United States Patent 9,487,797 (GENOMIC PLANT SEQUENCES AND USES THEREOF) - sequence listing, part 81

SEQ ID NO: 78263 - DNA, 643 bp, Oryza sativa
gaaccctacaaatttggtattaattgtgcaaatattttacgtgtaacttttagagatatggaaagtcgggaatggatgtatcattggccgaggtttttgtctccatatagaaacgaagtggctaaatttattggtattgccaaggttcacgctgagaagaacaatatgaggaagataatttgtccatgtgctgactgtaagaatgaaatagcctgggactttgacgatgcttttaaagtgaatgagcacttagtaactcgtggatttatggacaagtacgaaatatggacacttcatggcgaagaacaagtggacgggcctgaaaatgtagttccgacacaagttgaagacatggtgcataacgatggttctgttgaggacaaaatcgacctagaggaaatgttacgtcatgcagaactcgaggtgctgatggggttggctagagggctaaataactttgaagctttacagaaggcagcaaaggaagttttgtacgatgagtcgaagggctgtgacagtgagttcacaacactccggtcagttcttgaacttatgaagttaaaggtgagacatggatggtctgataccagtttcgacagtctgttagaacttctgcagaaaatgctaccgaggcctaactcac

SEQ ID NO: 78264 - DNA, 629 bp, Oryza sativa
tccatgacattggaatataaaatctccagatctctgcagggccacacactagtactgtcgctagccatggccctggtagtattaactaccactacgtacgcatgttcttgtggacatggattggagtgacctgagaggctggtgagcccttacaaaaatggtgaagcaccctaatcttccatgggagatcgagatcggtacagcatcttccttccttttatattccgcagggtatcaaattggagtattttttctctactcgtgtagcgatgaggagtgtagagtatctattggagcgccttgcaagcaacgccaaacgactactcctacacccaagacccaacttcccactcaactgtactgtactccactcgccgcacacactgacacagcgggcccacctgcagttagttctccggatcgcttcttccacctcgcgcgcacttcacctgcgctgcgcacacacgctccagtactccgccacgcgcacggctcttatcccgagctcgtgtcactggtggggtggggcccaccatgacaggcgaggcgtgggtcccgcaagcagggtcagcgcgcgagtccgagtaatattcccccacaacctctgccacaacggaaaacaacggcct

SEQ ID NO: 78265 - DNA, 20771 bp, Oryza sativa
ggcgggggggccggaacaccgagggcgaaggggaccgccctagggtttggagggttctacaaggggcatgctggaggaggaggaggggcctcagtaggctcttctggaaggttcgaatcctacacagctccatcatctctcacaaatcacacattacactagtatttttttggagaagaagaagaagatatgatatgagtatgacggcggcggcggcccccctcccttcctgttcctgtgcgctttgtggtggtggatcgagggttagttcaaaattttatacatgagcaaggaggtttttgcaaaattaccagatctcacgtggcatgcatacaaggtgaaaccaggcaccagcggtggaaggagcaggcacgcgacatagtcaaacgcgagattaacagtgagattaccggcaaactgtgttttcctgatcgcacacgcgctcacgtggagccgtaatcgcaagacgacaatgtgcaaattaaacaaggagaccaaaaaatttttaaaaaaaaggagaaaaagggtacggttaggctggttattgattgatgatatgtcacacgcacccctttcctattacagcattgtgaaaactcttttaatgtttttagcttccattactgcccacgcaattgtaacaaagtggctcatgctttagcagcctatagctataatagttctcagacgactcagttcagctgggatggttttcctccagatgtggaggaggtggttgccggcgatttagccgaaccagtggtataatggaatttaatgttcctctaaaaaaaccctgcttgctccaaggatgaggtggatcagactccacttccaaactactctaatccacttattaaaaatttccaacttgtgtttcaaacttttatctctactagaaaaaaatgtccgtgcgttgcaacgggtgaagactattttaatttttattatttttatacgaaattcactatgagaatttgcttggatatgtatttttctgaaaaaatcatgagctgcaattaggagtccgagtccgatcatctcaagttagcatgcgagtttttttaaaagagatttcttatgactcctgtattttataaaagcgaacgaacttaaaacctgactcaaatacggatatgtatctccaaatgcgaacgaacttaaaaaccgactcatacacggatgacgtactaaagtaccggcaaaaacatcttcaacttttataatagtagagatactaaaaaaaatatccgtgcgttgcaacgagtgaagcctatcttaatctgtgggaattcacttggatattgtttttacaagttagcatgcagttttttttataatagattacttatacaactccttctatgtgccagggttacggataagtcataccttctatcctacgacttatggaatatacagataaggtgtaccttcatgtacacggatcgtttccttgtataccatttggaatccattccaaattatggaaaatatatctacgagtctaagtgatttccaaaatcctactcggaagggatagaatttcggttacaccgtaccagatccaatatcctcaggtctttcttgggggtcaagatgattcatggtataaaagggaccctcggggaggggtgaaagggcatccaatttaatcgccaacacacccactatagtttacaaagccagagtacgcggggccaaatcgctgggagatctcatcgaaaccctcgaccacgatctcgttggtatgatctatttcgactactctctttgtaatatgttcttgtcattataaatcccatataaactggactagggctatgacctgataaggggcctgaaccagtataatccttatcttttgtttgcttgatgtcgtactacgtagaccctcattccaatgtaccccaacactctattcatccggtctgcgagtatcactcgtcgacactatgtttccaaaagagaatggaattaaaagctgactcaaatacgaatatgtaattccaaaagtcaataaaaacttaaagaacgactcaaatacggatgacgtatcaatttaccggtaaaaacatctttaatttttataatagtagagatctctaatttttgtaatatgtgtggtattcccatacataatacatataaactagagtatagttattactcatctagaggacccgagctagtataaatacatgtcctttgtctgcttgatccgatctcgcatacacactggttctaacgatctccatactctacaaatactacttgcggtgagacgacaaaccttgttgttatagctaaatatttcgtgaaccgcattaagttcaaacggattggtcttgccttagatcgcaagttgttcaaatgctcatggataacgaaattatttgagtaaatttcaaagaactactactattttgtcaaaagtatcagttatgacatttcaggtaactggaatagtggtatacaattgtatcgaaaagcttctactttatgtgtctgacaagttttggcccatgtgtcatacatatatatggggaaatgctgcgttttttaaataaaacagttctctattattcccattttttttgaaatattcaactaaagttatagcaaagtgatagttttgaccaaataattgcaatttatgaaatttactcacatcgttttgttggatgatttttttattatgtttacaaatcccgtctctcttctatctatatatgtggttacttaaccacaattcgtgggaatagaacacatttcctccaagatagtagataaggatgcagttttgtgctcaagcatgctaggaaaaagctaatgtcatgacaacgagttcccacttggagtgttgcctagcctttcatgagattccattcattttatgcctacttatgttattcctattgatgacttcatggtttactattggttttgtgtattagggaccaattaaatacatactaatttgtcaatctgggagaggggggcattattaatatcgatcgtatcatataccaaaactaacacttctgtctaatgttttggtaagcgccatcattggacattcttcttggtgtaatacttaagataattttcaatgaattgctccctcatgttaaggatatttgacgttgggagtattggttttagtactcatagtatatttagctgtagggagtattggttttgttttatatatttttagggtgttcctctaaaatcatacattagtgggataaggaacaccattttttgaaaacgtactaaaagtggatttcactggcctagatgattcttggaatttcctcttcttgttctatcaacaagtggctcatggttacttgtacgtagcccacttaatatagttcaaacttgtactcatgttttgactagcttgagctcatcatgttaccaagttcatgctctatgtttatttgaatgtttttaggtctcggggaataaattggttaaaacacaatgtttatgtgtttgtatttctaactaaaacgtattgtaaacttaaatatcaagttgtggtgtttcaaatgaattgtggaatctcccatgaatgtcaccttagttgtgctcaggtttacttatgtatgttaatgtcacttccagaaattcttgggcactatatattaggctacagcaaatgaaacttctcttaaaaagtgagataccaaatgaattcctatagcttcattttttaaaagagggggctcaattttattttaagaaacaacaaaatataaacatttacataaccgcatgtttgttcatcaatgaccaacatgaatgagcataaagagtagaggcaacagaaaacactagtgcgccaccaagatatttgatcaagagaagagttagcaacacataaaatgtctatctaaagaggagttaccaaatcaacatccatttcaccagaattatctaagaaacacattccattaagcctccttgtcattggtgccaaacccatagactttctaaacacgtcctcaatcacttgttagattttttttttgcacaatctagcatctcatagcgttttccttcaaactggattaatgtttatgtttgtcggagatatggacccggaggtatgcgaaatgagggaaatctaccttcccatcctgccacgtgtccctacagcctggtcctgcccccgcattccgcgaaccgcaggagcagccgagggggtcggggcctcggggtgccacgtcatgcccctcgggcccttgcaccgctttgccccgaggccctcgcccagccgccatttggcagggggagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtctgtgaccggcctgacgccggtcacgtctgactggacggacaaccgtgctcccatgtcgcatctgcttccggcggagtagaggtaggtatgacccgtcccatcggagggtcattcggacggcggccaccacaagtcttcacccattaatgagggaatgacagggttgtcccccgtgtcaggcgagggacagcgctgggccccgctcaagggcaagctgtggtttagcttccaggcgaaggcacgggtcgagttccggtcaagatagggtgggtccccacccgaaagaagagtaggtagaggcggtgcatgtggtatccccttaagatataaaaggaggacattgcccaccgagaaaggggacgactctcagtgaacttgagctctaggagaagagtgttctcctgagtttaggaacccttgtaactctcagtctaaatcccatacacaggagtagggtgttacgcttcatagcggcccgaacctgtataatttggttgtgtgcgagctagctaggagccttagggacagatacgtgatttctagaggcgagcttcttcccccggctgaactcacgaaaggggggtctcacgacctcccgctagagaggatcatccctcgacagctggcgtgccaggtagggggaagtcgcgcgctttaaagagaagtcgtttccttccgtcccaagtttcccttggccctcgacgatcatggtcgaggtcctggaggaggaggcggtgatgttcacccccactccgtctgggagtgaggatgctagcgagagctgcggccctcgtcaccgccgccgcaactctccaactcctccccgccgcgatccctcgcggagggaggaccccacccattcgggtggttcggccctctccccgcccccgggcggagggaggccacaacgcgtcagggcacggcgccgcctcacttatggtgacggcggctcgccccgaggcgcgcttcaagcagtgggtgtccttctgcggcatccccccgtgaactcggagccagagacccctgtccagcgctggttgggcgacgtggccaacttggtcactactgcccagtggcagttggccgcgggcggccgacccgccgtcaccggtacgtcgcgtacccccattaccctctcctcgtcagcaaggaggagggcccgtcggtcctggaggaggaggcggtggtgttcacccccactccgtctaggagtgaggatgctagcgagagccgcggccctcgtcaccgccgccgcaactctccaactactccccgccgcgatccctcgcggagggaggaccccacccattcgggtggttcagccctctccccgcccccgggcggagggaggccacaacgcgtcggggcacggcgccgcctcacttacggtgacggcggctcgccccgaggcgtgcttcaggcagtaggtgcccttctgcggcatccccccgtgaacttggagccggagacccctgtccagcgctggttgggtgacgtggccaacttggtcactattgcccagtggcagttggccgcgggcggccgacccgccgtcaccggtacgtcgcgtaccctcattatcctctcctcgtcagcaaggagagggcccgtcggtcggccacggcctcgaggcggtccacggatccaacatcgttgggggcctcaggaagccggaggcgtcacgacggtctctacggggagcaggacgctcgaatcaatatcgagcgacgccgggacgagcgccgagctgcccgcatgggggaaggcgcctcctcatctggagtgccacattcctcctcacgaggcggccctccccccacgctcacccctggagggacaggttgtagggccttcgtggcgagtctccggaatgtccggtggcccccgaagtttcaccctaacctcacggagaagtatgatggcagcatcaatccctccgagttcttccatatctacaccacgatcatcgtggcggcagggggcgacgaccgggtcatggcgaattatttccccatggccctcaagggtcaggcgcgcggctggttgatgacccagccccccgactccatctactcctgggaggacctgtgccagcagttcgtcacgaacttccagggcacatatccccgcccaggagaagaggcggacctgcacgctgtgcggcggaaggacgatgagtccctctgctcgtacatacagcgcttctgccaggtccgcaacactattccatgcattccggcccacgcggtcgtttatgcatttcggaatggcttgcagcataaccgcatgctggagaaaatcgctttcaaggagtccaagaccaccgctgagctcttcgagctggcggacaaggtggctcggaaggaggaggcgtgggcctggaactcccctggcatcggcgcggcggctgcggctacccccgagtctattccccgctctaagcggtgagataggaggggcaaaaggaaaccggcccgctccgatgacgagggccatgtccttgcggctaatgggcccgcacgggccccgtgcaagggaaaggccaccggcgacaagccgagctccactgctccatccggcgagggccagtcggcagacaagtggtgctcagtgcacaacacttatcggcacagtctcgccgactgccgctcggtcaagaatttggccgagcggttccggaaagccgatgaggagaagcggcagggtcgacgagagggcaaagcccccgcgaccccagccgatgaccggcgaggggaggccaagaagaaggcccccgccgatgatggcgatgacagcgaggatctggagttccagatacctcagggaaccatcgccacgcgcgatgggggggggggcttgcgctcacacctcccgccgaggcttcaaggccatgcggcgagaacttctggccaccgttccaacccacgaagcggcttggaaggcgcgctggtcagaggtgaagctcacctttgaccagagcgaccatccgacaatgctcgctcggggtgggaagttgaccctcgtggtctccccgaccattcacaacgtcgggatgaagcgcgtcctggttgacatgggggggggggcagcctgagcatcatctccccagctgccttcgacgcgctcaaggccccggggatgaagctccagccgtcgctgctgatcatcggcgtgactccgggacacacgtggcccctcggccacgttgagctcctggtaaccttcggcgactccaccaacttccgtaccgagcggatcgacttcgatgtggcggacctcaatctgccctacaatgcggtcctgggcagacctgcgttggtgaagttcatggccgccacccactacgcctacctccagatgaagatgccgggccctagtggtcccatcaccgtctttggtgatgtcaaagtcgccctcgcctgcgcggagcagcgcgccgacaacctggcggtggccacggagccacaggccctggaggcctccgcgtcccgcgcctccaagaagcacctcacctcggctgacgaggtgcccgtcaaggagatcccccttggagatgatccatccaagaccgccaaaattggcgggaccctggatgccaaataggaaagcgcgctcgtctccttcctgcgggcaaattccgatgtcttcgcatggaagccgtcgaacatgcccggggtccccaaggaggtgatcgagcaccacctcgccgtgcggccggatgcgcaacccgtccagcaaaaagtacggtgtcaagccccggagcgacaggccttcatctgagaggaagtggcatggctcctggaggttgacttcatccgcgaggttatccatccggagtggctggcgaacccggtggtcgtcccgaaggccaacgacaagctccggatgtgcatcgactacacggacctcaacaaggcatgccctaaagatcccttccctttaccacgcatagatcagatagtcgactccactgcggggtgcgaccttttgtgttttctagatgcctactcttggtatcaccaaatccgcatggctagggaagatgaggaaaaaactgtcttcgttactcctatgggcaccttttgttatacaactatgccttttgggttagagaatgcaggccttacttttcagcgtatgactcgtattactttgagtaatcagatagggcccaatatagaggcgtatgtcgatgacctagtggtaaagatgcgccaccaggacacgttgttgcaggatttggccgagactttcgacagtcttaggtccacacgcgtgaaactgaaccccgacaagtgtgtattcggtgtgccggcgggcaaactcctcggttttctagtcttctcctgaggcatagaagctaatcccgagaaaatacgcgcgatagagaggatgcgccccccagcaagcttagggatgtgcagtgcatcactggatgcatggccaccctaagtcgattcatatcgaggctgggagagagggcgctgcccctattcaagctcctcaagcgctccgggccgttcgtgtggacggaggaagctgagcaagctctcaatcagctgaaagcttacctcacctcccccccatcttggtagccccggggctagaggaaccattgctgctctacttggccgtgaccccccatgtggtgagtgccgccctagtattcgagcgtgaagagaacggaccggaggcccccttgactcgcgatggcccttcgtcccccgaagacccgatgcccgaagcccccagcccctgggaggaccccgaggcccccgtgggaggaggggaggctttggcaagtggtcctgaggcatatgatcctgacatgattcgagaccccccggggcccctgagcaagggcgccccagatcatctgcccctgacaacacggaccggccccaccgaaaggtgcagcggcccatctactttgtcagcgaggcactccgagatgcgaagacccgatacccacaggcccagaagatgctttatgcagtcttaatggcctcaaggaaattgcgccactattttcaagcgcatcgggtttccgtagtgacatcctaccctctcggccaaatcttgcacaaccgagagggtaatggtcgggttgtaaattgggccatcgagcttgctgagttcaacctgcactacgaaccacggcacgcgatcaaaagccaggtcttggctgacttcatcgcagagtggaccccagtagacgaccctgttccgtccaacgttccctccctccccggagatggagaggacccaaacgccaacattcgtggcgggcactgggttatgcatttcgatggctccctcaaccttcaaggtgcaagtgccggagtcacgctgacttcgccaagcggggacgtcctcaaatacgtcgttcggctcgacttccgagccacgaacaacatggcggaatacgaatgactcctcgcggggttgagggcggcggccggaatgggcatccgccatcttctggtcctaggcgactcccagctggttgtgaatcaagtatccaaagaataccagtgcaccgacccacaaatggacgcatatgtccacgaagtgtggcgcatggcatcgatctcatagccgacacccatcagggtgagtgcggggcccattcggcctcacgcactttggtcggtaaagccttccgacaaggtttttactggccgactgcgttgcaagatgcccaagaatgggtccggcggtgcaaggcatgctagttccacgccaagcaaacccaccagccggcccaagccttgcaggtcatcctactctcttggcctttcgcggtctgggggctagacatcctcggaccattcaaagcggctcgaggcgggtatcaacacctgtacatcgccatcgacaagttcaccaagtggcccgaagcttatccagtcgtcaagatcgacaagcattccgccctcaagttcatcaggggcatcacgtcccaattcggagtgctcaaccgtatcattacagacaacggcacccagttcaccagtgagctgttcggcgactattgcaatgacatgggcatcaaattgtgctttgcctcgcccgcccaccccaagagcaacggccaagtcgagcgagccaacgccgaaatcctcaaaggcctcaagaccaagacgtacaacgtcctgaagaaacatggggattcgtggctcgaggagttgcccaccgtgttgtgggcaaatcggaccactccaagtcgcgccacgggggaaacgccttttttcctggtgtatggcgccgaggcggtcctaccttcggagctttccctgggatcgcctcgcgtcgcgctatatgatgaggccaaccaggatgatcttcgccgcgacgacctcgactatcttgaagagtggagaaggcgcgcggccctacatgcggcgcactaaaaacaaagcctgcggcgctaccatcagcgccacgtccgggccccgtcactgcaagttggcgacctcgtcctacgccgcgtacagtcgcgtctggggctaagcaagctctcgccaatgtgggaagggacatacaaagtgatcgacgttccccggccaggctctgttcgactaaccacggaggacggcacggagttgcctaacccctggaatatcgaacaactccgtcgcttctatccatagcgtcgcagttttttgctttccaggagctcgggccaacccccgcacaacccctcggcttgtgcgggcttggccgggggctaccactgtgaattactttgtatctttttccctttccaagcaataaatttttccacctaaagtggaggccgttacgcgccctttcttctcactctttcctctggcttgtcctggttcaaaggacaattcgcgcttactctgaaccctaagtgccgttgggcgacctaaaaaccgctgaaagggagcccaaacgcgggccgcgccccgggttgcgccgaaccccgggagctcagaagggcctacacacggccgtccccgacccccggtcgtcgtagcctcggtctggccagtcccgctgggcggctccctcgggaccacggaccgagcgcggatttaccttttcgcaagaacgagcccgagagggggatggggtaaaaacggcatttcgatcacagggaggttaattatatacttttgctcttgttttttcttctttccgtgccgcaggcattcaagggagaaagcaaaggggtagaaaatgcgaaggggaagctttatttatagacaagacggcacgatagcctaaagacaagaagtgtctgctgcagacacacaacaaaaggaaattaaaagtggggataatcatggagtgcccgggcccccgaggtcggcgccgctgaccacgtcgtcccagtcctcgccatcggcgtcgtcaccaccggcgtcgtcaccaccgtcttcgctcccgttctcctcatccgaggcaagcccgaaggtgaactgaggggccgacccctcgaagttagagacgatcgcgtcggccgcctccgggacttgctccagagcccttgcctcggttcccgggggaaattctcaagtgcgcgccatgggacgaagtcgggatcacgggcttggtggctcgtgaggaccagttccaccgtggcccgcgccatggaagccgatgacgttttcacgatgtcgccggcctcctcctccagcctctccagatccgccgccagcccgtccagccggagcgcgagtgccggctgtgtgggccgtccagccggagcgcgagtgccggttgtgtgggcgggagcttcctatcccggcgcacggagatgccgactcggcgccccgcgcgctccagccgatcgacagcatcggagagctgcccggggccgatctcgttggtaaggcggagggtcgcgacctccctagcctggtcttgcaccaggagctctaggtcggtaagagtgctctaagccgcggtaagctggctcaccaactccgcgccgccgggctgcccgcccaccgctaggtccttctcccgggcctccagctcagaagccctcgccgccatcgccgcgcactcggcacgagcactctccagatgccgagcctcgcgcccggcaacggcctcctcgtgtttcgcgagttgctcgcccagctggcgcgaggccacttcacggcggttcacctcggctttgcactcggcgagtgcggcatcccgttcccggcacgcctcttcccggagccatagctccttcgcgcgacgggccgccgaagctttcacggcgagggtggtccggtcacgctcggctgcagcctcctcacaaaggcgaagggaggcctccgcctctgccgctgttctctcatgggaggccaaggtggactcccgctgatctagcaggcgcgctcgctcctccagcgccttagcccgcctctccagctcctgggctcgctgcgcctgctcctggctgcgcgcgtcttgctcgcgctggctctggtcgaggacctcgattcgccgacgaatcgtggcctcaaactcctgcgcggagcgggcacgctcatctaaggccttgcgttcagcctcgagcgccgccgtccgagcccgcagcgaggcgttggcttccgatacccaccgctctcgggcggcagccgcatcgaggacaccgcgggcgtccttaaccctcttcgccaggtcctcggcatgggcctcgtaccgtaggcgaatgtcacctagctcttcattcaggacgcttgaagcgatcagtgctgcctgccgctcttcctccgtctcacgcatgacggagtccagcgtctcctcgcgcacctggatttcagctagttgggcttggcgcattttgcgtcccatattcaccatgtcgtccacggcgcggcgcccctcgtcaacctgcgtgcggtccgcagcgagctgtgcctactctgcctccagggccgctcgttcttccgccagggcttgaacttgggcattgagcccctctcggacggtggaatcggcggcggcgagcacctgcaggagcggcttcatacttgctagagtcggagaagaaaaagttgcggtcagtccatgggacgatagagtgctgctggatcccccgcgagactgggggcttctctcagccccatttctgcgaggccatccccgaggactccccaagtgcaagggagagcggctgttcctctcgccccccacttcgggccctcgggtagattcggccttgttctcaggctcgggcccgcccccagtttcggcctcggcctcgggctcagggccgcctctagcctcggcttccgggccgcgacctccctcgccccctgctcccgggtggcgctccgcatggatccgggcctcggagtcgcccccgggagagacgccgccgccgctatcgctcgcggcgggtcgagtcccggctgaggtgaacccagggtcggacccagtgtgtggcccatgggccccgccgggaggctatgaaggccccgcggccctggatcggccaagcccgggccgctccgatcgttcggactttgtcccctgcaaagggtcggaccccgagatcccctgggaaggaatctcgctgcaaaagaactctgatcgcgttaacgaagaaaaagaagaggaaggaacaagagaccgagatgagtaaaaagcaccgaagcgagtgccggcagtcgtacctgcgaggagggcgattgaaagtccacttcgggggctcaatgaagctctcccgacacggctccgtttgacctatcttccggagccgcttcttcttccgtccggcctcaggcgcggcggggcgcttgtggcccgccggcggttggtccgccacgcgcttggcgccccctccgcgcgggggagagggcggtcgagatttggacatcttccgcttcccttttgggtcgctggctgagtcgaccccgggtccacggcttgggctgggtgccctagagctgccacccccgccggggccgctggtccgactcccgcctgcggtcgcgccacagccacccacgccgacagcgccaccaccggtaccgccccggcgggaccgactcctgccggtgctgacggtcgacatcacccaggatactctcccggtcgcggtcgctgcagaggggaaggatcccgtctagaatcagtgtttgctcggcggtgtccagacccaacacccgccgaatcaccgtcttcgcgtcctcctcgccccaatcccaacgcttgcccacatgcgtgcgcatggggtcgttgggtccagtgtactcccacgcgccacgtgatttatcttggagaggcgcgatgcggcggcagaagtagtcgccaaagaccattgcccccgtaaggcccaggcttcgcaggcccctgaggcgatcccgcaccgcgtcgtactcctcgcccaactccgaaaccgctagccacgtggcggatcgttcgagagggccagcgggaagccgaagttgcgggtggtccggcagcgcggtgtagaaccagtccttcttccagtcctcccatttcttgcggagatgactctcgatgtattgccccgccgtgcctggccagggctggaagtaacatccccccaccaccgcaccttgcagcagttgcgggacgaagaaagactggaacagccgcatcgtcggccgcaccccgatgaacatctcgcatagatgcgcgaagatggccagcgtcatcacggcgttgggtgcgagatgcaaggcatggatttcatagaaatccaaaacctcgtggaataatccggagaatggcgggatcaaccccgccatagcaaaggacaggaggtgcacagatcgctccgggtatcgcggccgcggccacgactcccccgccctcacggcggcgtcttccggcataatcttgcgggggagactaagatgcctatccgccgtaatgcgcgatgccgaaagcactgcgtcgccagcatcttgagccatgatgaccggtggagaaacgacgaggggcttggcgtgcggaatagcgtggagtggcgagaatgttagggcttagggagcgagtatgcgggtgagcagttggcaaaaggaaggaggcaaagtccccgcctccgtatccttttatccttgcctcgcccgcgctcgccttctcgtttcacgccctcacggttgcccccatgattctcgcgcctgcagttgcctcatcgtttatcgcgaccactcatcacgtcgcccactgaatcctcgccccgcatttagtgcgcctgtcaacagcacactcggtgtagggcgtgcggcggtcacgggcgcaatctgggcgaactgtcaccagtaccgccgcatacgtggcgggcgagggagttgaggtgtggtctaaccgaccccctgattttcgcgccttaagcatcctcatcatcagcgcggtcagtggcggtcaaaccgctgttgtggttgatacgccaacccggccactcggcggcatccgcttagattccctgccgggcccacaaccccagcttgggaagtcgcgaggcaccacatcagaccgacctcaggaggccaatgtccgatgtggtgccgggggctactgtcggagatatgggcccgggggtatgcgaaatgaggggaatctactttcccatcctgccacgtgtccttacagcctggttctgcccccgcattccgtgaaccgcaggagcggccgggggggtcggggcctcggggtgccacgtcatgccccttgttaacagtgaaatttggtaatcggcaaagacgtcatcggcttagaatcattatcggctgcagcatctcggaatcagccgatgggagttataaagtcgccaatagtcggattcctgctatattcgattaaggaaatcaatctattaaaggaagcttatccctaagtgaccgagtttaaagaggatgcggcatggtagtttatctattaattaggaatagtttgttagtttccttttatctttaggaaagtgtgtttagtgtccgataaggactttatattttccttttatctttaggttagtttctttcttgtccgacaaggacttgtatcaacccatgggtataaatatgtacacccggggtctatgtaatcgattctcacgatcaatacaattcggcgcatcgccacccttttatttctacttttgtttttacgttccggcggaacttggcacccgacgcggggctgcatcgtctttgatctccggcgaagggataagtccaatgttctgctggcccaggccattgtatcgtctacgtcggcgttgttcaaggctgcatcagtacattcgacctcttggattgctctggtttggatgatatacttgcctacctatttatcatatgtctctgttaatctagtcttagcatatcgatttagctctatcggttgcttctcgttttagggtttctgccggtatcggctaaatcgtgttgctagattatattagcttagacatctaccaccctgaaaactcagcaacggcttgattatctagatattatgtttcttttcatacttagtgctgcatcagttaagtttgatctactaagtcatgcttagaaccataatctctagcctgcttcttgattgccaataagggtatcatcggggtttcagccggtgagttatctggacgttgcatcggctcataaggattgcatatacatataagtaggatttagccgatgacaacaaaggtttcactgtttaatctaatcttatggatttcatgacatcggacctccagccgatgtgtgctttgaccttcggatcgatgcttatttatcatatcattatttgtcgattggtttatactggattatattgttattttattacatcgttgttagccgattgcctttatattattatctacattggacatatagccgattgcttaaaccctatcgctatcggctggtatcggcattggctattatcggcatcggctggaactactccatcggcttgtcagcccatcggctgtttagatctactatttgcatatcttgtcagttgcaggatcaaactgactggcacgctcgcatctcatcaatatttggacctgcacaggagctaagcagatctcctaggccggtgtgttcaattttttcgtcaacacccctcgggcccttgcaccgctttgccccgaggccctcgcccagccaccatttggcaggggaagcgagcgaggagggggcccaggctgaaccccctttaatgcgcgcagcgccccaactgccccctgtcgcatttaatgcagtggggtagacgtgcggcgtgctaaactgacgcgcaatagtcaagaatgaccggtatgtgaccggcctgacgccggtcacgtctgactggacggacaaccgtgctcccacgtcgcatctgcttccggcggagtggaggtaggtatgacccgtcccattggagggtcattcggacggcggccaccacaagtcttcacctattaatgagggaatgacagggctgtcccctgtgtcaggcgagggacggcgctgggtcctactcaagggcaagctgtggtttagcttcaaggcgaaggcacgggttgagttccggtcaagatagggtgggtccccacccgaaagaagagtaggtagaggcggtgcatgtggtatccccttgagatataaaaggaggatcttgcccaccgagaaaggggacgactctcagtgaactagagctctaggagaagagtgttctcccgagtttaggaacccttgtaactctcagtctaaatcccatacacaggagtagggtgttacgcttcatagcggcccgaacctgtataatttggttgtgtgcgagctaactaggagccttagggacggatacgtgatttctagaggcgagcttcttccctcggccgaactcacgaaagggggggtctcatgacctcccgctagagaggatcatccctcgacaatgttgtacatcaacaagttggatccaataaacggcatacttaggaagttttccacatcacccaataaatatatgaagtaatcacaacattatcatttctcatttttttggaatatgttctagcaatgaattcaaaccaaaaggtatattgccaatctgaaatcacacctaacaaatggataaaagcttacattcacccactttccctagttcccctttttttctttggcaatttctcattgtgaattagtcaaaaagcagcacccaaatgatataatcacttctatgaaattttattttcaaataagacaaatgtgcaaataaacacaaaattgttttcatgttcaaagaacttttctttatcatcttccattataaagacgatgtcatcaacatactgtagaattgagaccctatagcattcagcaaaatgtgacacccttcctttgatcaaaccttttcaattgtttggttaataagcaaagtcaatgcaacatcccccgctatgttaaaagggagtggagcaatatatattcttgccttaaaaccttgtaagacacatgcttataagttcattaagcatagttgcaacacaacctccccttaccaccttaaaaatcgaaccacaccatttatctatctccaaaacatttttggccataaatttgttatacaaaagaaccatctcgcatttcgtcacatactttctcaaagtttaccttaaaaagcacccatacattttttcccatatgaacttcttgaattatttcatgtaaacttaatatccctttccattatgaaccaatatttcaagaatgcaacttgactattgaactcaaccttttggatcactctaaccaacctacttatcacccctttggtgagaattttataactcatcacgtcgagtacacaaataggcctaaatttctatatggtcaaagtatcaatgtatcaaggttatacatagtttaatctctctatatctaaaaccgcattgtaaaaaccctcaaaaactttcagaagatcctatgtgatcacttcctagaagaattggtaaaatatttgtaggaagctattaggaccatgggcggccttattctttctcttctaaataaaacatgtggtttaatttcttccaatgaaaaaggtccattcagagatttcggattcagttcatccatttatatattcctaatatattagtgtcactgtggggccaaacaattttttatataaaagaagatgtcacatgttccatcaattccttctcatcttctatcatcttgaagattttattatatccaaagtgattgcacggtttagaataacgtcactaagtttgtatttaataattgtagctcccggagctaccatgctcctcttcatctggtattctgttcataattgtggcctttaacaagccttagtttgtactcctttctatatctcttataaataaaagaggaagatctcctgctcccttttttatataaaaaggaatatatatatatatatatatatatatatatatatatataggccaaccaaatgaagttctttcgaaccatgtgtttcaactttcaacaatggaattgaaaccaaagctccaagagttcctgagattttctgaaaaaaaaacaggtgttatattgagcaaatgaaaagaaagaagtttcagattgtttagtgagcaacgaagtccaaaatcacaaggttagcacatgatgtcggttaccatttaatttgcttctctataaattgtgttgtccaaactaaaatcgttgttgtgttctggttagttgtgaatttcttttgaggtgataaataggaagaaatgtgtacgacgttctcttgtgttaagcaaactcagcagagcttcagtgtgtactagtagtagtatagtatagcaaaagaagtgacgaattaattgtctttagaataaaatgttcttgctacattgcacaagtaattctcaaaaaaatacattgcacaagtgaattatttaacggtgacagcacgtgttgacataaaataaaactgaagagagaaataattaaaatacgtactcgatccacttttataagaaaagagaaaacgttgtcctcaagacctgtgtgtgccatgtgaagcaaggcgataaaaggcatgaagagaatcaggggtggtgaagaaggatgggagaatatggagcaagccagccaggtgaagctgaagctgcaagggccaagggctaggctacgaggaaggatggaagatgagaagaaaaaaaaagaggcactactgtacatgtgggggtaggaaatcaaaaggattcagctcaagccacacaagaggaaagcaaaaaaggaagatgcaaagcagtgcacatatataaaaagcactgctcctcagccacaccaagcaaaggataggagaaagctaacct

SEQ ID NO: 78266 - DNA, 1153 bp, Oryza sativa
aggagagccaacgcctagaccaacgtatagcaatggtagtcttttttcatgagatttcccgtagtattttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacacttaaataagcgtacattactctatagtt

SEQ ID NO: 78267 - DNA, 1111 bp, Oryza sativa
tactcaaatggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatct

SEQ ID NO: 78268 - DNA, 1504 bp, Oryza sativa
aatatgcccaatatagtaattttactttctgttaatttgtccacccaatcttaaaaaggctggctttccagcacagagggagtaggcttctttgtattcctcagggaagactccaaatggtagttgtttggccgtcgtcggctcgtcgcctcgtagagatgcatccagggtttacattaccggttgaccactaaatttcgagctatatcgtatcacggttttcgataaatttcgaccaaatctactgtttaaccttcgaaattctaatcagaacttaattttgagtcatgccaaaacgtcgaaatttcacagaattcgaccagtttttgttggaattgtgaacgctggatgcatcatgattcatgtcgccgtctcccactctctcgctactgccaccgcggcgccccgcgcgtccagtgttcccatccctgcggagttgggagacaacgctctcgaaatcgattctctgctcgcatcctgccctcatccaacattccaacacaaggcacgcacacatacatgacagtaacttggcagctgcaaatgcgggcagtatgcacagcacgtagtcacgtatagaagaacggtacagtacgacacaaccaagcagataccagctggccagctcgagccttctcgttggtggtcaacccaaatgtagtaagcttttgtatctcttttccaaggctcgcctggcctggggcaggagaacccgagcttctccgccatggggatctccgccgccgccgccgccgcccccttccttctcctcgtcgccctgctgctgctgctgccgtcccccgccgcggccttctccttcacctacaacttcacctcggcggacacggcgcggtcgggcatcgcgttccagggcgacgccttcttcaacaagttcatccgccttacccgcgacgagcgcatcggccccatcaccagcagcgccgggagggccttcttctcgcgccccgtcccgctctgcgaccccgtctcccgccgccgcgcctccttctccaccgccttctccttctccatcgccgcccccgacccctccgccgcctccggcgatggcctcgccttcttcctctcccccttcccctccgtcctccccaacagctccgccggcggcctcctcggcctcttcaactccttctcacgcgggggcgcagcggcggcgcacccgcgcccgctcgtcgccgtcgaattcgacacctacaagaacgagtgggaccccagcgacgaccacgtcggcgttgacctcggcgggattgtctccgccgccaccgtcgactggcccaccagcatgaaggacggccggagggcgcacgcgcgcgtcgcgtacgacggccaggccaagaacctcaccgtcgcgctctcctacggcgacgcggcggcggcggcggccctgacggaccccgtgctctggtacgccgtcgatctgatggagtacctccccgacgccgtcgccgtcggcttctccgccgccacgggcgaggccgcgagctgc

SEQ ID NO: 78269 - DNA, 502 bp, Oryza sativa
acagcccagggcagtttaagggaggccccaaaattaagcgtcctctttatataacggattcacggcctctatcgtacgaggctacaggttggacgcttgccgtggacaaacggctgaagtgaaggcactagccgccgcgagcatgaatttcaccgtattttatcaaaccagacggcgaagtaggacaacgttccgcccctttcgatgaaaaagtcagaactcaggacgaaaggttctacatctagaatccgcaggtccaagcaggatggagataataatatctccattctcccggccgcaatacaaggaatcctgatttgtaagcttggattacgtgagacactaatacgggacagtgtggcccacatgacaaacagacccacgtagcagtatggccagtatgtattgaaccggttctgctcggctcttacgggctacagctaggtagagaccaatcaatcacgcacgcactgggacagtcctcgccgatgattagaaatcc

SEQ ID NO: 78270 - DNA, 1023 bp, Oryza sativa
tcatattaatctattttttaagtttataataattaaaactcaattaatcacacgttattatcacctcatttgcgtgaaatgttgaaaatttagttataattcggtatattttaatccaaaataacaagataataaacatgatatttacaataggatttgatccagtgatagtggtgaatgtaatcaacattagcatgcttaacgtagaataagcatcaacaaccacataataacgcaatgttgatattacgatgaacattaacagtaaaacttctaattaaaataatataagaaggttataccccaagaatagtcctccgttggagtttgaggcggtattgcctccgttggtgttgacgggaacctccttctccttgtctctagtgttgccgttgtcatgttgccgctgtctccaatgttcgacatgttagtgaagacgaagtagacattgacgaacgcagtgagtagtcacgccttgcgctctccaaaaacctgatcgcccgtccgtccgtgcaaacgtcgcaacagtgcgtggtttcagaggcatactctcccaaacgtcgcagcagtgcgtggtttcggaggcatactctcccaacgcgtgtgcacacactcgtcaggatgggattaccgtagcagcaacagccttggaaatggatgaaagtgtgtctcccttcttcttagggagatcaaatccattctcattttataggaggaatggaagatgaagagtaagagtcatggaataggaagaggaatagagtaactaattctcatcaattagccatcaaccatcctccactacacaaccatcaaccaaccatcaattagaagtaattgatgtaggttaccaatggaatagaaagagaaatagagcaactaattgttatcaactagccatgtgaaagtgcatctaggcccctaatgattttggtgattaattacaatgcgattagagaggactaacatttttattcaagtaaatgtgaaggttgttatgtccttaatgagttaaagtaatgc

SEQ ID NO: 78271 - DNA, 703 bp, Oryza sativa
tcggcggcggagacgaggtcgcggacgtaggcgcgctccagcttctccgtcgccttgatgatggcgtacaggtcggcgaggctctccaggagctcccgctcccgcttgtcgttccacagcttcacctccatctccgccgccggcgagggggtcccctagcctcccttccctccctctccctctccggcgagcgaatcgcggtgggggctagggttccgccgcgtcgcgcgagattggggaaagaggaggaggagagggatcgcgatgggggagtttaggaggtcgaagaattgcgaggggcttcgtgtaaaagtgaagcgatctgtgtaagactgtgttaagcccaacgcgtttgttttgcctttcttccaaagttattactcgacctctcgacgagaaccaaacgcaactacgaattgcacggcagcttctgtcgttcgtttcttccactgcagtttttgcgtcctctcaatagaaacaggctttgcggttaagctcagctgttccaccgcacctaagacgagctaaatcattaatgtataatttaagagcttgttcactttgttaccatttttaactttaccttttttttaagttataaaaaaaagtagctgcatttagtttgttgccaaattttagtaagtacatatgaaatcttgcgaaaatttgacaaatttaccaaaattttggtaaccttatcgaa

SEQ ID NO: 78272 - DNA, 4260 bp, Oryza sativa
  unsure (1)..(4260): unsure at all n locations
cattttgttcaagtgtgagacttctcatgcaagctgcataagaattacggtgacccaacattacacagcctttggtggcatgccgcgttcatcgttcccatgaagctaacatttgctaagtaatgagtcatgctacctaggatagaggaatgcctccctagaataatttagagtggaatctgaagaagaatgttgcttgtaatttattgatctttctgttaattttgtgtaataaacccaatttcatcgaagaactaatgaaaaaatatgcacacacggtccaacacaaactaagtagcagcttgagtattacactctgcaagtcctattcaaataatgttaatatgcatttttttattttattttgcaaatcaatgatgctaccattctaatgcttaagttgttttgccatccagggaccagcgttatcatgaatgagcttacgattggttctatcgccaacttggaagcaccgatagcagaagtggtactaacttggagggtaacgatatgacatattgatagagagaatggcacaaaggtgcacgatgttttgttcttgtttttaagttctcattgttgtgttagtgacgatttccttttgaaaggggcctttatgcaatatcccacttacccaaaagaacagtgatgagatatcaaagctaaggccaaagaattggttgtttgtcattacagttcggcatttccttttttatactgagatttgtctgttgattcacagatttttttacgagtaccacatcatcgcgtatgttgtgttatctcgttgtcatttttttttaaaaaaaaatattctagagcatgagcattaggcattagcagtggctttgaacaagagccagaaacttattaccatcttaatgatgctatcaatagtttcagtgccaaatagctaaggcagttagaactttcaggcttgcagatgttacgtatgacgttagtaatcgcaaaggttgatcatgtccattggtggaataggcatgtcagcatggcaacatatacaaggcgtttcggtaggtattgatcaaatcattgaaaacttggaggactccatcactgttctctgttcttatcctggttcctggtgctcttaccatcttcaacgttaaattcacatgtccagataacccgaacacacctaccaatccaatgcaacaggtccttttgaagtcggatctagaacaacttactgcaatgaacacagatgctttcatgctcagatatacagtaagcgaacaaggttaaccagaagagataaaattggaaacaatagcgtatcaacatcacaacgcattcacctttgaagctggatgacgctgatacagctgttcaaatagccttgctgacactggctaaacagctgaaggagaaaacatggtttgagaacttctcacttacacaagcatagctttaatttaatggtcatgagagactccgcagctagctttcagcattgcatgataaatttctgactgctgaaattataactactgaaaacaaatgttgatactgcatcctgcaagctaggataatgtgagacaggatctaaagacggaaatattagctcagagaacatagcataaagatccacagctgtgcaatgatttctaggcaatacaaaaaaggataaatcgctaagataacaaggagagggatcgcgccgagatcatctaccatctaaataatttaataatataaactacctctgaactcaagtacacaaccagtcctcggaatgcatttaaccagataaaacctaaaaaattgctcactcgaccagcgaacaagtcgtccggcctggccagtgggcattcctagctctaagtcagtaacgcgaacatcttatgatcccttagctccagtcttcattacgcatttccctgaatttagaacatgcaaagttgatgcaaggcaaaatatgttagcatgtgcaaatgaacaatgaacatggttgggataaatgatcagggttctatttacctccaaatggcgacatatccagtttagcctgcaccatctaaggaacttgaggaaccattggcaggtatttgagatcatacctgagaagggctggaccaaatgcattatactttcccgaactgctatatgcctgttcagcatcagcactcttagaaaacactactcttgcgatctttgatttcttgttgatttcagtcgcaccctccatgattggcccgtgcatacggaatatactattgatgtcatccacagaagggatggcttctgcattactaaaatgtaagatcagagctgccggtccatctgcctgtttcacagcaggtgaatcagcagaggcctcatcttgaggtgcaacctcctgcttcatcttcttattaaaactcctgttctgagacagccgcttcattttgcggccctcatagtcacttgatgtgtctccatcatcaaaatcactgattataatatcacaccaatatgagtcttctgcctttcttgctgagtagatactccctgctgacttcctccgacccctatggccatccgccacctctaagtcaccttcttcttttgcagctgggtacaagcttctggccgtattttttctacctttcttgccacccaatgtctgcagcagctccttgtcgtcgtatgtggccggcacttctgagtccttgtattttgagaagaagctaagaatgacaggcacagagtcatagcccttgaagttgaatggatcagcagcaacggatgtaagctgtagaaacatgtcagcggctggtggatattgatactccactgtttcttggatcacctcgtcctcgtccttgaggtgtgcaggcctcccagcattgtttttcctaggcctcccgcgtggcctcccgcgtggtgcaccgctgcccctgccgcccttggagaccctcttgcggtcgaaatcgacttcggaatcggagtcagtggcacccttcttgcgtgggtcccaatcctcatcggagtcatcgaggatttcctcctccacctccttcctcttcctccccctcctcctggatggggggtaggagttgcagttgttgggagtggctgcggcggcggagacattgggtaggccgaggtggagggtgtactcgggagggtcgggtaggcccctgaacttgtcgaaggctctgagatgcgccttagcgacggcggcgtggacacggttggagaagcccatgcggtgggcggccaaatcgtgcagcagggcgatgaaatcgcgggggaggaaggggcgggcgatgcggccgggagcggtgagggcaagctcaacgcggcgctcgaactcgaggagggaggcatcgagggcggcgtcgaagtcgtcggcctcgccatcgtagagctcggcgacggggaagtagggctcgtagggcctgagctgggcggcgtcgcaccaggcgagggccttgtcgccgaagaaggagacgaggagctgggcgccggtgggggcggcggagatgacctcgccgggccaggccgggtgggagagcttcttgccccagaccaggtcgccgggggcgaaggggcatgcacctgctcctgctcctgcccctgctcctgctcctgatggaggatgaggattcggatccgtagccggtggcggtggcggtgggggattcttcctggggcggccgcggccacgcttgggcggcgctagggtttgggggtcagcggcggagttgaggtcgaagggtgtggacatggtgagcgcaagctagggtttggattggtggatgggaaaagtggggatcgatcgatcgatcggagcggaatggattctttggtaagggcttgagacttgagaggctttgggcggaggaatggaatggatgatccaatccaccctcctcttctcttctctagtagcctcctctcctctcctctctcctgtgagtgactactctctactggtgtactgaggaggaggatgagggtttgtcagtgatgctgtgcctcactgctactgttattatttactactactgtagcacggcaaagttaaatcaggggtaaacatcaatgctcactatctcatctcatctacgaaaaacaacctctcttccaatcttccaatactcccgtttcgnaaaccatgacaaagagtggataaactttttggatttttatggcacgttttttgaaactactaaacggtgtgtttcgtgtgaaaaccttttacggtgtgtttcgtgtgaaaaccttttatatgaaagttattctaaaatatca

SEQ ID NO: 78273 - DNA, 10945 bp, Oryza sativa
  unsure (1)..(10945): unsure at all n locations
tgaatggggnnnnnnnnattgagcgcccgtcgtgtgatggatctcacctagatctgattggtatcggcttgcggcactaagtgcagacaaaacatgtggatggtatcagttnnnttgaacctctgccgacatgtgggaccactacaccggcgcaccccgccggccagccttcgcacgtcgaagaccgcgccacacgcaccggcagctcctcctcgcaccgtagtcgcctcctccaccaccagtcgcgcctcttgcgccgcgctggtcagatgtggccgtctgccacacccttggctagccgtccgagtctgccatgcttcctcccaccacaaccacggtctccacagcgctgccactggctcgagctcgccctccgtgtttcctctcacagacgccgtcgccagcctcagccatcgccgccatcagccaccgccgctgccaccacgggcgctgcctcagccgctgccgccgtcgtccatcaccagccgcgcctccagccgctcgtaccaacggccggccaccgttgtctccgcaagcctcgcgtcgtcgtcgctcgccccgctgccgctgactcgtcgctgcgagctccaccgccaccaccgccgccagctcgccccgcctagccagatccgcctctgacgcaccactgccttccccgccgccgtcgccatccccgctgccttcgatccagccgcccggcacagctcgcccctaccgtcgccgtcgccatcccagccgccagatccggccggagcgacgcggatctggcggtcaccgccgccaccacccagagtggttccccaggccacccgggcaaggtctgacggcgagaaacgaggagccccgccgccgccgtccttgcaaccgcgtggctttgccggcgcccgctcagccggcggcgaggcgttgaagaaagatggggggagggggtggccggcgctcatcgcctcccgtgccacctctgataaggaagggcgaagcgagagcgtgctcgttcctgccttgtatatttataaaaaaggaaaatagaaagtgttacgatgtacaagcatgtggtgccaaaaaccatctctatgaacttatgaatgttagaaagtataactcgctgatggtatcttttgttctagaatcgtgattatacaactgatttagtatttttaatttctaatgctgataacgagcatatatacatgtaagctaatctggaaatatacaaagtgaagaaaaaccaaagccaaagtccaaactgctgcatgcctctatcttcttgcaacaaggacgtcctgtggggtgtaaccttgtaaatgtgtgatcatccatcaaagtcgtcatgatactgtccaagcacacacgttcataatcacaattttactaacatgaagatgatataaaaaaaagtatccattggtagctgatgaaaaagcaagataatattatcctcgatagtctactaatgatcaaaatataacatcttggttagaactaccattgtcggtgaaatgaaaaacaaaatcctcatcgctagcgactcagggcatgtctgcccccagggtgctatcctcatgggttgtgctcgaggcacttcactcctcgggacgaccccttgtgggttgtgctcagggcacaactgtgctttgcccccaagtgctcggaagagcaacagcgcattgttaactctcgcaagctcagacttcctcacgtgtgtattctatcaagcctcacactcagtgcgcaaggtgtatatgccaacctggtgtgcgaccggacaacacgcaataggacgaagcacacctatcccctgtagcacgtgtcaccctggaaaaacttttgacttcttcacttcactcgttaatcggcatgtgaaacagtcacctccgctaggcctaagggatatcgacaagaccaagcatgccgaacttaaggagtagggcccactctcatatgtacatattggtaccgtggacccccccccctccccgtttataaaaggaggatccacaccacctgtaagggggcttgcttttttcgatgtcagattaggcggagttaattagactgattcaagccaagttagaataaactcacacttcaagagaagaagagttcatcatctcctacttagaacaacatccacccaatctacattgtaaactttatcaccctcattcataacaagaacacaagagtagggtgatacgcttccgagcagcctaaacttgtctaaaaagaccatatgttcttatttgcatgattcgattgcctcgtttccgctcacccattccatagccaaatcttccttggggggtgccactcctccccgctgaaggagctccatacaaccattgatatacataaataaggcttgccaccaatgcaacaaaacactaaagtgattctctatctatttgtagcctgccaatagataactatttttttcatatatccctattaaaataaaacaaatcatagagacgtgtgaaagatatatgtgatataataggaggtcaattatcagaatccttagagataatttgagatgaaccgtctcatattatgccattgcaactacaagtgctcaattatcacaaaacaaaatttaaatcattttgtgaatgttgctataatatatttattgaaactacagggaccatctaacatccatgatgatcggttatttcataattttacaagtagggatatttaggatttgatactcataaaggtggcatttcaggatcccaaaaaaaaacctccgtgcctatgacatggtggttgttctgatcccacaataacagatgcgtgagtggtacatcctaaattgtaactatttatagatcaaaaaattcaaaatccctcttttaagtaaggaactagttgtgataatacatcacaatggattgagaaatttttcacgccttaagggtgtctcatcattgattcattgtatcaaaatacatgccaatactagttatgaaaaaaaactggtagcattggtataataaatatatgtctactatccgaagatttgaggactaattaagttcgactcacaatgagaaacataaatgacaaattcaaattgtaaatattgcactattcatgggtatatatattttgccttctttttcccccatttagttggttgagagtcgtagtagatgcaatatagtactctatattgttgattttttttcagaatttttatcactatttgtcttgtttttaagaagcagagctacaacagggctgggatagggggtaaaaatccactacctggtggaataaccttcacaacaaaatctggggtgacccaattgatgttcttgatcacaataaatcaaaaatatccaagtttacatgcatgcatgaactcaataccagcccccaattctccaaaagttgaaaaaacaaattctgaccatgactataaattaaatgtggggggaaaaaatcagggcttgtgctagctaccaacaaaccatgaatatatatttctagaagggaaaaaaacaagacaggaatattgacaaggcgagaaaccaacaaaagtgcatgggcaaaataatcagtcccccccaacttgaaaaatctcagctgcttgaaaccccccagccacaaacccaatcctgaactagtggctgtgtggatgaactctgattggattccagctactatttgccatccatttcttgctgaattctctcttctttaattcatcctctcttctcctcttctccttcatcactaggcagtagccacagtagccagtagctagctagcttgtcaagctaggagctagcagctgtgtgtcgtcgatggcatccaccgccgccttcctgtccacgctcgccggctcgaccagcctgggcggcgccacgccggccagcggcggcgggagcgggaggagcaagacggcgaggttcttgaggaggcggcggcgcggcggcgcggtgagggcggcggtgtccggcacggagcaggcgccggagacgacgaagaagaagggcggcggcggcggcggcggggacgagcgggtggtgcaggtgcacagcgcggaggagctcgacggcgcgctgcgggcggcgaaggagcggctggtggtggtggagttcgcggcgagccacagcgtgaacagcagccgcatctacccgtgcatggtggagctgagccgcacctgcggcgacgtcgacttcctcctcgtcatgggcgacgagtcggacgccacccgggagctgtgccgccgggaggggatcaccgccgtgccccacttcaccttctacaagggcgccgagaaggtccacgaggaggaggggatcggccccgaccagctcgccggcgacgtcctctactacggcgaccaccactccgccgtcgtccagctccactcccgcgccgacgtcgagtccctcatctccgaccaccgcggcgagggcggcaagctggtggtgctcgacgtggggctcaagcgatgcgggccctgcgtgaaggtgtaccccaccgtcgtgaagctgtcgcgcaccatggccgacaccaccgtcttcgcccgcatgaacggcgacgagaacgacagctgcatggagttcctccgcgacatggacgtcgtcgaggtgcccaccttcctcttcatcagggacggcgacatcgtcggccgctacgtcggctccggcaggggggagctcatcggcgagatcctcagatacaacggcgtcaaggtcacctagacatatacagattcatcactacgcagctcagctgcatgcagcaaccgtaattaaattaattactgtactactctcttgatcatgattgtaattttacaccaccacactagcttgagaagatcaagcttgttttatactggggacgatttgatcaaacctatctcgttgatttggtcccgtgtaatactagaattttggaacgtcaattgcaagttcgagacttgattttgcctatgattgtatctgtatccatccatctatcataggtggtgttcttatctctgaagatgaagattaagtttttttacgcaaaacaaggtggtattaacatatgattgattgagttttgattgttacaaacttaaaaaatagattaatatgatattttagagcaactttcatatagaaagttgatcatcactactgatcgatgtttttacacttaatggggacgatttgatcacactatctcgttgatttggtcccgtgtaataatactagaattttggaacgtcaattgcaagttcgagacttgattttgcctatgattgtatctgtatccatccatctttctatctatatgattgcccagttaatttatcttctgattaccttctttcttaattaattaccccatgtctcaaaaagaagataacaatgatctgctcaccaagagcaatggaagccacaagatgaccaaacaagaactgctcacaggtttgccaaacatttgtcaaatgcccaaactgaatctgaagatatttacaggcttccattttcagacggaaagaaacagagggtagcgtagggaagctgcctacgccgtaaagaaaagatcaacagcaatggcagcttgtcctccacaagttcacatcatctcacagcaagttgctttcacttccagatcttatgcactacttgcaggtggtaatgtcggtcaaaaactggacaaaattgccttccttggtttgctctgctgactgctggtcctgggatgtcatcacaaggaagcaatccagatcactagatttacatagttgacacaaaagggttcagttcagaaactgctcaattagtgcatgccctaacgtaaaaaaaatgatcttctgttcattggtactgttataaattagcggctgtcagcatcagttatgtcacagcaacggaacaggctcctaacagaagatgaccaagttgcagataccacagaatataaattactgacattctagctaaaaaatcctataaatctcttactgcacaaaaacagcaaactagagaaaggagtagcttgggactattcctctgcctcggcctcggcctctccttcctcttcatctgcagcccaccaagcaagaagaccaagaccgtctcctttaatgcttccctgcgaaagcattagtcagcctagttactcatcaaaggacactaagccagaattcaaataattgagcataattctcaaggcatacaataatttgcattggagcaaatgccctgtcagtctccttttgctcgactgggataggcgggtattttatgctagataccaagaatcgtatctgcgtagcaatcaagttgatcatgagcatacagagaatggtaattgctttgatttttttttagaaaaaaaacagattttgtatacctcatcatctaaatcaagatagagctcatcaccatcttcagtcttcagcatccacctaccatctagcgccctgggggaaatgagcagcaaagaaaataaagcaacataaatttatgtagaaagtactttcctcatgacaaacagaacaaggtagcagtgtgtactcagcagtctcaggtgacatccactgtcctcagcagttgtagagtttgtttttaaacacagataaagtaatccagaacgtatttaagccattgcaaagattctgtatttctgattctgttttagttcctgactgaactaaatttcaatagtatttttttttcataataaccaatctggttgaagtacatgccaagcagatgcaaacataacaagttaatctaagaggaatcaaaatcaaaatgtatgatataactccagagaagagtaagaacctcaagttttcaaattatagtagttactgctgtacaggaacaacaaaacaaaacattacctagccgtgccatactgcatcaagtgcccgggaatgcttatatcactgaagaaatcaagtgaaactgccaaacagatgtagccatatcagctcaaccaattgtttgtgaatgaggcttttcctactaactagtaccagaagaggaaggggccatttgtaacttttatacacatgtgaggcacaaatagtccaacagtaaagaacaggaattagttaagagtacacgcttgtcaaagataaaatttacatattcagtttaacaggatactatgttgaaaacagataactatagttcagaactaccctccagatatttagctagcaatggtttgtgtaccccaagaaatgtaatcactcttatgcaattgaggatgctgattccaggttagtaatcaggtctacagtggcaaagaagcatactatgatattaatcaacatctatttcattcaaacaaaaggatatatgagaaagtaaactagtccattgtttcgaacagcatgacctcaggataaaatagtgcaacagatacagagttaaacatcatatacaaatttcgtagcttattcttagaagacataagacatactatgacatggaaatatgaacataaaaattccatacagtacaaaatgttatccgatgttatagacaactgctacaaaaggaatggaatattccaacaggcaagataactagataagagattgccagcaaaccagctctttaaatgtcaataagaaaataagcaactcaccatgcagacccttttcatcatatccactgatcttcccgacaagaacctccccaacgaagggcctgaacatcagcaacctaaaggaaacctatacaggatggggaaaataaggaaatctaagagtgatttgcaaattgtaggaatcctcagaactaaatgcataagttcactgagacgacgtgttgcacacaccacactaacagaaatactgtaagaaagagcactgatgttaatagacacaactctaatcacaatgggtcattgagaacatgctatgttgtcatcaagtcgatcgcaactagtacataggctcgaaatacactaccaacatgagtaacagaattaatcaacttagagcttaaataagtctccaattgtgctgaaatatttttcaggcattcacctcctacagaatcttatgagacaagtacaccaccaagcagacatgtatcatacatatatcgcaattccatcaccaaaacaaaagggtaaaagcaatgggagcacaaattactttgtaagtggagcagccctctcctggaaagatgaagcctccttcgacggagcggatgtcgtagacggagacgcagagcccgaggttcgcgacgacctacatacagcacaggtggggggggggggcagaagcatgcaacacatcatcataatctcttgtacacaaccgtccgtgagcgagacaagcatcaacaacaggggtgactgagctcgtggtagttgattaccttgtcgaggaagagcctctcaagctcagccttgatggcgtcgacgagtggccggctcagcaggtgcggcggcatcggcaggttgtgttcgatctggctgagcacgaacatctctgcgctaaagtggcggacctaggatttagaagctgtgtattcaaaataacatgggttttttttctacacgtctacacccaaaatcctaataattagcttgtataatatcacgtactagtaattatatagtatatagtatatgcaccgtaacattgagcataggttcgtatagtatattgataaaattggtcataataacatactaatacacaaaatgaacattaaattctctgaattccaaacgattgtgtctcatataaaaaatatagtgaattactgatatacacttagccacacttaaccatatgctagttgaatccccttagctaactagataagcaagtgttaaagttgaataacaataagcggttaaatgaatcctcgattcctgatggctaactaggctaatcattcagtcgaatcggtaaaatagaacttcagataaaatcagcaaagcaaatactaagagcaaagcagcaagcctctatacagactatactaagtgctaaccacaagcgaatgcgccgaaagcgggaagccaagagcaggactaccgctgccgtgcggccgtgccgccgcgcgcctgcaccgcccctgctgcgccgccggagcagaggagcgcacagccccaccggcggcgaggccgagccgacgggggtgggggcggcggcgtcgcggcgaggtttgagaggcgagggcgaagggaggaggggtgtggtttggggtgtaatgggctgggatgggccgcggggcgactaatagctctgatgggaaaaaaaaaggaataagtacatctgaggtcccttaacttgtcaacgaatccgattttcgtccctcaactatcaaaaccggtacaaattagatccctcggcggttttggctgatgtggcacttatatggctaatttgactcgtcttcaactgacatggcactcacgtggcgctgatgtggcaattcgattcgaaaaaataataaaacccgtggggcccacaagtcagttcacacagaaaataatttaaaaatggtagggcccacgcgggccccacatgtcagcctcactcctcccttcatccctctccctcggcttcctcgacaccattgacctcaacggcggccgcgccgtctccctcggcacctccaacatctacggcttcctcgccaccatcgcccccgccgcagcgcacaccaccccacgcccgccgccgcgcctaccaccaccaccccaaatgcggcggcacggcggcggccaccccgtctcctcctccttctccccaatgttgggatccatgtcacggcggccggaagggcgacacgacgagcaatggccggcggggaaaaaggacaaagcgcgccgacctggaagatgccgccgccgccgctgccgcttggtgccaagatctggaggctggccgcccgtcgccattgggagcctggaggcctgctgcctggtgccctctgttcggcggacctcgctcctggggaagacgccaccgtgagccgatggtggggagcgagcaggcaacatcgggagtggaagatggctggcgggatggtgagctcgagctcgccggctcccctcccctcttcctcacctccgtcttcctcatcggccgccacctaccgcgaccccctcctcggcaaccgcctcccacctgcctgtcgacgggatggtaagctcgagctccgcctctgctcctgcggcgcgggggcctcggccgagttggagccgcacatgggcaggaactcggcgccactccccgccgacgacgaggctggcgccctccgcttggctccgccgccccatcggcttcgggtgcaaccacttcgccctcgcgtccaccgccgctgcccactctgccccgtcggcttcacaccgtcgttcgcccgccgccaccccccactcgaccccgctgctctaccacccacgcgaagataggggagaagaagggtgagagaggagaaataaattgctactgactgacgtggggcctatgtgggccccaccatatttatttgttgtgtagctgacatgtgggccccacttttttattattatttttatgtagctgacatgtgggcccacggtttttattatttttcctatatataattgccacgtaagcgccacatcaatgccacgtgggacagccctaatcaaattagccacgtaagcgccacatcagccaaaaccgccctcaaaaccgccgagggacctaatctatactggttttgatagttgaggatctatgtctcaatatcaccctgaatttggtaaaagtttgattgagggttataaacaagagtagcaaccaaaaaaatccaaggtttcaacagagagaacaagtaaaagaataaccaaatagtcccgtgggtgtatgaacagagctatatcaccatgtaatttggtccgatctggctcagtgatagaaagcatgtatttcaggagatgccatctcacagcggcgctcatt

SEQ ID NO: 78274 - DNA, 37401 bp, Oryza sativa
  unsure (1)..(37401): unsure at all n locations
atgtgttttggaatttttcggagtttttcgaaattcattttcggactttccgaaaatacacagaaccacttttcgcttctggaaattttcggatatgtctgaaaggcattttcagactttccgaaaatgactaagaaggcaaacatggttctgtatattttcggacttgtccgaaactgattttcggattttccgaaaaacatcagtagagtctctttcgcttctgtaaattttcagagttttccgaaaggaattttcggactttccgaaaatgtccagaagggtgtttttggttctggaaattttcggacttgtccgaaaagttttcagaatgtccgaaaaatcttcagttgactttactgtcggtgccgagctggaattttcggacttgtccgaaaatctttcggaatatccgaaaatcccatttattgtgcacaacgggcagaatttgggttgtggctataaatagccccatcccctcacttgtgagggctgctggtcacattggatattcttgtgcccttggcttgctcttgttgagattcacttttgagccttgctttcttgtttcccctctcacccgtgttcgattcggatttggtgtgtgtgtgagagttgtggattcgagtttgtgtgagtacttgttgttgacttcgtaaagatttgtgagcacttgcatcatctccgggagttcattgcatcatttgttactcttggaggttgaggactcctaggcggctaggtgttgctcccgagccaccgatctacttgtggttggccgggagaagtttgtgaaggtcgggtctcacctccgaaagggaagagatactcttagtggaaggaggagtgcttagtgcaacctcttgaggaaagggtcagctaagacccggctcttagtgagctcctcaacggagagtagaattccctcaaggattcgaacttcgggaacaacttcgtgagcttcatctttggtgacttcacatcctccctctcctttagctttgcttgtttgagccgctataggtctagttgctgtttgtgctagtatattcttgttgtaggcaactagatctaggttttaccttgtgtttgtgctgactccgataaattttcggatatatctaaaaattttggaaatatccgaaaattactgcttccgcttttaattgaattcttgaattagcctattcacccccctctaggcctaattgacactttcaccatcaaccatcctccactacataaccatcaaccatccatcaattaggagtaattgatataagttaccaattccctaatcaaatggattaattctcaaaactcttcatcccattgatatcccataagagaatgaatacacatgaattcctagcataatgagccttggaatttatttgatttaaatggatcaattacccaattaaatctaacatgaaacacttaatcttcatcttcaagagattcaaacaccaccttagggcctgcttagttctcaaacaaaatttttcgcgttgtcgcatctaatgtttggacacatgcatggagtattaaatgtaaaaaaaacaaaccaattatacacttcgctaggattaattaggctaattgcgccatgatttgacaatatggtgctacagtaaacatttgctaataacggattaattaggcttgataagttcgtctcgcaatttcctggtggaatctgtaatttattttgttattagactacgtttaatacttcaaatgtgtgtccgtatattcaatgtgacatgcagaggcaattttttttttgccaactaaataggctcttaggccttgtttaattcgcgagacgaaaagtttcgacatatcacatcggatatacggacacatatttgaagtattaaacatacactaacaaaataaaatacagatttcgcttgtaaactgcgagacgaatttattaagtctaattaattcgtcattagcaaatgtttattgtagcaccacattatcaaataatggagcaattaggcttaaaagatttgtctcgcaatttcaacacaatctgtgtaattagttttttttcttatatttaatactccatgcatatgtccaaacatttgatgtgatagggtgaaaagttttttgtttggtaactaagcagggccttaaattcatacttcccataaaaatattaaccaaaactgatttggattatatattcacctttacatctgctcttaagtttttcttgtttttagtccttgtgttttccaggtgttgcctttcagaggcatttctattaaatgttactttaatcaaaacatacgtagctctcaacaaagttatgtatacctcaccgttatatctagaaaacatattctgcctacataagctttcggtgcaaaatatctcaattttttttgttaaaaaaatatacacgtacttccaatgttacaacacatatgtgcaaagtactatctttaaattaattatgttttagccgtacaaagaaatacaaaatacaaacaattttaagagttattttttttggttatgcaggtgcattactaagagcaggtacaatagcagcctataagccagctataaacatattttaaagagataaagaaagagagagaagagcagcgggctacatatttgtagctaactacaacacggactccaagacgtaatgtatgtatgacagataggaccagatattaatagtatagcaagcaactattgtatgaattgactattacagctatagatgatttagagctaacaatgggctatactattaaatttgctctaacaatagatttgttgacacaaactccctttataagcacgacacggtacgacatacgtatgggttaacattttgattggtggcagctgctgcagggcccaattcgaacacaagtcccacggcctgtggtaacccagcccactccaccacaagaccaataatcgattatttattactcccttcatattttaatgtatgacgccgttgactttttattcaacgtttgaccattcgtcttattcaaaaaatttatataactatcatttattttattgtgacttgatttattatcaaatattctttaagcatgacataaatattctcatatttgcacaaaaatttgaataaaataaatggtcaaacgtttgtcaaaaaaatcaacggcgccatacaaactaggcttccatccaatggcaatgggggttcgatcaagcacgacaaagcaaaaggaatcgaacgattaatagctactcctactaaacagtactactcaccaccctcttcccttcattgctgttgatgttgtttggtcttttttttttgttaatttgtttattaaaggaaaacccgcaccctcactctcagtctagctccctgctgcttccacagctacttaattgtaggatgtaggatggtgcgtgctagctgcagctcactactacaactgtactagctagcagatcgcagctagtagcagagaggagaggagaggagttgatctgaggtaggataggagagcagcagatcagatcagatcgatccgggcaggcgggcagcatggcgtcggcaggtggctgcaagaagaagacgggaaatagtcgtagtaggagccctcgtagcccggtggtgctgcggagggcgatgctgcattcgtccctctgcttcctggtcggcctccttgccggcctcgccgccccctccgactggcccgctgccgccggcgccgccgtcttcctccgcacgctccgtgccagcaatgtcatcttcagtcgcagtagcaataggccgcagcagccgcagctggtggtagtggtcaccaccaccgagcagtccgacgactccgagcggcgcgccgccgggctgacgcgcacggcgcacgcgctgcggctggtgtcgccgccgcttctctggctggtggtggaggaggcccccgcggagaagcacgcggcgccgcccacggcgcggctgctgcggcgcacgggggtggtgcaccgccacctcctcatgaaacaaggagatgatgattttagcatgcagatatcgatgaggagggagcagcagaggaacgtggctctgcgccacatcgaggaccaccgcatcgccggcgtcgtgctcttcgggggcctcgccgacatctacgacctccgcctcctccaccacctcagggacatcaggtacagcatcacaatacatacctacgtatatgcgtacactacatccttattagagtcttagaaaaaaatactcgtacgttgtaacatgttatggtttagttaagatgaaattcactatgtgaattcacttgaatctatatatttctagaaaatcatgagctacagttaaaagtccgacgagtccgctcatcacaatttagtatgcgagttttttttaaagagattcttttatacgattcttcctgtattactaaaaagcgaacaaacttaaaaaaaaaaccagatatgtatttccaaaaacgaacgaacttggaaactgactctacacgaatgacgtgccaaagtaccggtaaaaatattttcaatttttataatataggctgtgttcccttcaaaacttccaaaaattccgtcaaatcaactatttgtacacatgcatggagcattaaatgtggataaaaaaaaccaattgcacattttgcatgtaaattacgagacgaatcttttgagcctaattacgccatgatttgacaatgtgatgctatagtaaacatttgctaatgacggattaattaggtttaataaattcgtctcgcggtttataggcggaatctgtaatttattttgttattagtctatatttaatacttcaaatgtgtatctgtctacttaaaaaaaaattggtacaccaactaaacacctctatagtagaggtaaagatattttagtcaacactcaactacattccgctatatataggcctgggttagttactaattttctttttaaacttttaattttaatgtagaactaaacaaagccatactactccagtatgtttttaattactagtagtgagctagctagctagagacaaacaatgtacacataacatggaggcctcccggagtgatagtttttgtacgtaagcaggtactccctccgtcccaaaataagcatagccatgaattttcgtgtctaattttaattgtccattttatttaatttttttaaaaaactaaaaaaaatataagtcacacataaagtactattcgtgctttataatctaataacaaacaaaatactaatcataaaaaaataaataaaatagatgatcaaaattgaacacagaaactcgtaactatgtttgtttttgaacggagggagtactacgaagctagggtgtcggtggatggaagggccctccctactactacaatagctactccttaggattcaaaattatatatgtgtcatcctattcacatttttctctccaatcactctttgaaatttctccccattttactctatagtgcaccctccatccctaaaaaaataaaattagagataaacctggataaattcattctcaaaaggtactacctccgtcccatattacttgtcgctttgactttttccttataacgtttgaccattcgttttatttgaaaaatttatacaaatataaaaagggataagtcatacttaaaatacttttgataataaagcaaatcacaaataaaataaacaataatttcaaatttttttaataaaacgaatgatcaaacattacaaataaaaaaaggtagtatctttttaagacggggagagtactctataatttattattatgtaggagtacttactactaatttaaagttgagcgtgaaaaatgattgctgaaattaaaatgagagggatgtcgtagcagtagcgcgttaattattgtatatggccgtacagtgcagtatagtacaggatgtgtcggcaagaatgaatgatttgatggggctggcatatgtaaatgcaggacatttggtgcgtggcccgtggcgacagtgtcggcgtacgagcgaaaggtgatggtgcaaggcccactctgcatcaacacatcctcctcgtcggtgatcacccgcggctggttcgatatggacatggacatggcggccggcggcgagcggcgagcggccgctgaccggccgcctccggagacgttaatggaagtgggcgggttcgcgttcagcagctggatgctgtgggacccgcacaggtgggaccgcttccccctctccgaccccgacgcctcgcaggtcagccactgcccagtgcccggaaagagatccctgactttgtgcagtttgcagttatgccactggtgacaccagtggcataacaccagtggcataactgcaaaccagtggcataactgcaaactgcacaaagtcaggggatcctcattcccagtgcccacccatcatcgctacctctcactcgatctactcctgccacgtagtagtaattaattagcctaaccacgtcgtccaccccaccttcaggcggaccggagtattatatcacgattctcaatttcttacttattagtcattccatattttaacgtataacgtcgttgacttttaagtaaagtttgatcattcgtcttatttaaaaggaaaaagtacgttttaccctctgaactattgtgacagtacgaattaccctcccgaaccatataatcatgatatattacacctcaaactattgataccggatgaattacccccccgactcaatactgagcggttttgctcctacgtggcatagacatggcgtcgatgtggaaatccaatcagcaaaaaaaacacacacacacacacacacacaagggcccacatgtcattatctctcttcagtcttccccctcccccttctctctctcaggcgtgcgtcaacgggcaatgcgcgacggcagcggcacgcggacgggcggcgagcgcggcaaggagtggtggggccgagacaggcggcgggcgggtcgggggcgcagcggacgtggtggagaggtggccggcaggcgtgacggcgcctgtgccctcctgtcgcggcggcagcggcgcgcggacaggcggcgagcgggggccgcgggcgcggcgggtggcgcggcagggagtggtggggccggggcaggcagcgggcgtggtggagaggcggccggcgggcctgacggcgcccgtgccccctatcgcagcggagggcggcgaagtggcgagggcggcgaagtgccctcctctcatacctctctctcgggccgtcgggaggtcggtgcgcacgcctgagcttgccgtcgtcatcttcaatgtcctcgggaccttggcgcccgtgcccgtctcgccctccccaccgcgcccaccggagctcgaggcggcaggaggaggggacagcgaaggggagcctgggctcatcgtactccagcaggagcggctcgaacgacgacggcggcggctgggggatgactccgacgactcttccggcctccacgctccctcgccggtctcctcacctccttcctctctgcccgccccgctaatgccggcatgcttcggccgccgccgctccgcccgcgttgccaccgctgcttcgccccgccgctctgccgccggcgcgcgagtcgcagccgctagcatctaacgggagagagagagggggtgagagggaaagagagagagaatattatgtcatgacaggtgggccctatcctttatttaatgaaaaacttgctgactggactgccacgtagaccaaaaccgcttacaaaactgttgggggggtttcatccggtatcgatagttgagggtgaaaaatgactggttttcaggtttagggggtaattcatactcacccaatacttcagggggtaattcgtacttttcctatttaaaattattgtgtaaatataaaaatatttatgtcattctgataaaacatttgatgataactcaagtcataataaaaaaaataataattatccaaattttttaaataaaacgaatgatcaaatgttggttaaaaagtcaacaacattatatattaaaatacggggaagggagtactttcttgtcatgtcctggggctggtcctagctatagatagatcagtagtactacctcgtttcagattataagactttctagcatttgtccatatgtatatagatgttgattaatctagtcacacacacacacacacacatatatatatatatatatatatatatatatatatatatatatatatatatatatatatatatatatatatatatatatatatatatatatatagtgtgtgtgtgagtaaagtcgaaacgaaggaagtagctagctaactgaaaagagattaaaagtcggaagaatataatgcgcaattcacgtacgcacacgacactagacacgcacaagctccgcgtctgtctgctttctttttggtttgtttgtttgcttgcttgcttaatttcatcaatcatttccatatattattccagcctcactagctagaagcctttcagcgtgtagtagtagtacatgtactataattaccgtacagtttggatcccaatctgcagattcatcatacataagtacacagtaactattgacaattacgaagtaggagtacgtactagtaattgagattatatatatatatatatatatatatatatatatatatatatatatatatatatatatatatatatatatatatatgcgcttaataatatgtgtatacatatatatgcaggaatcagtgaagttcgtgcagcgggtggcggtggaggaatacaaccagtcgacgacgagggggatgccggactccgattgctcccaaatcatgctctggcgcatccaaactacgctctaggctctagctagcttaatttcattcttcttccttaatcatcgatcgtcaatctccaaaacccacactcctactcctatctaagacaaatacctgcatataaatatatacacacgtatacgtggtgtgttcacgtacggttaattaagctgcaaggaagtactccgcaatactacatgcatatatgttttcaccttacttacgtcgagtctttgtgattctcggtctctttttaagtaagagtgacaatatattcacgaggaaaatacatcagtgatataccacaacctgtgtggagggtgaaatttttagtcactcgctttgtaagttgatcaacccagcttaagattctgataagcagctgctgagaaactagctggtgacttctaagttcattttctagattctacaactacagactctcagaatctggataaaaaactagactgtttggaggagcttctggcaactggagattctaagagaaactgaaggtgttagaagctccccaaacagattcataggctaaatcttgtccaacagatgtcatttctgctggttttctcttatagcatggacacacacgatgtataaataaatcaacagcggaggcaggtaccaaatcatgacagttgattgtgctagattcaatggttcaataatgtaggtaccagacaacgccatctaatctgggagatggtaccggctcgaggaacggaattgctagaaaactttcgcaagtttttcttttttgcccctaaaacttttgagatttgtgcattaacgtaaaaaaaaagataatctccaagaaattctattgacaagtgtccaaatctcagaaatggcatcgataagtgtgagttttaagaaatgccatcgtacaaacgactttgtcctaaaaatgccatcgtcgttagggttatgtccattccacgccattaaattctataggatgaacagtgtatttaatggtgtaaagtggacggcgatggcatttttgggacaaaatcgtttgtacgatggaatttcttagaactcacacttgtcgatggtatttcttggatttggacgcttgtcaatggcatttcttgaattatctctaaaaaaatcgctagaaagaaattttcacgcatgccacgcgtaagatccctatgctaaccaaccaaatcatagttgaatacaagttttatataaattacatcgtagttataatacaattacacttcaattatgtgatgtcgcatgcgtgacggagaggagatatttcagcgtctcgcgtgaaacattgaggtcgcgcacctctgcttcacttcattacctatcatgcctatgttaaatgaatggttgtatttaatttggtacctggtggtaccgtaccagtatattgtattatcgtaggcgcatgatgttatggtccgcctgtaatttagtatgtgtttggttgcagagatttgctgggtcgggttaggtcgaatccgcttttatagatgtataattgtggggttagatgggacgggttgactccaaaagagaatatcctcctgatatttgggttcgactcccccatcattagtatataaaaaaccatcataggtgtcagttcccaaccggctatatgtgccggttttcctaccggcacctattgatcgacaccaatacaagcaaccggcacctataccaaaaatagaaccggcacctataggtttgtacgagcaaaaaaaaagagccggctcgaatcgagccggaactcgcaatcgcaatcactgcgccatgccccacatctagttttttgaaatccccacatcacagatcatccaccaatcacagatcaaaacatattcaacaagaaaagcatccacaaatcaaaaaacatcttaaaagaatctacaaaatcatcccaaaaaaattcctcaggcgccgccgcccgccgcctcccctcccaccggatttgacggaggggagtgtgcggcggccgccgttgctgtctccgaggtccgccgtctcctcttcggtcggatcgagcggaggggacagcgccgcggcagccgccgccggccgttcccaaaggtccaccacctcccctccggctggatccggtggaggggagggcgcggccgccgccagccgctgctgccgcctccgcctggccaccgccgaagcccgccgactcccaactgcctccctccacaggctcccctccacgccgccgcctctgtctgtggggtgcccgccgcctccccacctgtcggatctggcggagaggagggcacggccgccgccgcctctgccgcgtccactaggccggttgccagccgcgggggcttgccgtcttcgccatgcagccactgccgagagagagagagagagagtggtgggagagagacgcgagagctgagagacgagagaaaggtagtagatggataaggcggagagacgagagaaaggtagtagatggataaggcggagaaacgatttgataaggacgcgtggtggtgtggtgcttatgggctcggctcgccggcttggctcaaagctataggtgccggttttttaaaaaaacggtacctacaatatatgataggtgctggtttttttaaaaaaactgacacctatagtataagtgccgggtttttttctagaaccagcatctatatatattgtttaaaggtgccggttctattttttccatcgtagggaggtgggaaaagctctataggtgtaggttttaaatgaaccgacacctatgagccgttctctatgacggttttttagtagtgcatgaaaatttggcggaccgattcgacccaacactctcgcgtgaatcacgtgaggcagcggcgaggttgaccacgcgtcgcagcctcctccctttgtgcttcccctccctcactggcttctcgtccaggaagcggctgcggcggcggcaacagcgacggcggtgttggtaggaagcagtggggaggttgatgcgcgagggagtagtcgtcacgacctctttccttctccctccacacttcccctcttgtgccatcttcttgtccaagaacggaggaggcggctcccagcgacatcactctcgtgcccttctctttgtgatagctggttggttgcatgagactattgaaattcctagcgatgatgtttttttttcaataaatttcatcagaatagaacaattttttatatgaacaagtgttaagacaattctgaagcagctatatatagtgggtggtctaattaattaagctaattctaagacaattctttgtgaatccccctaagcctagcctaggagaccctctcccctttccacccttccctgttccatttgtaccctaactcaggaccctaactaatcacgattgccgctgcggatcgtcagagttggaggagaagcccactagagtacgaatcgcgaaaccgaattgaagtttataaatttgtcagaatttatctttattttactatatggaatgtggtttacagattcccgataataataactaatagagtttgggaccatgtgcgtatgtacctagatagggagctcagctcattgatgcacatgtacatgcgtccatgtctggtacttacttgcgggtaactagcacgcacttgcactaattggatagatccatccatcacgatcgagctcacctatggatgcctacgctatataccacacttaaaatccactcttgcgtgcgtgcttggtgtcagtggaacaagcaccgaagaacgactatcgatagaagttgatgatgaggcgcagcttggtgattgtgatggtggcctgcagctgcgccacagccatagccagaggaggaggaggaggaggtctgaagctcaacttctactcggagtcggagaggtgcccgagggcggaggaggtggtgagggaggaggtgcggaggctgtacgaggagcacggcaacacggcggtgtcgtggttgagggcactcttccacgactgcatggtctactcctgcgacgcctccctgctgctccacaccaccaccaccacaggcgtctccgagcagtcctcccaccgcagcttcggcatgcgcaacttcaagtacatcaccgccatcaaggccgccgtcgagcgtgagtgccctgccaccgtctcctgcgccgacatcctcgccctggccgcccgcgacggcgtggccatgctgggtgggccctcggtggccatgcggacggggcggcgcgacagcagggagagctactacggcgtggtggagcagtacatccccaaccacaacgacagcgtgtccaccgtgctgtcgaggttcgcggccatcggggtggacacggagggagcggtggcgctgctgggcgcgcactcggtggggcgcgtccactgcttcaacctggtggggaggctgtacccgcaggtggacggcagcatggaggcggcgtacggggagtacctgcgggggaggtgcccgacggctgcggcgacggaggacacgagagaggtggtgtacgcgcgcaacgaccgcgtcacgcccatgctcatcgacaacatgtactaccgcaacctgctcgccgggcgggggctcctcctggtggaccagcagctggcctccgacgcccgcacggcgccctacgtccgccggatggccgccgacaacgactacttccaccagcgcttcgccgcagcgcttctcaccatgtccgagaacgcgccgctcaccggcgcacagggggaggtcagaaaagactgcaggttcgtcaactctagctaagctcgactagctagtagtacacatatacatacatatatgatcgatgtaaaaataattgaggtacgttctatgagatcgatcggtctgtgaactaatcgatcggcggcctctatctgttggcatcgactcctccattggatctttgtatttttctcaacttgtatgtacgtacgtatgtatgtggggttccgtcgagtcgtgtgtgtccgtgaccgtaactggactcaattattatggagtaacataatatatattgtatgcgtggcgttccatcgttacaaatatgcaacagtgtctatcatcatagcagtagtgcagtggcggcagcgacatgtttcgatggatcagattcaaaatactttgggggaataagttcaccggaggtcccttaaccacaaaaccagaaatgtctacccctaaactcactcgaaccgttcaccggaggtccctcggcagtattttcgcccggttttgctgacgtggcatcctagtcagcaaaaaaaaattaaaaaaatacatggggctcacatgtcagctgcacatttttttcttctcttttcttctccttctctcctcttctccttcaggctgcaggcggaggcggagcagccgcgcgccatggccgccgtcgtcgtcggctctccaccgtcgtcgtcgccatgagcgaggctacgcggagcggccgtccggtggcggagcggaggcagcggagcgcggcggcgggcggagcagccgcgcgccgtggccgccctcgtcgtcggctctccaccgtcgtcgtcgccgtgggcgaggcctagagttacatgcacatatgcattcattcatgaatgtagtacatatatattcgatcgatcgatcttgtcactttcaaccagtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccgacaagctcgcgagtgaagctcggccggctctctctcctctccggcaagaagggcgccaaggccgccctgtccgacgacgacgattacgagccccccgcgccgccgctcccacccggggacggcgacaatgacgaggagcccatcaacctcgtcttcaagggcggagatgaggccggcgggagagggggtggcgcgccgcatcggcgaagaggtcgttgccgacctcctaccgccgctccgcagccacacttgccccccgccgctcgccgaccaggccccccgctctgtcgtaatcgcccgccgtcctctgcccaccgctgctccgcctaccacgctcgtggaggtcaaccaacacgacgacgacaccggcggtgaagagctagagcatgacgagcgccgccgctccgctgccactctcgcccgctgccctgcccgccgctcccgccgtcccagctgcctctctccccctctcccgccaccgctggcgcgctcgctccacgccgcccaccgccgtgcccgcctcctctcccctctctcgcttcttccccgcgcgccgctgtgcccgcaccgctgcctgtcgccacgccctcatctgcccggccgcctcactgaagaagacgagaaaagaaaatgtgcagctgatatgtgggctccatgtactttttaattttttttactgactaggatgccacgtcagtaaaactgggcaaaaatactgccgagggacctccggtgaacggtttgagggagtttaggggtacacatttctgattttgtggttaaaggaccacagaaaatctcgctgttaagttgagagacccctggtgaacttattcctagtttgggatagagcgttgactgacgttggttgcgattgggcctctttctcatctttcgacaagtttaattgggcccccatcacaacgtacggcatattttatccccaacgtctccactctcacacctccctctctcctgagtcccctctttcaagatatttaactatttatcaattttacatatagcaatttcactaaacttacatatcatagatacatacatgatggtccacatatcgtaggttgtgagtaacaaatcattaattacaacatcttaaaagtaacgaatagttaaatgcccctacgagtcccacataagcaacctcaccgacgacgtcatgcacccaagccggtcggcatcggcagcctcgcctccactcagagtaggtgtacaatagcagactataagctaactataaatatatttcgaggagataccaaaacatggcagggaaagatttgtagtggcagatctatctcttcttcaaaaaagattatcaatcttggagtatatgtatagttagcttttgtatgagagctaacactcatttttttctttatctttctcttccacataagattatagttggcttataacccactgccatccttgctacatactctctccgtgctcgtaaaggaagtcgttttggacagcgacacggtctccaaaacacaactttgacttcttgtttctataaaaatatttattaaaaagtgatatatgtatacttttatgaaagtatttttcaagacaaatctattcatataacttttacattttcaaactcaacaactaactttagagttattcatgatttatattcccaaagtttgatttaaacattattctaaacgacttctttacgagtacagaggaagtatatcaacatccaacatcacaggaagccttctggtaagactcgcattaatgcattatacttgttggctgctgctttgtgtgtggtgtgttgttttgaggtgcaatcattcgaacaatcaaacatgaaggctctagcaaatgaaacctgaagatgtagatattctgggtaaagggtttgtctttcccttttttagtagtctgacagatcaattacaacctccgcattcatcttaggtattaggacctatttcgggaaacttttagtagctgtatctttcaacagaatctctaactctcccaaacagcttagattattacctagattctacaaatatgtatatgtagaatccataaaataaattagaagctagaagctgaaaaacccaacttcttcaaattcttagaaactggatactaactagcaaattatgagaatcttaagctcctcatttcatctatgattggcttgctttaaccatgcgaaaagaggtaacaattacgtagtactccctccgtcccatattatatgggattaggggttaaaaacgtgtctcaaaatataagggatcgggtaggtagagtactaatgcaaacaaacatcgggcagggagagtactaatgcggacagagagctgtcggtggaatttgtccctaccttatcctctcaccgagtcgcccatcgaccaccgctcgttcccctcccgattttcttcgctttttctctgtcccctccatcagcgcctccctcccacccgcatcttcttccacctcctcccatccatccgagctccttcccttccacctcccatccgtcgacgccaacgccggtggtgcggcggccaacctggcccatgcgccgccgccaccggtgcccaacctggcccgtgcggtgggggcaccgccggggaagcgaatcgaggtggtgtgggagcgggagaacacgctgctctcgttcggccaggccgccgcgcacgccgccgtcgccttcgtcgagttcaacgtccaggtatatatatacagcgcaaccgagtttgatgtgcgtgcttccatttccacgttgttggtagtacctgtgtttgttttggatcttacattggatgtcagtttacgctttgaattgtttgattttgacaccgctgcatcgcaatgcaagatttggaagctagcgtgggtatgacttggatgtagccattgattggtgtggtactggacatgaaatttgcagcaacgttctagccagtgaactatatgggacaagactcacaagtaggagtatcaatttaatcgcatttaaccaggatctagatgccaccatgctaaattggtcaagaatgaagaatggagcgattttaggtggatgttttgcagggatgtagttatccattaggcaaagtgctaggatttgaagttgcaattcttgtttagagctgaagaggttcttaaaacattgccaactactcttagatcatacggagtactaggaaattaacggtgtttaaaaaaactgaagtgtcaattttattaatcttaaacgctgttaggcacatcctatcttagattcatggtagatttaaaggttctatgtttcattttgatagtttaaaatttaaaattttataggaatataatgatttaacatgtcgccggcagcagtttacgggctggcggcagaatgcggcctagcggcagggttcgcgggacgtggtggttgctaggcaaagagccgcgtccagtggcggaaggcgtttgttttgacgacttggtgtttgtccctgactcggatgatgaaggggctggcaatgagttcaactcacaaggttttgacgacgaatttgtgcctgaaacacaacaagatgttccaatcgaggagattggcatagggttcctctcttatttatttaattattagtcctttccattcaattttgttaaattatgtgctttttgatgttccatttatttctccttacggtgcagccatcctgtgacaagcaaatcaggagggccgcgccagctcggagtgcatcctcgcttggggtatgtgattcacactagattgttgatttgggatggttatgcatttgtagcatgcaaattgagtcacatcttgatttatattgatttgtcttatcttctttacagtacaatgttgcacgattggcttcgggctatttcagagtatgagaagccaagcatcgacatggcaaccatcgagaaggcatgggccgatgagaaaaaggcaatcgctgatgcggactatgagggaaatccaagcaaggtgaacacaagctccgagaagaaggcatgtgtcgacgaggggaagtcaatctccgatgcagaaactgatgatgagggcgtcggtgtgcctgagaagaaggcatgcatcgccgagggaaagtcaatctccgacgcagagactgatgatgagggcgtcggtgtgcctcggaatttacagatgaaagatttgcacgatatcatgtttcctacctgctgaatgtgattgtgttgtggtattttattgtggaaatgcacaatggacataggagtacttagtgcaatatggatgtaagactaccatgtttataagtgtacaaattaccgtagtgttccatatggttgccagactagtacgaagtattttgttatggaaatgccctagttatagtcatatactcctataatatattgttctaatgattgtagtattgttccaaagttagtgctgaaattaactatgcaatgacatgttctgaaatgggttcaattaagtattcattgttatgaaattagtgctgaattaaatatagaatcacatattgctgattgctaaaactagttatgctgaattacctatatataacaaaagtctgaaatcatatttacaaactccatcggagtacgaaaaacaaaagtatggctaggctggactagttgttcaacatggtctgcatcaccacatacttacaaactccatcggagtacaaaagataaaagtatggctaggctaggctagtttaacaaggtgtgcattaccacatacttacaaactccatcggagtaaaaaaacaaaagtatggccaggctggactagttcaacaaggtctgcataaccttgttgtaaagtgcaatatcacaagtcagactagtagggagcatgttaagcctctccaatcgatccttgttcatatggggtatcttgtagccattgcctccatcggctttcatcacttctatgaagcaagcttgtagggttaggaaaccctactcaccaagttagaattatactcattgtactcttcgtccacattgctgattaattcatccatgttactacaatttttgaggtatgtcttcgattgaagagaagcaaagaaacccagatcaagcacattcatgtttggtgaattagggcgttggttcatgatgcgtatgtctaggcctacttgggccaccgcgagggcaaatgcttcgtcgtttggcagaatatgtgtccgtgcattgtcttgctgaatccaaatggtcttccctacatcttctctcggccaacaagaggcaatagttggaataacctttgtaatcaagaaagccctacttgtttctctcgacaccgtaatagattttgtgaccaatgtacccttcggcctgttgcgactactcctttgtgctggttcctaacatatagagcaaagaacaagttagctacaaagtgacttgaaagcaataaaaatagattgaatcaagttgagacttcaccttcctaacaaagggccatattcctattttgacatcgaagtagcaatttccttcctcatcatacctaggctttgcaagagctgataaaaacataactttatctatggcatttttattttgcacacatctcacaggttcatcttcattgaatacaaggtagaaggtcttgtttttcatagtggcgttgaaccatttttcatcaatatgcacaatgttttgcatgtctataaatcttggttcagcattcaaagtagcaacatctagcatggatacacagaacttgagcctttgttttttattagcttccttcaagtaaggtttaatgctattttagtgacggcgaagggctccttctttgactaacctatgcaccttgcttttgctagcattcaatgcgctagcaagagatctgatgctacaccttaagttcaaaggaagtgctaaaacctgatccaaatcaatgtcacttctttttcggccacaattaccaggcttctttgatttaaagtcaacttcaacacctgctgctaaacatttcttcgcctttgtccaaatgtcttgtacaactctccttgtcacatcaaccatagttgcaataattgttgtagtatctctatcaacaagtttcccattgatagtacttgcaagtaaagcaccataaatagctttgttctcagcttctggtaaatatttccttctctttatattgtcttgttgagtatctgcacaaagaaaatatttatatatatacatatcagttggcaatatattttatacttgcagtacactaatgaatgtcatttgcatgtcataccttcctcatcacttgatgtatggagatcttcatcaaagacaacatccatataaggagaataaacatcaaaatcctcctcgtctgcatggacagaaaaggtgagacatgagctactcatatgatatccccatctgcatcactgctgattacatatgagcaaaaaataatgtatgtacctgcataatttgattgatcttggagaacatagagtctgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatatagaaaagtgcattataaattaagtaaccattcttgaccacaaaagtttttttttgcattaggtcatctaccacaaaaaaaacacatgttcccatacctatatgggtcatccttcagtggtgttatatataaagttcataatattaattttttggattgttttagtagtttctgatattaaaaccagctttatgaaataaaacttgaactatgctgattccaactatttagaacacatgatgtacgcttataaactttggagattgttgggctaatggctggttatcataatgagcaaataaaatttatagagccatttatgatcatcatttttgcacagtaccacataagagtatatatatgactgatggctgaagtttacaactcttgactaaaagcaacaactgattgacactaatagcaaagttgcaaagctctgtgttatgcaaagaagtaatattgggcttgttagtttatgaatttgttcataaattttgatcatacaaactttgctactttcaacatttatgtttctgttatttcagcagaagggaggatgggaaatgtgagtaagaccataacttgctttgcattaagattttgattccatacctggctccatgtttagatgacaaatttcttgtgcactccggccattggagagttcaactgcttgcatggcagggtctggatgttcatcttcatgagcaccaaaacattggttgtcaggaagctcttcatcttcatattggaaggcatcttctccttgcacagcaggatccaggttaaggtcagggatcccatcaccttcatcttgtagcacttcttgcacaccaagatcaaggttgagatcaggaatctcatattcctcttcttccatggattagttgagggtctctcttggtgtaatgctggagtaggttgctaatatgagtgtaatatgagagctttggtttttagacctgtgagtgagagcaagggagtgaaaatggcgggttggttctgagcatcaagtttaaattttgaacagctaatgcctgtgtatttgtggcgctaatgtgtagtgcgtgtgaattttgggcagcaaagaggtgagtgggatttaattgactcttgtcaacatatgcattaatgtcattgtatactgaggaatgcttactctttctttgtgccaatcatttgctggcaagcttgtaaacccaaatagtctctcactgctagtgccagtactaagtaaatgaggggtacatgcatctttcgccaacctccttattttggatgaacagtgtccagtcccatataatgtgtgtcggtgatatgggcccgggggtatcagatttagagcgaggaggctgccccacgatgccacgtggtcctccccggaggggagtcaggcccgaggtagggtggcggccactccttcccagagactggatggaggaggctgccccccgatgccacgtggccctcccccgaggggagtcaggcccaaggtggggcggcggccactccctggccgagactagagggagaaggctaccccaggcgccacatggccctcccccgagggggtatcgggcccgaggtcgggctgcagcggccccctcctgtgactaggggtcgggctcccccgaccccctctctaggtcaccatgtacggtgggttaaatgtccgcctccaggtgcccacctacccgcatttatggcggctcgagtagtcgcgcaacgccgcatttaatgcggtgtgcaatgcactccaccggtctgtgaccggtcgaatgaccgatgggactagggtagtgcgcctgtgcgctgctcgtgtgtcaggcgacgtgcagcctgacatgtcccatcaaataatgatggtgagaggttctcatcctcttatcctagccagagtcggtcctcccgctctggtcaaagtaaggctcccgtttcccggtgtaataagagcccagaagtcctcacccattaaatggtgactaacaggggcaccccccgtgtcaggcagcaagatttgacaggcctcatcagcaagatgacgtgcgcttgcttcccaagtcaagagacaagacatgcatttaatgcaaagattgtaatccttctccactaagttatgtttttgggcccatgtggtaaccccttggagatataaaaggaggtccaggcctagtaggagggggggctggagcccctgatgatcaacaccttctaccccacaaggagatcttgtaatttctcataagatcagctaagcacaggagcagggtattacgcttcttagcggcccgaacttgtataaacctcttttgtctcatcgtctttggggggggctaaccccctcaagatcacacagctccgctcaccaagccctcgaatctcacccgctgcccccagccgaactcacaaatgggggcctcatggttccctggtggaggagttcattctccgacaatgtgggacggagggagtaccagatacgcacaagcacatagacttgcttgcggtttcctagagtagggtaaagtggcataagatttaacataggattatgcttaatgggggagtagaaactaaacgacgtttgagtcttcaatctcctctaaccccccaaacccccgaggacagtctcaactctctatctcaagttctcaactactacctccatattttaatgcatggcgccgttgacttttttttcaacgtttgaccattgtcttattcaaaaaatttatgtaattattatttattttactgtgacttgattcgtcatcaaatattctttaatcatgacataaatattttcatatttgcacaaaaattttgaataaaataaatggtcaaatatttatcgaaaagtcaacggcgtcatacattaaaatacggagggagtagtttatagcattaaatatattgtcattgaagaaaaaaactaatatagcaaaagagttattaataagaaaagaggaaaaaaataaagtaaccatttaagaggaaaaaaaaccttttcgtctctcactgggccgtcaataaggcgtttgtacttgatgggtaaatggaccttttggtcagaattactctaatcgaagaataaaaatcataaagatctaaaaaaaaacataatgtgcaagatctattccatattcaatatgaatgaatataaacataatgtgtaagatctactccatattcaatatgaatgaatatactaaaccagacttttgcatcataaagaaattagctttacacggtacagacgtgtagtcacctttctccatatatacgctgcccaggagatgcttgggcacaaaaggggcggggaaaaaaacagaaagcgaatcgagcattactgaaacataagcaagataagaaagggagagaatgtgtaaaggaaaacaaagaaggagaatagccgatgggtcaaggaaaggcacacatgcttgaatgttagctggatagatacctcgctttgcttccgttgcattttttcttctcttgtttttcatgatgatcaagactcgagggagagcaacgtccattatccatcattttgtctttcgtctcgtggactagtctgttgccttcttttctttttgcttaattattgtattgtcttataccgctttcaattactgtacatggctgtacttttgtgccccattaactctcccaatttttttcctctttattagcttgtactatactaccccaagtccccaacctaaaataaataagtgcatcttgtccaatatttgatcgttcgttttatttaaaaaaattataaaaaaataaaaaatatcacacataaagaactatttatgttttatcatctaataacaataaaaaatactaatcataatttttttaaataagacgaatcgttaaacgttggatatagacagtatataattatacttattttgagacatttagagtagttgcttgctgtttctttttcttctctttctttcttataccttccggttccacaggcagactcatcgtatggagcggatgtcgtatcataattatatcatatattagaactaaacacaatggacacatgttatgcttatagaccacgtattatgtgcattcttatccgtcctccacatgcactcacacctcacctgtcggtggggccaactaataattaatactccaacagctaaccaagcaatactctatggcaaaatatctttattgtactctagtagattagatcactaataaaaagtagaaactctgctgcatattactccctccgtcccataatgttgcaacctaggatgggatgagacccacctagaactacgaatttgaacatgaggacccatcttaggactacgaatctgaacatacatgtccagattcgtagtcctaggatgggtctcatcctgacccatccgagattacaacattatgggacggagggagtagtcttctatcttaagctgactcgataaaagtactactccctcggtccctcctcctaggtttagctcttaaaatttagcctaaaatataacatcttattcatcaatattttttttccaactaatcctaaatcttcaccatttaatttttctatttatctttacttcttatctaattagattttctttaatttacttgtacctattttcttattaataatcatgtccaactctaaaatttttatattctggaacggcctgcatagtggtgtgagaactttgacctttgatccataataattatttagtgaattgagctagtggtgttgaaaattccatccattaaataattactcttgcatactcaaataatgaattaataaaatgtagtgaccgtgccgacggaggaagacgaagacaggagacggttactggagttgagtactccacccaccacaccacacaagagagagaagggttggggttggggtcactctttccttttctctgttgttgttggcttgatgatgagctgattcgcataattccaattccaattccaattataattccaagaggcttatcatcaactcaactgaagaagaagaagaagaagaagaagaagaagaggaggagggttgtgaactgatttgggaagggagggggaggaggaaggcgatcgatcggcgatgggcacgtacaagtgctgcctatcttcaagcgccgcttccgctggaacgacgcgccgccgcccgacgatgtccgcgccctcttcgccaaccactccgccggcggtggcccccacatggccgccgacggcctccgcgcctacctccaggccaccggccaggacggcgacgtggacatggagcggctggtggagcagatccggcagctgcaggggcgcggcgggcgcatcccgcgggtggggcgggcactcccactcctgacggtggacgacttccaccgattcctcttctcccacgagctgaacccacccatccggcacgggcaggggcaggtgcaccacgacatggccgccccgctctcccactacttcatctacaccggccacaactcctacctcaccggcaaccagctcagcagcgactgcagcgacctccccatcatcagggctctccagaggggcgtccgcgtcatcgagctcgacatgtggcccaactcctccaaggatgacatcagcatcctccatggcaggacgctcaccaccccggtctccctcctcaaatgcctcctctccatcaagcaacacgcctttgaggcctccccttacccggttatcatcacgctcgaagaccacctcacccccgatctccaggacaaagcagccaaggtatatataatcttcttcttctctctgtctctgccttgctcgctcacttgccaatgggccagatggttcttgaagttttcggcgacatcctctactaccctgacaaagatcacctcaaagagttcccttcgcctcaagacctcaagggccgtgtcctcctctccaccaagccccccagggagtaccttcaagccaaggatggtaatgctgccaccatcaaagaggacgccaaggccgccgccactgacgatgccgcatggggaaaagaagtcccagatattcactctcaaatccactctgccactaaagtactcctcatattactagcttcttcttcttcttcttatgctcatagtagagccagtttcttacctgcagggcacacttttgtttcattctgcagcatgaccaaagagaagatgacgacgacaccgatgaagacgaagatgacgaggaggaggagcagaaaatgcaacagcatctagctccacagtacaaacaccttattaccatcaaagcaggaaagccaaaaggtactctacttgatgccttacagagtgacccagaaaaggttagaaggctcagtttgagcgagcaacaacttgccaaattggcagatcatcatggtaccgaaattgtaaggtacgaatctgctaagtgaatgaagttgctcttcctttccatcttcagcatcagtgaaaatgtttttttttttttgcactttataggccatctctcgctaactctgctgaaatgcccaatctttttggccaaaacaggttcacacagagaaacctactgaggatatacccaaagggcactcgggtcacatcatccaactataatccatttcttggttgggtgcatggtgctcagatggtagcgttcaatatgcaggtgaggtgcacttctgttcctgagcagttagttccagagtgatggtttagctctttgtaccttatttccaattcagtaaattcggtgaggaatcaatttgctgaatgcagttaagtttacattttatcttataattatacctgaacgattattatggtataatataacttcagaattggtggatcaaatttgagcaacctggaatttctggctccatgttttctgaatgcctgtcaagttgtgacatttgccgcttcttttaccgttgtcatattaaaaatacatgaaatttcttgcagggatatggaagagctctttggttgatgcatggattttataaagctaatggtggctgtggttatgtgaagaaaccagatttcttaatgcaaactgatccagaggtttttgacccaaaaaaatccctatctcccaagaaaaccttgaaggtatgcatgcctgtcattctttttgtttgtgctcgtctgtgaaacctggagacttcactgaagtgctgcctttcaggtgaaagtatacatgggggatggttggcggatggacttcacgcagacccactttgatcaatattctcctccagacttttatgcacgggtacgtacgtggattgaatttcataccgaaaacggttcgctactccaagttgatgtgatattatggaggtgacgatggaaaatggacttgtgatgggatgatggataggtggggatagcgggagtaccagcggactcggtgatgaagagaacgagggcgatagaggataactgggtgccggtgtgggaggaggatttcaccttcaaactgaccgtgccggagatcgcgttgctgcgggtggaggtgcacgagtacgacatgtcggagaaggacgacttcggcggccagacggtgctgccggtgtcggatctcatcccggggatccgagcggtggcactccacgaccgcaaagggatcaagttgaacaacgtcaagcttctcatgcgcttcgagtttgaatgacccaacacaccgacactttctttctttctcgccgcatcgcattgcactgtgcctgtgcttgtgcagcatccatcatttggtttggtttttcatgttcctgtgcatacgcatttgtgtctgtacataggctcggtcctgtatattgtttgtgagtaacatgtaataataaggcttcacgccatgttcattcctcctgtttgaacccctccaaatatattaataccgaaggtacaaaatatctcaacggcagacggttctgtttgcagggcaggagtaatttggcaagtgcgctatgtaataactaaactcgaccacaaaaagaccatatacagttgaaccccccccccctccccgccaaaaaaaaaaacgtatgtaacaaatatcagacattcttcaggcacaaaagttcaatgaaaaattttagaaaatatagaccgccaaagatgaaaagacggctaagaatcttcccatttccctagtcaaggtaaaactgtatactacatatccaactgcccagctacaatgaattatccaagtcctaagtcctaacaagggtctattccagacccatcttgaacttcaatgcccacctccttccggcatataactaatacagaaagggaagtaaccaatagttgattgggacgtcacattctgcagagacaaaatccgcagacaattgcgtgtttgttcagttaaaaacagagcattataatggcatttattatgataaaacaaagagccaaaaattttgagatatttaccacggctgccgaagaagattagctaacagcggaagattcctgggtcacttctgtcgtagtatctgcagctgaactgctggtttctgcagcctgattttggctactttgtgcttgaggtgcaggttgctgttgatcttcagcaagacccaaaactaccaaggtagacctgccataaaatggaagctctgaatcagatcctgccctcgtgtacttgaaatggataagtagcttttatgctggtaagatatagggttaagtacaaaccttggaagagttgatcgtacgttaggttggttcgcgtgctcaaccaaaggtgccttcagtacaggattcttattcaaggcattttcaagttgaggagctggtaactgataaaccaagtttgatgttatgaaaattattggcagtttggcactatgataaaaatgaactcaagagccactagcagatagcatgtaaaacagctagcggatggtgcacatgctacagagatttttgcatacaagaacaagtagattctacgtagaagcaaaagtgagccaacctgcagcagcacaccatatgactgaggtttcgtcaagatagcacacttcaggaatcctacccataacttgggatacttccatatctgcaataataaaagatgacatgatatttccatatccaaaattatgtaaaaccactgaaactaaacttaaaaaaaaaatgaaaacctgcttgctaacaagacgtgacatgatatccatcacaaagtccacctgaaaagaaggcttaccgtcagattataagaacaagaaacaggtctataagattgagaaataataccgaaaactcccaagagatttttcataataaagaattgcaatgctcgtcaacttcaatatgttatcatgccaacactgtgtaataaaggaagttccacatgaatatctttgatagtttgatggtcccaatcctccatcaccttcgagagagtggaaaggacatatattaccatgtaactgctttctcatagaatcaagtggataagtgcacgcaccagatatgaagcaagcagttgtaaacagtaaacacaagtgatcaactctttgcttcttaagtggcagtaaaatacaactaaagaaaaatcatgaatggacactttctaattgaatcaggcgcaagcaccaaaaccaggaaagggaatgtggcctactcaacatgaaccacaggtagatcatgtaacagcatgaccgtggcatttcaacttgatttgttgtactatcagcagatgttaactatatattataacaccaataaactatcagccacagttagaatattgggttcatgcagttaactcaccaatgcaggaaatgcaccgattgcttgcataacagttcgcataaacagcaacggaagtggaatttgttcaacctgaggaaaagtagagcttgagcaatgacccaacaactacatcatatcacaaggcaggtacatctgaaaaggcgaaaaatatgatcatatataccagttggttcagtgctttcgccaaaacttgttgagtgaatattgtcctttgctcaaaacaagcagcacaggcatcaataacctatcataagataaaatgaattaccaaatttatcagtatattaaactaaatcgccaaatgatctatttaaaaatattggaaacagacctttttgagtggtattccttctttctcaggatctattacatgaatcgcaatcaaaatttctgatggatcaagagaaggcccattctgcggtgatccctgcaatagtcagcaagttataatgtatcataagcccgcacaagctgggaaacccttaaaactaaactgaatcaatttaccaaaaccaaacaagtacactgaacttgcactttgcaacaggcataaaaataaaattttcaacaagtaaaactgtaatatttacattttacaggcagtaaaaaaaataaacaattaccattgtcctactttgagaaaaataattaaatgaaaaggaaatcatatcatgaaaagaaaaaacatgaaggaaaaatcaaacatgatagatgagctgtggaatcatatcttattgtcttattgaatgctgcaaatttgcagctaataagatcaatcagtgtttgcatgtaatatggatcagttacggtctgatggattcttgcggtgtgtgagtgcctttgagtaaactttccagtatttttctagataaaaataaaagctcccaaatctttataactgcaacaagaaaactgtgccctactaacagaagaccaaagttaatccactttgttaccagttaaagtcatgcattatcttctccccccagtcaactttacatactttgacgacatagttggcctaagaaggatagctaagctactggatggtcattgaatacaggtgaatttttggggtggtgtggcactgcataagcttctttctgtattcaactgcagaagtctaatatataatactcacgtgaaacatataaccccaaaaggagagggtagaaacaaggttttactaaaaaaacattaaagttgttatttttttacgtcaaaggtgcaacgaaaggatcagcttggacatgaacttaagttaatactcaaatacaaatcacagttaaggatcagatagaaaattaacacagcatgcacatatttcatgccagacaaaaactaacctgcaggattcgagaaagtgcaacttgaaacttatccaagggaagattaacaatactgggaaaaacagggaggacctgagaaaaagcacaatgaacaataaatgtgaaactataataataatacaggtgacatattgatgcctagagaccataaaagttccactaatgcaacatgccatgcattgtcaaagattcttaacacggaaaagttggatacccagattagtcaattattaaatgttaatcagcatatgtacaccttctaattgaaacactccattgcaaaaattattaccacaggttttgcaaatacaattcaaatagtataaattgtgagcaattcagcagcatatgctgattaacatttaataaatgacagtacacaacagtcattaggtgactgcaggaaatgaagacttaaagtaaatataaactactgcataaattctatagttcaataaaactagaaataaggtatgcatgctgctggttcattgtaatatcttcaatgttgcaagggggagaaaaaaacctcatcttttggcagatgagccaagactgcaaaaaggacctcgatatcctgcaaaatgaagccagaatgttaatagtatctcaggtgggaatcagtccagaaacaaaagttgaactctgataaagataagtaaagaacctttgttttagaatataagttctttacagaggaaatcagatcttgagatggcattgctccatcggtgagtgtctgtaaaacctgtgtggcgatgcaatttcatgggttatgatgtattcagataaaacaaaccttttaagaaaatttgatgaaacatctttttctgtacacatttaagcagaattttggatttttatcataaaagaacaacttgcacctgcatcagtaggtcccgactatcagctggtgggtctgagatgatcccaagaagactgggagatgagcctattgtgcggatcagaatgggtacttgtcgatgaactgcctgaaaggtatacaatatatcaaatggatatagtttattactgattgagccattggcatggcagagagaagcagtcagcacagacctgcttggcagcttgtggtagacttccatatattgcaaatacatgccgaagaagggaatgcttctggcaagtaagatgtaaattgcatgctgttagtaaaatccatagaatcagatcaagatgttaaactttagtaaatactaaccttggtgcacaaagcaaaatagagtgacatcaaagtttgagaatctgctactgaagacgataaattttctgaaccaccatccttcataagacacagttcatcccaataagaaaaggcagcactataattcacttgaaaaggaacagaaatgtactcaaggttatcttccaagacaatatcaattaagtcatctacaattctgcatatcttactcatcactttttctttttacatcacttcgtaggttcatctatatgactttattcgtctgtttttcatctgtttcttggttttagtgtattacttggttgattttatgacaaagttcaaccgcaattctatttaagaatcaactaaactgtaataagtccagaacagtacatgtgaaagaaattagagcataaatcaaaccttgggtgcttctggagtagacatttcagaagctgctgattcatcagctggaactacttccagaactgaattaagtttttcatttgcaaaatcttcaatcctttttgaaatgcttgccataggaaatagcttatttgctacctgttattaccaaatgagaaacaaaatggttaaaatcacataaatgcatgtttcatgcaagcacaaacaattaggtcaattaccaagcgtattgccttcatgcggacctcatctagatgatggattgaactctgcaagaaaaacttctacttagaatcataaaaaaggaacaagctatacttgaaccagaaaagtagcactagagtaccagtcaacaaaaccaacatcaagtcctaaccagtatataagtttcattcattggtaattgcacgtttggagttcaatctgacgcttatgtccataaaagggaaatagagatgcaaaacattactcatattttgagtgttcaactgtcctgaactcttccaagacacatgaaacaactaaaactgacatcatgtcaaatgactcttgcatgctctaccactgaatcaaaaatcaaaatagaaaactntctcatgctaccacaggtggagttcctgacaatctcatgacagtttgtgactcacaaaaatcatgtgagaagagctgcacatctaagcaagcgtatcgcacatttacacaaggtgagtaaatatgtcatgaagtcagtctagcacctgcaaagcgatctccagacatctgtctcgatttgaaggtcttaacatgataaggttccagacagcactaagtccttgagttaccctatcaccactctgcagatccttgtcctgcttctcattgcttccaggagaacataagccctctagcaacttcaatacaccctctggtaagtatggtatctcacaaagtaattttccaagtgatttatctgaagccggaaacatatcgcgaagattttcagcctacgccaaataagaagtggttggacatgatgcaagaaaaacaatacagtgacaaagttagagatatcataagaagacatacaacagtcagaagaaacgattcataaactgatgttgcagttctcgatgaaaggaagtcttgatcctgttctgcttcacgatacaacctgttcagaatgcacagtgtcagctcgtgtccctgctcaaggaaagatagtcagaccattgtaaggggtaaactgattaaagcatgtaattagataaagcaacagagttacatgaaacataatctgggtaaacattttgatataataaatagataatgatcatcgtcataggcttgctatataaataagaatggagggagtagtttggtaaactagaatgaagataaaaaatgttgtgtctagttaactggtcaagatattggcttgctagttgaaccacataccacagatacagcgccagccctacaactagaagttaaaaaaagtgaagctgaacaaacatattttatttccataaatactttggcaatggaggttggggatatgttcttgtaattgtcatggtagttgtcaagtatgatctttcgctgccagtctaccagataggtagcattctgtgcaaaatccgtaacgtttagcaaggtaatttggtttgaatcaaagccatgtggttgaactggatttttctcccagttcagtcacctaggcaggactaaaaagctttcagttctctcttttttttggtatggactaaatcagttcccatccaacacttgtgtttataatagagaattgataccagttgcacccagtggacccaaaaaaaaaactgtacagaaaagaaattctatgattttgtacacctgtacctcattatttacataatcagacagtacatgcttctggagaagctcccaagggtccaactccaaagggaactgcactatcaagtagcataatgtaaaaggagtgtaactatgacaaaatacaagaaactgaagcatcattggtttaaacattgcaggcactatcaattaattgcttctgcaaagaaactgtcaatggataaattaaccaaacaatggtgcacacaaaaaacactaaccgaattgaagcaaaagaatattactctaaaggaggcaatgtaacatgtacctcaacacccaagtgagcaagcaagggaagacgagctattgaaccaccagatgcatcttgtttatcacaatcaagaatccgcaaaaatgcttctttttgaagtagatctttagcctcatcgctgagatcaatattagtcacaaccaactttggaagcacatgctgtgaagtaagtgtgcttgaatatgagaactgagtctgacttgcttccaccatagaagagcttggactacgagtttctgaagattgagccaaactaagaccagctgaggaattatcagcaggcaatgaactaataaaactgccaccatgctcttgggttccttgaagttctgttgaagcatgggaagcttctgatgattcttgaatctcaattgataacctagcggcatctgcagtgggttctttagcctctatagtttccatatcagatggaattgatgaactattactattctcctccataggtacatttcttgaggtaggtccaggaatggcaggaattgctgcagtttcaccagcagcagatggcacaacagcagaatctatagtttgaggtgcttcatcgacctctcgatcattttgatttattctctgaagacaaagttcaataaacaaaagtcaaagaagaaactctaatgaatcaataaaatctagataaaaaaccaaccttcaataaagattctaacagaggaaagcatgctgaaagaagacttgaactcggagcaccagatggctggccagctgaaggagattgttgttggtctacttcaggatgagaaactggcaggtgttgcatgttaaccattaccacctctgctaataagtcagcagcaatactggatgacaggatttgcagtgatccagccgctctgtcaccttgagcggctaatgcagcaaacatactaactaattgatatacagcttcagaatttccagtacttgcagagttggacgggctagatggggtatcagcagaggttagctccacattattctttacattttcagtatgttcttgatcatgatgtgattgcctaattcttttgttggaacgatcaccatcttctggcgcattatcgatgtcatcgatcagattacgcttgttactgttatctgtgcttg

SEQ ID NO: 78275 - DNA, 763 bp, Oryza sativa
cataggataataagctagttttaggccttgaacagtagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggtatccataaaaggccccagtgaacatatattacattaaggcaggaaaatcctttagctatatgctgctgtaaaatggaataacttagatacgaacaacataggtgtagggatgtacaaggcgccaccacagaacgacacatcctattctctcccgtccatcgaagcagctctatcaaaaggccgatctcatagcaccacgagctgcctcacgtttcatctcagcagccttcccacttccacggaaatacatgtatacttgctgcatttcaaacggccaagttcagaatgacatctcccaggagaaaatgaagacagcattgcagcggaaattttattgcaacaagaacaaaatcttaggggacagcacattctagttgggagtggagacatcaatgcaaatagaaatgtatatattctgaaggcacagcatgacgcatgatgatgaacggcagaatgaaggagtgttgctgaacagacaccaaggtgttactatttggctttggctaagatcaag

SEQ ID NO: 78276 - DNA, 1413 bp, Oryza sativa
gcaatgcgtgcgtgcagggtactacaatgggccgccggtgatggcgccgccgcagtacgcggctccgccgccgaggcggccggagccgagcttcctcgaaggatggtaagaacgacaaagccatatgcgagcatacgatcgtcagaatactgtctctgtcctttgcattctctctgctaatcatggtgctaatttgtctgaataatacagccttgctgctctctgctgctgctgcctcatcgacgagtgctgctgcgacccatcggtcatatttgtgacctaattacggtcacagtggcgtctcgactggttgacgaggacgaacagtctgagttgagatatacactgtacacgtgcttgccttttgttaaatgttgataattgtatcggtctatagctagattacagtacaagtcctccgttaagttcaggttcttcaagtatcagatgcatgcgtgatccacctgcagtggaaatatttatattgcatgcactggttgctcgattaaccaaaggacgtatacgtttctatgtgtatgtctgcatgatcgactataaagaataaacgaaggtaaagtgaagttatactgtgcatggtcctcaaatctgcaatatatattttgcgcccccctgaatttcttctgcaatggcattgcacattcctaatcgaacggttggcagagattccgatggggttcggagttttcaactccgaatcccatcaatgggccttcacgagcccgttcagcgccataggccgagagcccgaggcggagcctcccatcaggcccaaggatcacggagcgtcgcgaataattccactcatctaggccgcacgggcttgatcgaacggtcgtcgggtattccagggagctcggagttggaaacaacgaacccccgtggccctgtattcgggtggcaagaatgaggcgccaggcctcgccggagcgccgccgcgtaatacccgtccccagaggcaaagaggacgcacccgagtgcccaagttccagacttccagtacgccgatggcgtctgggtcaatgtgccatttgtccccgtggcagctagcctcagagaaaagaacgagctaaaaccatagaaggtctcactcttcttcatctgcattgatgaacttactggagcagaatttcatgcatggccataatgttgcaaagggcaagttcgatgcagcataaaaggttccagctgttgttgttgcaacactgccgcgcagagtacatagtcctaatcaccgcaacacgacacgttaaccgctagctgaaatcccagagggggtcggagtactccgaccccatgcaccagtgcatcctcctcctgggctcactgcggctgtgcggcacctgctgctcatctgagccgcacatatctaatcagacggcgggaaaagattcc

SEQ ID NO: 78277 - DNA, 9218 bp, Oryza sativa
  unsure (1)..(9218): unsure at all n locations
tgagtccntttaanccttgggtaagtacgaaggaataaaaaagtacggtacgtacataagcacgcccagccccacgtctttattttcattttttcttctttctcacttattagattagatgaaaaacaaaactaataatttaagctcatatgtaaaaatatatgttattttgagttgtattataaccatatttatgctantcggatcatacccataaaagataccaaaccaanantnncngnnaanaaanaaannaaantttttaaaatttttnaaaaggggngnnaaaaaatttttttttttttttaaaaaaaataattgtatatcactttaagaaattagacttgcattttcaaaattaaaaataacatagtaacattcccaaatgtcactcaccctatttaaaaaaaatactgatacaattaaacaacattactaaatactgattctgctgcccccagactctctctacccgtctctgtgactactactctctggactactttttttaactcatccttccattcttccttgttcaatcgggctaactgtagcaagatgttcccgatctattcgcagcaaaacatcatacgctccaataattctctcagtttttgttttgttcacaagtgaataaatttgtgctgcactcaaaacctgttcacaagtgaagagttgactagttcataggatggagcattttctagtttttatcccattacgtgtctgagtatttccctttttcctggtgagacaagaggcggcaacatgagaactttgcaattctgtccaccccaagaagcacaagaaaagctaggcttgctacattttagtgtaccatagctagcagctctctgattggtatttgatctcgaaccgtagcccagggaggaaaccatgatgttacttggacatatgacgttgatatgcaggcaagatgtatggctaacttgctcaaaatatgacaataatgtaactatttttaccagttttttagtcacttaatttggagttaccgacagatccatacttccataagatctcgacaaattccatgcatctaatccaaaacaaactaattgaatttttataacaagctttagtctttttttttcgaacggctggtcagaattgactggcgttatattgatagaaggacaaaaagtacaaatagccaaagggctaaaaaagagaaaaactgtacatgacaacatgcaaacaagcttgcacgtagccttcctagctcctcatggcaacattctcccaatgtgtttagcgccggccatactccaccaacctaattcctcttggatgcgactaatcatctggtgtactgtcgcctcctttgctctgaagattcttgcatttcgttccttccagatttcccaagcaatgagcaagaagagagctctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagttgtccacacccggttttgaagaaccaaccaactaaagattttgcactttgccggagcccatgcctcccaagacaactttgttgatggcgagagtaccattccattgaattggaattggtacgcggattttgcaccgtattccccattagttgtccattgccaaacaatcgagtcttgtaccccctctgttagttgtggggtgtcacgggctaaaatttcccaaacatggaagaattcatcaagaagaggaatggtgaggctgtggcggacgtcgttaatccatcttccttgttgcagggcgtcctagacggtgcaggttttcctcttcgaatgcctataaagattaggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctttggcatcctccattcgaaccataaccatctcagtcaaagagctctggcaaacttttctaagttcggaacccccaaaccaccgtaccggacaggtgagaaaactttaagccaattgaccttgcattttccgccatgcatattctcattacctacccacaggaaccgccttcttgctttgtcaatttcttgaagagattgtttcggcggtttcagcaccgtgagggtgtaagttgggatggcacttagaactgagttcaccataattcggcgcccccccatgtacaacaatgatggcttccatcccgagaaccgacctttgatcttatcctggagaggctggaaatgcaccttacgtaggcggccaggagtgagtggtagccctaggtaagttagtgggaagctggctcttgcccccgaataactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcatcaagcgaagtcctcaatctagcatggcgacttccgatgttggttagttgcccaccttcggtcgatagatgtagaagcctttgtagggggtcgatagccaggataaagagatagggggatagggggtccccttgcctcaagccacgtctgtgtgcaatgcattccccctggtctccatttaggactaccttggaagtggcggtggaaaagagcaaacagatccaatttctccactgggggccaaaacccatgttttgcatcagttcaagtagatattcccaggagaccgaatcaaaagctctagcaatgtctagcttgagaaaaagtgttggctttttgctggcatttaggttcctgagcacgttccgaacatacaggaagttgtcttgaatgcatctttttttgatgaaggcgctctgtgcaacagagatcaggccatccatctgcctggcaagccttattgctagaactttggatatcagcttggcgacggagtgaatgaggctgattggcctaaaatcggtcaccaaggtaggggcattcctctttggaagcaaggtaattgctgctctgttgagtgctccaaagtttcatcctgacaggttatacaaacactggaaaacatccatgatatcctgtttaattagctgccagcatttcttgtagaaggtaccattaaagccatctagacctggggccttttctgccggcatctgctttaaagcggcccaaacttcctcctctgtaaaaggttcatctagttcatcggggttaacctgtggtagatccatcgcgttccaatttagggtgcaatttcacgcctccttgttgcctaggattgagttgaaatggttgaaaagcgcgtcacttttttcctcatgttctgtcaggatagcacttgttgtatggagttggtgaatgtggtttttccttctcctcgagtttgcgtgaatgtggaaaaactttgtgttggcatccccttctttcagccatgtcaatcgcgatatctgccttttcttcgactttgccactgctgctagccccaaaattcttagcttgaggtcattcctgagctggtgttcatcagtcgcttattatacgattgagttacggttataaattagagatacatagctggatgcatgagttggcaaaatattcagtagtcattgttacatatctaaccaacgaaacaaaaatgtacataaatcaatcacatgtttttcccccttttttttccctgaaaactatccacgcgtctacaccaaattaagttcataacctcaaggagtgatgagacccatggtggtttacagcgcgtcgcagccgttggaaatctgtgccagtgtcagcctgaccgcaacgcaaaagccggtaagaccatgcttgccagattgccactaatgctgcagcaccaagatgtcaagtgatcgatggacttgaactgaacgctccagcggtaatgctctcggcgactatttcttgagcgacatcttcttttcccgtggcctctcatttctatggcattttttttgttttcggtaagcaataacctcaagctgatgcaatcgtggaagtatatatatagtttatgagagttgttctatatagcatataaatatggtggaaatatgggaatgtgccacctgtgagtattcctttctcattttacatcgtctccgtttgttccactcttgcaattcacactaatgaggaaggcccagcgtacgaatgggaggacgacatatgaacggtcacaaatgcttagttaccggaatagcaacagtctcaacatgaggagttgaaatcttacgaaagaacagtggaccgacaagctacaaatgttgaaagaatagtataacaaaaagtcaaaaacttgatgagcagatagccatatatttctcaccttcgcctcttctaacggagtttctgttagatttaattgggtaatttatccatttaaatcaattaaatcaaataaatttcaaggctcattatgctaggaattcatgtgtattcattctcttatgggacatcaatgggacgaagaattttcagaattattccatttgattagggaattggtaacttatatcaattactcctaattgatggatggttgatggttgtgtagtggaggatggttcatggctagatgatgacaattagttgctctattcctcttcctattccattgcattggtaacctacactaattactcctaattgatggttgattgatggttgtgtagtgaagaatggttgatggctaattgatgagaattagttactctattcctcttcttattccatgactcttactcttcatcttccattcctcctataaaatgagaatggatttgatctccctaaggagaagtgagacacactttcatccatttccaaggctgttgctgctacggtaatcccatcccgacgagtgtatgcacacgcgttgggagagtaggcctccgaaaccacgcactgctgcgacgtatgcacggacgggcgggcgatcaggtttttggggagcgcaagacgagactactcactgttcatcaacgtctacttcgtcttcaccaacatatcgagcactggagacaacggcaacactagagacaaggagaaggaggttcccgtcaacaccaatgaaggcaatactgcctcaaactccagcggaggaccattcggtataaccttcttatattatttcacttagaagttttaatgttaatgttcatcgcaatgtcaacattgcgttattatgtgattgttgatgcttattctacgttaagcatactcatattgattacattcgccactatcattggatcaaatcccattgtaaatatcatgtttattatcttgctattttggattaaaatatgccgaattatgaccaaattctcaacaatccaaaaacctgataggtccttttaggtagttggctttgctgcaatactgaaaccacatgtttttgatggttctaactataagagatgctaagcacgtgcactactgtggttgacagcgatgcaatgcttctatatttcacggaaaaaacgaagtgaactgcctctctctcctgaggaggaggctaggttcgaggattcggattgcctgttccgtggaacattgatcagtatacttgctgacaatatagtggacgtgtacatgcacatgccttcggggaaggtcatgtggaatgcatttgaggccaagttcggagtttccgacaccagcagcgagctgtatgtcatggagcagttctatgactatgagatggtcgattaccgttctatagtggaacaggctcatgagatttagatgctgacaaaggaacttgagaacaaacaactgcgagttgccgaacaagtttgtggcgggtggcattattgccaaatttccaccttcttggtcggactttgctacttctctagaacacaagaggcaagagttcggtgttactgatctcattggctctttgggtgttgaggagaaggcgagagcaaaggacaacagggcaaaaatatcgagggaggttctagcgccaatttggtgcaaaagaagaaccctcacgcatcccacaacaacaacaacaagaaagtcaagcctgatgtcaaaccaaaggctactaccaattttaaggataaaggcaagggaaaggccaagggcgactgctttgtgtgcggtaagcctaggcattgggccaagaattgtcctaatcgcaaggacaagaagtctgccaacatggttattagcgagggcggaggaacatcggggtatggtaaatttttacctacaattctctctgtttttcattcacctgattggtgggttgatactggtgctaatattcatgtgtgtgctgatatttccatgttttcttcttatcaagtcgggagagattcctccttgttgatgggaaacgggtcgcttgcggttgttcatggtgttggtatggtcgatttgaagtttacttcgggaaagaccgtgcagctaaagaacgtgcagcatgtccctttaataaagaagaatctagttagcagctctctactgtgtagagatgcttttagacttgtgtttgaatccaataaatgtgccgtatctaaatatggaacttttattggaaaaggttatgtcagcggagttctgttccgtttttctttggatgacatgcgtaataataataatgatgtgaaccatattagcgagaatgatgagttcaatgtgtggcattcgcgactttgtcatatgaatttcggttgtatgacacgcttggctaatatgagtttaattgcaaaattcactttagtaaaaggttctaagtgccatacttgtgttcaatcgaaacaacctcgcaaacctcacaatgcatctgaggcgaggaatttggcacccctagaacttgttcatttcgatctgtgtgaaatgaacggcgtgttgagtaaagagggaaagaaatatttcatgacactgatagatgattgcactagattttgctatgtgtacctattgaaaccaaaggatgaagcattgtattactttaagatctataaagctgaggtagaaaaccatcttgaaaggaaaatcaaatggttgaggtctgataggggtggagagtatttttccaatgagtttatgtccttttgcgaagagtttggaattattcatgagaggatgcctccctattcacccaatcaaatggggtagccaaaagaaagaaccgcactcttactgagatggtgaatgccatgttagacactgcgggacttttcaaggaatggtggggtgaggcaattttgactacttttcatgtcctgaataaaattccagtgaagcataagaaagtagcaccgttcaaggaatgggaaaggaagaaactaaatctctcatacctacgcacatggggctgtttggccaaggtaaatgtacctatagccaaaaagcgtaaacttggaccaaataccgtagactgtgtgttcctcggttatgctatccacagcgtgggttatagatacttaatagtaaactctggagtacccgacatacgtgttggtataattactgagtccagagatgccacattctttgagtgaatttcccatgaaaaatacacctagcacatctagtcaagaacctgttttaccccatgagcactttgcaccgatagaacacagtaatcaaacgcctgaggaaaatcctgaggaggataacattgtatactcgaaagagtaagagacaaagggttgcaaaatcctttggagatgactacattgtatacctcgtggatgacactccaagaactatagaagaggcatattcatctcctgacgctgactattggaaggaagcggtacgcagtgaaatggactcaattatatctaatagtacttgggaagtcgttgagcgtccatatgggtgcaagcctgtaggatgcaaattggttttcaagaaaaagcttaggccagatggtacaattaaaaagtacaaggtaaggcttgtggccaagggttataaaaaaagaaggtgaggacttttttgacacctactcaccagttacccgcttgaccacgattcgagtactacttcatctggtagcctcttatggtcttctcgtccattagatggatgttaagataggctttctaaattgagagctggaagaggagatctatatggatcaaccagacaggtatgtactagaaggtcaggatggaatggtgtataaactgttgaaatccttgtatggccttaagcaagcatctaagcaatggcatgagaagtttggcacaacacttacatctgctgacaaatgtgtgtactatctctatggcgggggagagggagtgatcttgtgtttatatgccgatgacatattgatttttggaaccagcctcaatgtgattgaggaggttaaggactttttgtcccaaagctttgaaatgaaggatttgggagtagctaatgttgttcttaacattaagctactgagaggagatgagggtgggattacactcgtgcaatctcactatgtggacaatgttttgagtcgctttggttatagtgactgcaagccatctcctactccttatgactctagtgtgcttttaaggaaaaaccgaagaatagcaagggatcaattgagatactcccatatcattggttcattgatatacttggctagtgcaacgagtcctgacatctcatttgctgtgagcaagctgagcagatttgtttcaaatccgggagatgatcattggcaagctctggaaagggtcatacgctatctaaagggcacagtgagctatggaattcactatactgtgtacccaaaagtactggaagggtatagtgactcaaacttgatatctgatgctgatgagataaaggccacaagtggatatgtgttcacacttggaggtggcgctgtttcagaccatcttaacgaggtcaacaatggaagcagaactcacagc

SEQ ID NO: 78278 - DNA, 736 bp, Oryza sativa
aacatacaagtttaaatttaacttttacatctcgcaacggaaaaaaaataaatttgacatatgaatatatgttaacaagctgtagtttaatatgtttttctcgttgtgaaatgtagaagttaaatataatataacataacatattaatatattttttaaatttttttcataattatttgagtgacgtacaaacaacgagaagtcgtcccctcgggatatcaaaatccactccctagacaacgataatggaagcattattttcgacctctatatcaacaaacaatgcaaacaagcattatttatagaaccttgtcgctgccgttactgaaggaggaggatgcgaggagctccggtgtagaagccggacgcgccggtgcggagccatggcttgtaaccgagctggcttctcttcccatcagggagaaatgcaccagctggtccggggaaacaacaaccagagatctccggcgaattcgttcctctccatttctacacgcaatggatttgattcttcttatcggattcgaattggatgtagtttccccctttcttaggtggataaaaaacaaaaaggaaaataaatattggtgaagaactgtaatggactgggcctagagatgccacattatttttatgatggaataagtccattttgtctccctcatctcttgcgcttgattgaattgcctccctcaaccacaaaaccgggtataatgaatccctcatcttcaaaaac

SEQ ID NO: 78279 - DNA, 6634 bp, Oryza sativa
taaagcatgtacccagcctaggctcacatgaacaggatgcaaggcgtacaggaaatgagcatggttcagcagaataaggaaataaagcatatatatctcccacattgccatgacactaccaaatatgctgcctcccaggctgctaaagctgacactaaaaccccacatatgttgaagctcatgcctgatttagtgctgcctgacaaattgccaccgcctaacaactgcgtgatgttattgtctccccaagaaaccccagcttgtttactgccaaagtccaaactctccaatatatgatgctggcactggtaatgaacttatctattggaatgtggttccatcaatcaagaaaggcaatatgcaaaataaagaaaagaactctgatattccccgggagctgggagtaattgctaatttcgattatatacggttaaaatgtcacaatgaaggaacttattttatgcttagtttatggttagaatggtacaatagacataattggtttagtttagttctttttcaccactcccataatacatgcatccaaccaaagtactaaaccatactcactcattcatcctgcatccacaatctaaccgaactagtaaccaatcaaaaacattggcgccttccaggacaaatgagaccaaagatgtgattaactgagccccatctaggaaacccataggcacctaagcgacctaacatgtgtatacagtatgcaaaactcttgagtacactgaccaaataaaaacagcatagcctcttacataataaattaattaactacagtttttaagcacataatgaaataggcacggagtgatacatgtgaaacctgccagtagaaagaaaggttcaccgagaaaaagttaacagacaatatcagatattatgaatgcaacatttataagttataagttactagttgtacaagctaaaagaaataccggctctgcacttgaatgtgtacatttcaggcatgcagcaaaggcactcttcaaagcatggaaagcacctgggacttgcactttaataatggaacttgctggatccaaagaaagtaaaactggaagtatgcgtccgtaaaatgaaggtcttctttgcgcgatagctgagaggctgagggaaattcatgttagaggatgaggaaaaaatggtagaagataaaaatataacatggaagaaacctgcactttcttctacaaacagaatgaataaatgttacaacatcctcatacaggaaatatatttgttccaagaatggtaagaaaggtaatatatagaaaagacagtggaacacaaatggatgagacaaacctagtaacaaagacaatgatcatggaagtactgagtgattttactttaggaggcttaagctgttctagcagcaatccaaggttctggctggcttccattgccagatctccaacattaagcaaagggtgacctcctctcagccacgctacattgaatcccatatctacaaaaggatttacagatgacagaccatcatggcacaactccaaaatattggcaaatgtttttttttttgggggggggggggggggtatgaaatgccgtgtatgttataccttctgtaacttcaattggtggatccggtggggtatcaagatcaggggtgtacaatagaactgttttttcaacaaatttaatagccagtaacctggctccttcattgctcatcggctatacagcaggttacgcagatgtaagaaatggcaggaggagaggatgaaattgaccagccacgaggaaaaagatagtgccttacctgaaaggccatgtgtgacacagcagatttaagcttgagcagtgcctcccaggataattttaatgaatcatcaatgccaccacttgagaacaagccctgatatcaaatccggcaaaccagcgatgttaggcaaagttcacccacacaggctgctcgaagagcttctgataaaattacctgaataactgctgtcgtagtactttggcaaacaaggttgttcctgttttaatagcttgccttgcgaccgcaggtgtgtcatcgttgagaagatgaagcagacaaggcatgacattgggaaggtatgccatgtgttttgacccaacctcaccaatcatcctatgtcggggtagaattgacatgcacatgtagcaaaaaaaccatgagcatatacgagcacagtgaaaagcgtgggcagagtattataatttctaatagacgctcttatgaacaacaacaccttgagcgagcaggctcgtgtacagtattgttaataactagcaagcgctaaattatcatttgttactgttggtgagtggtaaatagaagagtggaaacttagcatcgaatgtgtgtggaaataaaattacagagtgactcaacgttgacacctaaaccacacacaatccaaatataaaaacctaggacgggaggatgaaattgggaggtccaagaccaagaggagaaagggacactgactcggcgacgagcttgcggacggggctggcctgatcggcatggaggtcggcgatgcgggcgacgaagtcgaggagcggaaccctgcggagctggcggaggcgcggctccatggaggaaggcaaaggcgaggggttgggatggaaggtcggcgggaggtcttgggcagcggccacagccatcggaaccctagctcctccgctccggccgccggcgctcactccgccgtgccgcctgcggatgggttgggctttcccttttctttttttttttagaataatatgaatatgggatgggttggaaaatgtaaatgggcttacggtgggagggatgtcatctggacttaaatcatcagatatatgggctcaaatttgagatgcacatgaaataggaaataagtccacctgtcatccctcaactttacgtcgagtttgccagaaattttcaccctccatcttgacaaaacgggcccatctcgctgagtcaccactgaccgggcctatatgtcagtggataacctttcttcttcctccaatcctcctctctctctcctctactcctatcaccctccatatgtaattgctacagtatttgaaacaatatataaatgtaatgaggcattgaggtgtgtatataatggatatatcaatatggccttgtccaaattgtcactagctttatgctgcgtcttacaaagtacagcacgcacgcacatcaaatctagctacatatccttcaatacatgtatgtatactcctatatatccatggaaagaattgtgacctccatatctccacacggacacgcacatatatatcgattgatcggcgatatatataggtctctttctatctgtctgtggatcgaatgttgaatacatgtccaggtcagtcgcagctatctaattaagctaatttaagcctccgggcttaaaagaattgaaggaaatgtaaaattaatttagttagcagggtcggtctggtagtagaccacatctccggtgtcgctgacatagtggtcgcgtttcaagctccgggacagcgctccaaacaggtgtaagggaaaaggcccagacttgtccggctccctgtagtatttccccatcacaccctttgctgcttccgtctgcacattttcatcacccatgcttcttagtaattactcagcactacgtactgataaacatcacatagcataatttaattactagtactccgcatgcactgcagagactagagcttaccgcctcaattagatggtaatgcgggatttgggggaaaagatggtgaatgacatgtgtcccgatgtcgtggtggatgttgttgatccacccatagtccctgtccactgtcgtcagtcctccccgcaaatagctccattcctgtacatatcatcaatctattcagtacaaaagtgcaaaagtgagattattattatttggatttccttgagtaattctctgcctacgaacattttctaaagaaaaaaaaaagaaaaaaattcactgcctcacagtatgaattctgaaaacgatgcagctctctaggaaaaagatgcatgtatacaaaagttgtgatccaacttgcatttgcatcatggaccacaacgtattgtgattttttgtggacagaagatcgcatctttgcattatcatctagtttctatgactcgtttaatcacaggctcaggtcaaagtcccttcctaaattgactatttttgacaaggtagttatgcctaatctttttttttctacgtactgcaatcaatcgattactagatccaacggcataaataaaagttgcaacctagcttattcattcagtgtgtgagccatgcatacatatatattgcttgatttctgaatatattaagcatgcatatagtgtgagcgagtttaattagagagaagaaatgatgtatatatgcatgtcgtctaatagtaattgatagtaaaaaatgttagtaattagttaaacggaccttgccacggtaccagggcagcttgtcgttgtggccgtgatggtgcaagtaggtgacgaagtccagccacataacaaaaatctgcagagaagtagaattgaaatacaaactgatgagaaaagaaagcaaggtaggttttgttccccacatccacaaaagaggagatcgagggcaggcagaggatagaggaacccaatccacagatcacatcaatgaaccaacgtatgtatgtagggggtaactacgtacccagtaagggacaaagtagaggttgagcatgaggaggggtcccatgaggaaggtgaggcctgcgaggagggcagccatggccacccagcacgctgtggatgtcagcacatcgttcctttcgttgggctggaacaggtcgctgctgggatggaaatgcgaaccagactttcctgggctccgagaccactgcatgcatgcaatatatccatccattcatcatcgtcttaatcatcacatcacatataaatatatataatggaataatgaacgtagagtacattgttatgctagtaatattagtagagtactagagtagcaattaattaaccaggtagaatgggtaggcgagcatggggaagggtatggagaagcggagcatccgggtggctctgttaaggctcctgtacagccgctcggggagctgcattttggattggattgatcagattcatttgcaatggggaaacccaactggagtagttgcaattaagtagtgaaatcgagaaggaaggaaggaatgcgtacgggatgccaggactcatccttgtcgacatggccatggttctgatgatgcgtcctgtggctaatcctccagccatggtagggtacgaggatggaggagtggagtatgtggcccatcacgctgttgagcctcgagttgttggagaagctcccgtgcccgctgcaattccaattccatgaacgaattaattactactagtgtagtagagtggagtaggaatcaaaatggaaatgaataccgtcgtaccagtcgtggccgaggacgaagagcgcccagaacatggttccctgcgccgcccagtagagcggccaggcgaggcagctgtggaggcgcgcggcggcggcagcgagggcgaacaccaccaccacgtcgcgcagcacgtaccccatggatcgccaggggtccttcacccaacagtgcttggggatagcggcgcggatgtcggccagaccaaacgggggcgccgcgcccgggtcgaagtcctcacaaggaggaggaggagcattattttcattgtcgtcctcctccacggtggccacgcggctggtgggtgcggccacacgagcggaggcggacattcccaagtgggagcgcaaatgcaatggcgcgacggcggcaggggaggagggggagcggcgcgacgccggagagtagcagccgggccattctttccttggttggttctactccaattggtattggtaagctgcgcggcgccgcccccgcctgggtttatcaacgcaaaaaggaaaggaaaacccaactgggttgccggccctatctatctatctatctatccatctgtccgtatcccacttttgggaactcgtcggcaaacctcagccttccctccactccatccaatacctcatcaccttccaaaccaccccacccgttacactcccaaccacaaactactcacatccccatttctcttcccaaaactaccttccactcttcctacatactagtatatcattacattctgctgtaatacaacatattactatcttttttctttcaaaaaaaaaagagagagagaaacattacattctcgtgtagtacaacatgaccctaaagctaacgtgtgtataaacgaccaccgcgacaagctcggagaaatatgtaccacaaacgaattatatatatatatatatatatatgtagtgcatacctaaaaatgataaaacaaattgacgtataagatttatccacatcaccacaaataaaacttttactcgtgatgacatggacaaatctctcacattcacttcataatcagacagtttgtcttacatataaagtttgcgctacatatttccccaaggctcccctcctactaatattatacacaacaccaccagatggcacacaatgaatatgaatcaatggc

SEQ ID NO: 78280 - DNA, 612 bp, Oryza sativa
cctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttg

SEQ ID NO: 78281 - DNA, 4420 bp, Oryza sativa
tacagctagtgagctcgcagttgctcgggttcgtcttcgagcagcaccggcactgcaggcacaacggcgccgccaacgtccctactacgccgccgccaccgatggccaccaccaccggcttcgccggcttcgtcggcaccatgtcgtccgccacctgggcatccagcgcccatgctagttgattgatacacgcacacacaccgtggtaaattaaatgtgtaatccgtcaagaattacattacaagttcagagatgaatccagatcgagcttagaatatataccttgggattgcacggcgacgacgatgaggaggaggacgggggacgaagctcgagagaggggaggtcatgctcctgcagtagttcgccattgctgattcgatggatattacgctgttgaatgatgtaaatttggaaatgggaatggttgaggagaccgagtggcgagtgacgacgagatatactcgtttatataagcgaggaggcgtttgcatgccaaggcaagaattcatttcctgctaacgttgatatgcataaatttagaggggcgtttaatagattaattctatcctaatttgagcaaaacgctacttcatcgaattcatgaagctctgcgaaatgtatcgattggagctcattgtagatagacgattttcaaatggaccatcaaagctctgctaaatgtatagattccgtgcctaagtgcttatctcgaacagtttccataccagctttcttcttgttctgatcacttctctctttggagatatgcaattagttccttccatattgcaaaaccttatccatttctttagaggaagaaacttactttcttgacgattcaaaacgagctagatggaggtgggggctaatcgaagcccttaattacaacttgggcctaagttgtcaaacatagggacatattgaagggaaaagaatccattttgtttcccccaaccataggcccggcttgttcacatctcttacccgcaaaaccagatagaaagcctcgctcgcctatcaatactggattgttttgtcttatcgagcagtttgcatgtatgtttcgtcctacaaagtgcccacatgcatggcacattgacttgatttttgaccgatgtgacgactacatggcagttctaaggaaaaagtaaaaaatatatagctagacccatgtaaggcccatatgtcagtgaccaccatctgtctcccattcccccctctcctattaattactggactaatgcggtggtgaattgaggaagggaggaggttgctcgtccaagggttgtgtcacatccctttttcaaatttgcctaattttgaaaattcacattcatatttattcgcttaaatttttttaatggaaacttcataaatgaaatatggtttaatttgactaaatcaatcctcctctatcttttctcctaataaatctccaaaaatctcaaagggaatcccactgattttgtcgctgttccatcttggtcaactcgagataaaccctagtttcttcgctgcctctagctatcaaatccccaccggtcacttcctccttggctaataaatagcatccccttgtccgagctcgtcccataccccagccgccttcccgcatgctcattctctctcctccaccatcggcgccgctccggccgagcagtatcattgccccggtaatcgtcagtcaatgccacctcctccttcggcactgcagcagccgtgcgaccggcctccacttcccggaagactaagaccaccgaaagttccaagtgctcctacttgccgtcgtctctagccgagctgcgccgatgatccccgccgaagccgccatcggcatctgaaggacacagggaaactcggtcaccacctcttctttctcaagtcttgttagagcactgtcattgtcgttgacccttgaagcccgtcgctggccaccgttcatcctcatcagtggttgccaaagtgttgttaagtgtcgcctcaccattccttgtccattggtgtcctcagtgtctcgctcctttgttcgccgtgtgccgctgctcctgggtctgcctttgttgatccaacatggttgccacatcagcattttatcagctaatccgtcctctgtggctgccacccaggctccacgtggcacctctctgcatcactagatcagaattgatctgaatagtcagattatttcggtcaacagtggccaatttatcttaggcatccatctctatggaccatagtggacctcctctatggactagatccatggtagacccattgcatcctctctatgacatgcgggtccctcttgtcagtgaccttagcctatcctctctatatggcatgcaataaacagtttaattgttttctatctcttcttcttcttcttcttcttcacaaacatgatacattcctcattcctcattcatcatatccaacgatcaatattcatctataacagatcgaatgggtgagattgtgtcacacccagaaattctcgaaccagaatttctaagctgaatgtgcattaaatccttgtccaggaccagccagggtacacaaacgacaattgttgacatacagacccacgtcttacaaaaatataaaagattataaatgcagcgggaaagataaaagtgagctaaaccaggaagcttgacttcagcagcgggcgactccactccacaggcaaaccttgacggcagcgacgaaaccaacctctctgagacggctccaactgagaagaacttcaactctagtgtgggggaaaagagagcaagactgagtactacccactgtactcagcaagtcataccggaagaggaggtatgatgcaggatataaccaaaggaagctaggggttcttttgcataaagcaggcatttcaaagcagtagttggaagcagtaaaacagctgtagtaattaatcaatattaaccaatcattgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaattgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaacacctcggccgacccaattccatcacgcccattctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcactcacagcccgccatttagaatattttaattaactgacacccttgcggtggcaccaatctaaagctatgccaatagtcagagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaaagtattgcatgacttgccttggcttcgaactgatgagaccttagcaaccgctttcgagaaacccgcggatcgacgaaacggcccaaacctatgcgacaaacaaagcacaacagccaaacatgctttaagactattgaaacaggaaacaaaacacttttaatagattctttgcatttttctgatttactggaaatgaatggcttaaacggagctcggtagaattacttaggtatttagaaaaaaaaatggggttttacctataaagaaaaaggcctaattaattattcgccataatattcacgggtgacgtcatacaagggcgcgcacaaggcggggccacaggttaacggtttaaagggaaaagaaagggcccccgcttattggccccaggcgagtgttaaggaggccggtctaccgggacgggacacccgttgggtccacccgtcacaggaacccagaccgaattggtcgggagcccctggacgaccgcgggcgttagagcgctctaattcttttataattggcggcgccctgttaaatgggttacccccatgctctcatcagaatatatggcggaaacaacgatcaggtcataaagcgtgttctcaaagaatcatcttgtggag

SEQ ID NO: 78282 - DNA, 982 bp, Oryza sativa
  unsure (1)..(982): unsure at all n locations
aacggcctgcttttggccatgaatctaanctgagcccaaattgatgttcgtccaatcagtttctagggagaaaaaaggttcctggtcattcgggtggctaaaactaatttattagggcagcgtagtgtgcaacttttcttgtgaaagtcttgaactttttacagtccttctgtttttaactgacaaaaatccattactatccttctgctgttatctttcaataaaccaagggaattttagtttgttctaaaaatcaattttccctaggctacccagtcatcactcagctcatgatgtatcaaaaaaaatctctattatatttggaattactttcgtgattatgatattatattagagtcgtttagaataccaaactttttcctactaattttgtaggcttctaacataagttaacttcaaatataatcactctgtgaatataggtattgtgcatatgaaaatgatcacatttgaagtaacaaaaattttacaattttaaacttatgcaacaatttttcgatttatgctaagaatgaagtcatcaaagttacatcttattgactttttacagtctaaaatgatacatatttgtgactcgagggagtatatcatcattgcttaggactgtaaaaccactctgaattaaagcaagacttatgacatgcagtcacgcacccaagtcttttgtgtctctttcaggccaatattgttatgtgccagctgctgataatattattggttctcatcttgacttttatcaccagcttagattcgtcaaaagttatgacattcaaccacacacatcacacatccgttggcttcttccaaagagattcctacaccatctgctaaacactttcaccgatggcagaagcaatcttctcggcaattgttggcgatgtgatcggcagagtgatatcccttgttgtcagtaatttcaatggagatcacagcactgaagtcaagttacagaggatatgcc

SEQ ID NO: 78283 - DNA, 662 bp, Oryza sativa
gggtgtgtgtgcgagagattggagatggtgcgctgcttatatacaagctgagctacgcgcggtgcgttgtgttacagctttcaggcggcctggctagctagcttaatataagctgacgatcgagcggccgggcgggctgtcgcgcgcctggaatcgattggttggcttggcggctcggcgccaccagctggttcagttcatcgtggtgggagggagtccgcccggcgcgggatggggtcgttggcgccggcccggggcccgcaattgcgtcgctggagagcggcggaataattgattgcgctcgcggcgcggcgcggcaaggcacatggtgaattggcgttgagatgacaactcctctgccgtgccgcgctgtctactggttacgggggcttgcgtccatggtctacaagcgaattctgatgcagcccaatccgatgatccaggcccattttccgcagggttgggtaggccagatcctcctaatcagaggctcagagcgttcggcccagaaccgtactgaaacagagagaaacaagtacagggaaactattctaatccctcgaggggatgttccctcgtttgctcaaaaatcatttaaatggttatgaaaaattctgaaaaaatttgacaacattcatacaacacatatatacaacttcaca

SEQ ID NO: 78284 - DNA, 2676 bp, Oryza sativa
ttgttttccgtgagacgtcgccgtgcacacagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattcctcaagattggattaatgatagttcacgatggtcaatcgtgttggttgatttaatacatgcaacataaacttgataaatgttgggttgtgagcacatggttttgagagtcgtgctcatgacaattaagagcaggtcacagagtttaggttgtgaaacataaaccgtgccaaccacaagccagcgtgggcacaggctttaccttttgtatagcatggttcattgcgcagcaccagactgagaagtgccggagataagcccacgggggtcgttgaggagtctataccttgtttataaaggggtgattatgatccaggaacggtgcactgctttgaattgtgttgtgcgaggggaactgtcacagctcctttccaaggtaccgtggtggtattgaggcacatggtgacatgtcgtggggctgtgtcttgtgggtacagtggtacacctctggccagagtaaaactattcgaatagccgtgcccgcggttaagggcgggtcgaacaatgtctttcgtgattagtctcacacttctcatcataataaaagatgctataactggtaataatttgattagctcctggtttggaatggtatattcctggtttgaagatagaactgtgcagccgggatggttgttcagaatggttgggcctatgcaacagggtatgttgtatagcattggattaatattgtttaattattacttaactgttttattaaattctgaaatgtttattaaatgctgtttatgcaaatgaaaccctcctatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctagtcaagctgcctgtggagtggagtcgtctgcgtcgtttatcttattttttccgctgcttagatctttattgattgagaggaactatctacctctgtaatgacattttattcgcttattaattagagtgataattgtactctattatcaatttgttattgtgtgcctcggctgattcctggacgagggttcacacacatgtaagcgtttggaattttggatagaaattccgggcgtgacaaaacttatccaagagaaaaagagtacaatctatccaaattattgctttgatttttgtaattggttttgggtacttgattattcagatcaagcttttgttaatagacatgcaaaatatccccctaaattttgcatctcttttaagtgtgaaccatcaaaactcgttgcgtgtatcatttttttcagacatagtgcgagtgatgttccaatggtcaaatcttgcatgtctatgacttgtagagtttgtatagtctatcagtgctgatgcgacacacatatcattatcttcttaataatgattttggggtttggacaaagttagaaccatgttacttgctagaaatggcgaactatgtccatggaacttatgtattttcatattctaacatagtatggttcactcttcacatggtgtaggcttacaggcctaagcaacataagtttctcccaattttattttaaactcggtccaaagagtgagcctttattttttatatgaggatattcggaacaacatttggtttggggctttaaatacttgtatgcgaatggtcaaacccaaaatattttatgcattattattaacttaggtcaactgcgggtgattttaaccatagcaatgccaagtagttctttggttaaaaggatatgtccataataggtttataccaattccgggaacatgctttttttattggcatggccaatagtggacctctcaattgttggaaaaagtttgtcaaaaaaccaatgggtttttaaaccgattttttggtgtactttaaagaaaaattgttgtgagttacgctttttttgccacctccaaaattggataaatacgctcatgtgcaaccaggttgggttgtgcacacaacaattg

SEQ ID NO: 78285 - DNA, 1933 bp, Oryza sativa
tggatttatattagtttatcaaacgggcgcaatagaactgaggtaactctgacttttgccgatttccctgttcttttttcacaccatatacaggatcttagtttgtttttatgacaatttttggcatgctgaattttatgaagatttttgatattttgactttttagtataattttaatagtatatggataaacttatagtgtgtatgatcaatgtattgttggagagaatgtgcctttctctttatactagagcgcattcctcaagtcaggaaacatgactaactacagctttgattgtccacctcaaatactacaagtaaaatctgagaattgtagtgtaggtaagaaaggagaaatgttagtatagatctcatgggaatatggtttagttatatgaaaggaaagagagtcataaattattgttttaaatctagaccatattcttaagttttaatctggaaagttctgtaagtccttaattgggaggtccaatcctggctgtcccagcccaatcctcaccaagaccagttcattttcgttgttggtattgggccctcccatactatgcctgagtgatgtgatcttcactgcgagcatgtatgcatacatcaatgcaagagcctggtaatttttgttgaaaaataattatcttacttttatcatgagcagatctctgccagagctggctattcttgctgaaagctccttaatgtcgttatcaaggtggagttacaaggcaggcatggagaaatctatgagctccgcaaatggacagattgctctggtaaatcgttttgctttgagctgtaaattggtcctaagggttcggttggtttatgccaaataatacattgaactttggtgtcacatatcgccagatgtttgttgattccttttttctgttgtttctggaacgtttatatttgagcgcatgctcaccgtgccaactggcaagaacagttgaagttgactttcgctagtaaaagtcacctctaatcaattccatctttaataggaaactcaagatttaatttagaatctccaggtccatctacctattacaatgttacatagtgtggccacagtacatgcgaatgtaactaatgcattagcgcacaatacacctttttttcacaatccactaatcatccttgatccagtgggaaatgttcggggaagaaatccatcattttttattctgatcttccctctgccacaggtaaacgggttgaacttgcaatcatctctcttatagcctcagagaatgccttcaggtacttggcttttctggcatgtcttctgtgtagtttttttttcctgtttcagttcgatctgctatttaggttaagaagcatagtcccgacatatgaccatgcactgatattttggcattcacaattatcattttaggcttccagagtcaatgccatgccttcatgacaaagtacttgcagcagctgctgaagcagctattaatgcctcaatggaccagaaaagaaaccaggtttggccttgttagatcttctatgtatcatcatcacctgtgtacaatttggcatgacaatgaaaattcatctgtagactccagcaggaggaattcttggtggcatcattaaaggattgaaaggcaaagaagaaaatgcaaaacagaaaggaagtttaagtgcacaaaccatgagcgaacagttggaatcgattttcttgaaagaatcacttgttgaaccatcaatacccgatcctgacgacccatagaagaactgtcaataggtcatcttcctccctgtctatctgaaagctttgcccttaagtactgcctatttatttgaaagcatttgaatgcagacgacatagatatcgatgatgaaattccactagcacccccaccagcatcatctacatctcatgtgaataaaaaaacaacagggctgcag

SEQ ID NO: 78286 - DNA, 3530 bp, Oryza sativa
aaaagttggaagtttatgtgtgtagaaaagtttgatgtgacgaaaaagttaaaagtttaaagaaaaaagttggaatctaaacatgcctatagagaatataccaataagctgaatagcaaacactccgattctaaagtccaattcaaagaagagttcaatcaatgccatgtgacgtgatgtcagagagacaggaaagaactacgaatgtgaccccattcacctccgacatgaaaaacagagcaatgaattagtacgtgattaattaattattagcttaaaaaacttcaaaaatagattaatataacttatctatagaattttttcaaaccacgcaccatttagtagtttgggaagcgtacgtgcggtaaataagagagtgaggttggaagcttaactgaagaatgcagcctaaaaaccatagcattgtatacaacaatcaaatatggtagtagtaatttgtattgcgaagcaatcaaagtaccatggagaggtaggtagtctcgtgcctcggtggcaccggttagcctagctagagttccggcagcatggcggcaagcagggcagaggattgaagaaggggtcggacaggggcaagcgcccgtcgtcgacgccgaagcgactgggagggagtctccatccatcgttgcgagcagctgctcatctagaccgcatatgcataatcgaacggacaacagagattccaatggggcttggagttttaaactctggacccttccaatgggcctctgtgggccaattcagcgcaataggctgacacagagaggcctctcgtcaagtcgaaagactacgcagccacaaattattccactcatcttagtcgtgcaagcttgatcgaatagtcataagatattccacggggttcggagttcaaaacgatgactcccactcccactattttgtactcctactcagcaaagaacaccaccttggccctcgtgccaagcctcgccggaccgccgccgcgtcctgtccacccttcgctagccagatccacatgagaagaggatgcacccaagctctaagcaggtttcccttaccgtcggtgtcgagtttatcgcaccttagcgataaacacgattaccgcgtggtaactgcagtaaactgtataaaatttattaaaaaattaaattatttttaaaatttgtttaaatttaatgagattaccgtggttttatttttatggtaccctaacggtaagtaagtacagcaatttgacggttactgtcggttttgtcaaccttggctgttggctccattcatccctgacggtatgcagctagctagcctgtcagatattccaatgttgtggacgatctggtcgtcgaggtgctctcgccgtcgcccgcgcatgcacgcacctttcatgggcctcgaactctggaatggagtactccctccgttcagaaaaaaaacccaatcctagatttaaatctggacatacactgtcttcagatttaaacccaggattggagtatatgataagctgaatgacatgcagattttaactctctaattcacagaagagttgttggagataatagaaatgtgatgtcagagacaggaacaaactactccaaaccatactccgcatcgatgatcttgttggagcagaattttatggtctcattattgcaaagatgcagcattgaaggttccaatatattgcactaaacaaattggatatagatgcaaattaaaccgcaacacaggcgcgcgcagccgcgcagagtgcatcagagcgatgagatctaatggcctaatcaccgcaatgcatcacgttaacagcgagctgagatcctagagtgggtcggagatttaaactccgaccccgtgcacactgccgcttcacgccagcccgataaacgtactctcttggtctctcgacgcgtagtctcggttgacttggggcggtttatgaagaagagcagaaactgaaaggcagtcaatgcagtgaacaccgtggcagcatttcatcgtgttcatgctatagcagatattttctttgcagtcaaattgagaagacctccagctcaaaagagagagagagagagaaagaaaagaatgagaagaacttgaaagcgatgctaattaacttccggcatcaacattcacgaaccaacacggtacgtcaggcgaacattaattcagaaaaataaaacatccaaagtaaaaaaaaaaccaataaatttcttatgtgctgggaatgcgtaccgtaccaaagcttgcgatggattaagaaaggagactgtccggcgagaagggaccaaagcagttttcttttttctccgaaaagcatccctggacggttggaccccatcccgagttccctgctggtgaagtagtacactcaaatggcaggcttacgtccaggttacagtctttcttctcaaactgtgacacagcagcaatccgtagcagagtcatgtcttcctttctcagttcaatactgctcttgtaatttgggctctatacaacccttttagcatttttttttagagaaggatattttttaaccggcctctacatttaaccggatatatacggccattgaaatagggaacttagccccgcaaacaatccaatctgaaattcgctccataggaaatttgaactcagaaccttggggtactactcagatcactacaacccttttagcatacatgacctgtaaagttacttaatgatccccgcaaaaaaagttacttaatgataacgaataatcaattaatcattcgtgatcaagttatattgaagtacacgaaaaagtgttaataatgctgccaaatgcagaatgctaatgccattgttctttatggactctgctagtaataagaaacaacagggtcagtgttcttgatggaacctacgaggtttggcatacttttgagttctcagtcaaggaacagcgagtgtacataacggccggcccctaaggaccagctgcaaacaacgaactcactccatttcatctttttctatttattattgaccgcggccacacatacagataagttattccccctctttttttataagaaggaaaataaacagctcgttttcttttcttttttgaacggaaaacggcacgagatagtaccttttcattgaatggagtaggagaaacagcttgctttatagtattaacaggtaataaaaccgaaacggtggatcaaagaacatatattacaggaaggatttacatcatcacataaatggaagagggtaaaataaacggagcaaaacaaggaactttcgatctcgatcggcgattattcctcccttttctacgaggtgggccatcacatcgatcacccaaaaaacctccaccaatataaatactggtttcccccatccgaacacaccgagcaatgatcatattgtaatccttcccgtcgccgagagattcccacacaggctaaaactatctatcaggcctgcaaatgcaatagggctgagaagtgaggaagctaggcaacctcaaccttattataaacacggggggatccact

SEQ ID NO: 78287 - DNA, 692 bp, Oryza sativa
atgcaatattgggaaaaacagctgaaaaaaatgataaaataaaaacaaatgtaaaaaacagagtaatctaatataaactaattcaattaaacattacataaatacataccatgtcacatgtctcaattggtctagcaagtgatgctccaaaaactcttttggaccattccaaaattagtttttgaagggtgtttcataagatcattctgaaataaaaaaatacatactcaatttgcaagtaacagagttgtatttaataaaaaaattaaaaaaatacaaacactcatcccaattgatgagaagaaatagtgtcgtttggattttgaaggatgaatcgattgaaacatatatcgacagaacacagacattacaaaatttgataattctccaccttgtttgaatgaagaaccaaaagatgagaatttgcagtgaactccatcaatattaacagcttcttgactgcagtaatagtacaaaacttacatatatgaagaaactgaaaaaaattacatgaaaaaatatttaaagttacagttaattttgcaagaaaaaaaatgtatgcagacattctaacatggagcagcacatgcttgcacaagcattcaatcacaacaaaatgttcagcaagtaaatataaaagtgtcaagcttatcccatagcataccaaaaactataaaaaattaaaaatcatg

SEQ ID NO: 78288 - DNA, 2851 bp, Oryza sativa
  unsure (1)..(2851): unsure at all n locations
gagagccnnttgtatganctccgttagaaccattcttttactaacttattacattttctctaaacagttcaatttagaccctattgacattttctgttagttgctttattttataacagttcaaaatataggcattatggatatttaaatcattggtttaactataaatacaacaatatttatattagaaatcaaatgtatagcttaaaattcatgtatgcttgaatatttttgattatttctcgctataaaaacaggaagggtagatggagagctcaagcgaagtagggaggtttcggtagtgccatgttgtgcatatgtgtgggggagggcgaagtgcaggggacatgagcggtttttttcttttttttctaaatgatttaagtgaaactgatgatccagtttttctcacaacttttgttattcattttttctaatttttaatatgtaacacatggtggcttaagatttttctaaaaatatatctattggctaaaaataaggatatacctatttaagtagaacttgatggatagatggttttcttccaatctgtaaggttttatttttatttaatgcataactcgtaacgccttcagtgcacttcagaggatatacaatgatttccattgatgtaatacttattttaattttattattaggttctctttcctttttgctatttggttacaattcgaaggatcagtgtctacattcaaatgatgtatttttaattttatagagtggaatgtgggtaacatgggtcttaaaatatttatttaattataaataaaacacaattcagataaagtaaaaattggatttaacttaagaactataatcatttagctttctaattattggactgtttttttacttagttaaaaattaggagatgaaggaattaaatgagataggagaggaagagagagttgaagagaagagattacgccgcatataattataatatttctttttatgggttatattgttttagttggtattacttttttagctaaaaattgataaatgctttattgtatgattaaaatctatctttttttacttgtcttttcctatggtatattcgcagtagatattaaaaatataaacactatattctaataacgttattttgacttattgtaatgttagaatggacgagtaattttttaaaaacattactcagagttaggttcattttgcttttatccatatagatataatttaattattctgacatcatatacgatgataaaatctatatcactatttttctataattttgtattttttcgaatgatatacaaaaataaaatattgttgcccaaattgacagatttcttctcaaagatgaattaccgtggatatgggtctttaaatgtaaaatagtctgattaaatattagttgtgtgatacttgtcttttcctatagtatattcgcagtaggtattaaaaatataaacactacaatctaataacattattttgacttattgtaatgttagaatggaggagtattttttaaaaacattagtcagagataggctcttttgcttttatccatatagatataatttaattattctataattttgtatttgttcgaatggcatacaaaattaaaaaattgttgcccaaattgacatgtttcctctcaaagatgaattaccatggacatgggtctttaaatgtaaaataatctgatcaagtattagttgtgtgaattagatgttaatgttgcttacttttagcataagttttgcttttaaactcacagaatattcattttacttttatcattatggacatagtttaattattatgaagttatatacgatgataaaatctatattattattatttcatacttttcacaattgcttgaatggcacgtaaaagtcacaaaatataaaccaaaatttcatttcttttcaaaagctaaattgtgaaatatgatcttcaactgtaaattgagttataaataatttaaagatttaacgtgtaggatcgaatcacaataactaagccaaccagaggggggtgaatggttggtatacccaaaaccgaaaaattttagccgaaataaaagttgccctcgaaattgacggaagtcagtctgaccaagattgatctgccagtctgaccgagtggatgttgccagcctgaccggtatagattacccggtctgaccgccgatgtcgcctgctgcgcctgtcgccgccgctggtctgaccgccgccttgtcgccggtccaaccgccggtgagtcatcggttagaccgccgaaacccgatgaaacacaaatcgaagaactcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactc

SEQ ID NO: 78289 - DNA, 12094 bp, Oryza sativa
aaagaaagcagttgagagatactagcatgaaactgataagaatttgatcatctgtcatatgttcccctttaatgaacttgtccccaaaaaatttcacagagggcattgctgatttgccaaatgtttcaagaatcttgttttttccaagttcaaaattagaagaaatttcaattcctccaacaggcaatccaagaataatatgtacacaatcttctgtcaatggaattactttgtcatcaacaactatatcagaagaagacacatctacatgattagcaatccaagaggcaaactgatttggaacaaatgaagactggaaattcagcaggcttttaaagcaagtccttccaataacttccttatcatgtactgataaattgttgattacttcagagaaatacttcacattgaatctagtgaaaacttcttcacacttgttatctttctcaaaggtttttctctgccaaaaaaatttaaagaaaagaaattaaaaaaactaaagaaaaaattattcaccaatgtaataaggtaataaaattaccttattttcagactgttcaccaagcatgcttaatttcattttcaaagaatggagaactagatcattgtgaatctctaacaatgcatcatcgataattgagtctgattcaactttttgtctctgaaaataaaaaatatcatattaaaaaaataatgtaaattacaaaaatctaaatatgcattaatcataccttctttttatggtcatgtgtaaatggccttttaccaagcttaattttcaatttcttcataagctcttctttagttaaatgaagcaaaggatcattttcctcaaaatgttggtccttaataaaaaaacaagaagattcaaaaaaaatattgaaataaaaaataaacttccatgataaatgaacatgacaaatgaacttacatgattatcagaactttcatcatgattagataaatgaacatcaccatcatgattatctgaactcaaactacaatcattgtcactgttagattcactggaaatatccacttttgatctttttctatgacccatactgcaaggagagaaaaaagatctcaaaacataagtattatggactaaaatatataacaaaacagaataaaacatacaagttaaatgcaccatgtcatatgaaaataatattactttcatatagtagaaataattatttccatagagtagtgtcaaatgtgtagcacaaactcatgtcatatatcagagtatagtgatgactaggaatactatagtcttctccttctgaacaaatgtattaacaatactcttctccttctgaatactaaacctgagcatgcaaaatgcagagacaaaaattgactactataaaaaacattctagtacagaaatcttcaataacttgtgttatttactcatgtaaggttgtcattgaaagattaaaaataccaaactaaaatgcaaatggcatatagcatttgtggatttctagaaaaaaaaatcctgaatcagtgcataaacatccacctaaataccatatagcattctcttgcatagatttagaaactgacatcaaagcattactacaaaatcaatcagtgcacagaacatgcaaatcaagggtatacagaagggtcaacaaatgtacattgcacacatctagttcacaaaagcaaaagcacatatctagttcacaaatgcaaaaaagcaatcacaaaaagatatatctaaaatgaaatgaatcacagatctagtccacataaacaatatctagggctaagaacacaaatcgcaaccataaacataacagtactcttctcattttgaatactgaacatgaacatggaacatgcatcagagacaaaaaaaaattaacaaccataataccattctaataaagatataaaacctgaaacttagtacaaaccagcatatcttagtcatgcaaaaaacaactgataatatcaataacaaatttaactgctcatataaggttgtcattgaattaacatatagcatttgcagatttctagaataaaaacatcctgaatgcattactacaaaaacaatcagtgcatacagataggtgaacatatgtacattactcccttatttgcacacatctagttcagaaaaaagcataaaacacagttctagaacaaaataaaaaagcacataactagttcacaaaagcaaaagcacagatctagtccacaactacaaccacatcatgttctgtaattttcatatagaagacaaaagcaaaagcgcagatctagtgcacaagacaatatatagggctaagaacacagagatcaccgagtcataaacgaatatgaatcaaggggattcaccatatcaaacacatacatagattccgagtcgaaacaaactcagatctacaagccccatgaatcgacgacctaaaacacaagggaaaatcagaaaaacgaaggggaaactcaccgaaatcagctccaacttcacagccgcgtcgtagccaccagcaaaccaaagaccacgagaagagaaaaatgaagagatgaatcaacacaagagcaacaaatagaagaagaaatcgataaaaaatggaaaataaatctgccaccttcacctcccgcaaactgcgcaacaggactgcacaatcaccggacggaatcgccgccgctcctcccgacggaaacgccgccgcttcgcccgacggaatcgccgccgcgtcgcctgagacgacgagaacgagagaaatatctctctctctccctctatctgactcactctctctctctctccatcggcacaaaaaagacaagcgcggatttcaaaatttgaacagtgcccatgggtcccacacaggctgtcgaaaaaaaattctgatgtgggtcccacataattaccacacacaaaaaaaagcccaaaagcccagacacaaataaaaagctcataagcccacacaccgataccacaaaacgaactacgagccagtacgaatcacaaagaaatccgacggcttaaaaaacgaatgatagagccaagaaaaaacatgcgattgccaaatagccatcccgtattgtttatgtgtaagaggtgggaccatatattaatggtgtggtatgtgtttatatgtagctattgtataaatgacatattagattggctatagatgaattggagatactagttggctatactattaaacttgttcttacgagtgacaattaaagatttgttattggacccacaaatcatagatatacgaggacctacatatcatagactatgagtggtaaatatttaattgcgacattttaaaagtggcaaagatgataaatgtcccctcaatttaagacttccacacgtgccgttgctttacatttcttccacggttctttctcgttttgttttcttgattcctattaacattttataatcgaagattatagccgttaaacgatgtaactcattttttaaatactccatccttttatattagagaaaagtacaaattaacccctgaactattgggtgagtacgaataacaccccctaaactcgaaaaccagacatcacttaccccgaacttttaataccggccaagaaaccccccccccccaagcactgttgtgagcggtttagagttcgaatagcacacgtggcagtccagtcagcaattttttttctaaaacaatagcgggcccacttgtcagaatccccacctctatttctctcctcctctcgttctgaagagtgcggcggtggcggcggccggcccgctctggaggagtagcacgagtgtgcatgcggagaaatacggtggcgcgggagaggggttgacgcggcggggcgcggccagtggcatggaggcggaggcgagggccgcgcggtcgacagcgaaggtggggcggcggagatagagagccaccaccaccatagcctctgccgccaccgccaccaccacaacctcttccgggggagaacgacgccggagctgtggtcgcagacaaagacggcgaacgagaggaccaaggcgcaggccaccaccacgcacaacgccatggaccacggtcgcccgagttcgataaaatcattactcagttttttgagatggagataataattgatctcgatctgatgtgtccatggaattcggaacgtttgttgcttcaaatcgattcacagttgagcacttgagctcctccgccatgcacggtggcccagagcttggacgccaccaagaaggaagaagtttttctttttatttttttttgtttatagctctccgccccatggacttccggcagccaatgcccgtcgccccaccgacggcacggtggttagctggcgatgcgtcgctgtcacggtgctgacacaagccatggccgcctccgccgccgcaccttcaccatcgaccgtgtctccggttgcaccgccctcgcctccgtctccatgacgctagcctctgcaggcgccccgcagcttcgccctctctcccgcatgcgggacagcggggcggccgcgcgtttctgaaggagacggagaagagagagagaaaagatgggtggggaatctgacaaatgagcccactattttttaaaaaaatattgctgattggactgccacgtgtaatattggaactctaaaccgctcgcaacagtgctcaggggggtttcttgttcggttttaaaagtttaaggtgagcgatgtctggttttcaagttttggggtgttattcgtactcacctaatagttcagggaggtaattcgtacttttctctttatattatactcactccatttcaaaatataatgcataatcacctttaactaaaaaccaataaacaatcattatcacctcattgttggctcatcctaataaattagatgatgtctcgcgcgttattgcggaatatttgtattaaaatggaatttaaaaattcaagtacactttgcgagataaaaaagtagtaagaaaagagggaaactgaggcaatacagcgtagcaacttttgcgaggaataaactgatagcaatgcttcactttcagtgcactgagacctcatgtaaaacaccacgatagcgcctcacagaaaataggatcatatttaagcacgatgaaccaataggataaggttaataacaaagagcacgcttgttacctgttgcagaggcaagagatgaatggttgtctatgaattttctctctcaacaggtgtagctagctattccgaaactcagtttattattgatcaaacgataactttcaaatctagggcaaggagaagaacaatactgaaaatactgaaaataattttcaaatcttgggttagggtttcatggtcaaaagacccatttaacaagcccaatgggcctaattggttggcctggttcgctctctcgctcgcagcttcaccaatcgccatcgcgctctcgctctctctcgtggtcacgccatggcgctggtgtggcgtcctgggaaggaggacgcgcggggggggggggggggtgctcgcgggaggagcaaggtaaggcgagcgccacacccgagccctccacccctgcaggttagcacacaaggtaatttatggtaacaatatcctccccaatgtaccaatgacatggcacgaagtgcggttttaacattgtctaatttccccctaccttcaattctctcaacgctatccattttcagccatctactttatatatattttttatttcttatgcagcacttttgttgtttgaaagcaacatgccatttcatacattcaccaacaatatgtttgccataaaggctgacatagttaccaactgacattttccacattatttcatttttaagataacatatatgaatcatagcttaagcttgagagcgaccaaagtttattcagcaattcagcttccaagctaagacggcacacattgtgatagatggaaagttaaacgtatagaacaccaacattgtttagatgaaacaaatattaatagcaaagactattgctaaatctatatccatagtcggcgaaaatgcatgacagcaatctcgagaaaatggcatccacaattcttcgaaggaagcaaaatgttataacaattatcaaaccaagccatcactgttatacatctgtctagcaagaagccatgatttgtaatacaacccaatagcccaaaattctttgcaaatatatgctaaacagagtataaaaattcatctttgccgattggtgagcaggacttcctcgatgagcctctatgctagtaatgctcgatctttgacatgctacctaggattagattttcggggttggagaaggcgggatagggtaggagggcggtaagggtgggtttagagggatgtctagggcggcttaagaacaatggtcggtggcgacaggctatgtagatgggagggcggcagggtgcttgaattacagggatggtggagggcagtgggaaggatcagtagctagggaaaaggacgtcaacagatttggttgaaaggtagggttggcagaagtggatctggcgctaggagccactggatatgggggatgagtagcagggtgtgggaatcttaccggagctattaaagagggtgatgacacccacacggaggaggagcacaagaagggagggaagcggaggtgtgtgtggatgcgagtcttgccccgctgctaatgcgatgttggtgaggtggaggaggcgttatagatggaggcatggcgtattggattgggcatgatttgcggcaacagactagagtttgaggagaagagatagggttccctgagtttcacgaatcttgatgagatctgaaccaaacaaaaatgaactgatggatagagaaatatcatgcagctattaataggtggcctccaatttagcataccatcataacttctgttaccttttcctatgcggtggcgtgattcagttcgatgcccggaaggagcatatcgttcgacgacaagctctgtgatcgtcatcgccaccgctgacactgacagcaatgcgtccaccactagggcgaggtccttgctatggcggttcttgaggtgcagctttttcagatgcgggaagcccaaggaaaagaggcgagcattgacgaacccctacgtcaaccacggcaggtcctccaggacaagaatggtgagcatgcccaggtacgacagtgacaccgtgggccatttccgcagtgcgagcttcgtcagacgcaactaatccgacggcatgaaccagtagagcttacggatgacatgcggggatggggaagcttgccagagttgttgaagtgggcgacgacagaagcttggaggaggagcaggagaaggtagggaagcggatgtgtatgagattttgagtcttgccacgccgctggcgcgatgatggggaggcggaggaggcagcgtggtgtgttgaattgggcacgatttgcggtggcgaactggagtatgagatcaagagatagggttacctgatttgcatgaatcttgatgatatctgaagcaatcaaagatgaactaattaataggtggcctctaatttagcataccgtccaaacatcagtttccttttcctacgttaatatgtgcttatttacctccttctttgttccaatttgtgtgcacactccattggcatgtgacacactagcgggtgagttagtggttggccatggtagtgagtgagctggtgggcagctgtattgagacatatttaataatttacactaatgtcttctaactccacgcttttgttgaatcctacatgtacaaaagaagttctaatacaaataaggtgaacccactttgagatatacaaaatcacatattttttactcattgggtgattgaaaatgtaaaacacattagttgattctccaactacaggagatgtggcagcaccgtcaaattagtgttcggggtagtaggaaggacgggagagatcgaggagatgaggtcggtccccggtcctcatgccggagggggagggggatcggctaaagctaagggagggataggtctatcatataagcgtcgtaaaaatcttggggaaatactagccataaaaatgttattgacatttaaaaaaaaaatagttgcctactgaagacacaaccaaaaaatgcaaattaggaaaaactgtaactgcaatactatgaagttgaaggtttttatagatgcacgtttaagcaatgcaacttttactctgcatatatcaataaaacaacaagcttaccaataccaatagaacatagggttattgtctcgtgaagagcccaagcttgtataaaatgtgtctcccatttgaccgaaatgtcccaaaggaacacacacaaactggacataggtacacaagtttctgttgtcaagatttttattgatgacatattaatagcaaagtctattgagaaatctccatccatagtcaacgaaaatcatcgaaaatcagcatgactgctgtctcgagaaaatggcatccgcactaattcttagaaagaaatagaatgctacaacaattccgcaaccatcactctgcctcgaacagtgacaccaatgccgatctcgctcatctctccggggccaaccttgtgcgccacctctagacaacaacctgcatggctgattacgaggtggccgcacacatgcttggcgagtgtgagcgtagggttgtcgaggccgagatctgtctccaagccaagatcgatgcacttcagatggagtatgatcttctagccaaagaagtgccaaagaaggagaaagaggaggtgcgccttgagaaaatcatcgttgaggctggtgcccgctttaaggccatccttgttggtattaacatgctacaaagaaggaacgaggaattccttgtcgattcacaacgctacatggatgaagttgaacccaaccttaagtctgcaatcacagtggttgaagtgctctagaatatgtagggtgctacgtgccccacctccagccaacaatgaacatagttgaggctaacgaggtcatcaccactgtgcctgccctagatctccctccaggcctagatttgtaccatcagaaagtggatctcgctatgaaagaagggaaacaacaccaagaaggtcaatatggtgagaatactaatatcaactgttgggaagaggagaaatagatggtctgtaccaaagcgcacggcatagctgtgttccaccatgaaccacggtcagatgttggctattgtggatgagatcatgatccctaccctttatgtggatcttcccttggtcctagatctgctacagcaggaagtcgatctcgctgtggaagaagagcaagagtgcctagaatttctcgattgcaagaatactgacatcaatagcctggaagaaaaggaagagatgatctgcactaatgtgcatggtgtgcctgcattttgccacaaacaactgctaggtgtggccatggccctaaccacagcttgcccccgtcgtggatttgcctccggtcctgcattttcaccaacaagaagtggggctctttgtgcaagaaaggcatgagtgcgggtgtagtcaatgtggcaagaatactaacatcaacaccaacaaaaatgaggtaagctgcaccaatcattcaagttcttctagcaagagaaagatggctgacatggacaacatgaccatcccaccagttttgcgcaagagacctcgttgcatcgacaacttcaagagcaccaaaaaatgagggaggccatgcaagagttcaatcaagccagaaccaaccatgtcaaatgatttcaaatgcattctacaattgcgattgccactatcatccacagttcctgcatccacgaatgtatcattgttggatttaccaattatagccactgtacccccctccagttgtgatctcgttaggtccacacttacttttggaaaccgataatcaagagagaaattggaacaagagatcactatttactgggttgggaagtgttgatcaagaatatggaattgaataggaaagtgctcccttgctaccatcatctatgcaacaaccttcttcttccttggggctatccatgggtggttctcaaatagctacagcacaagtagcaactagttttgcctctgtccccaatatgagcccacccttggttaaagaatcaaaccagggagatatagaaatgcataacgaattatcccatttgcacttgaataatttgatgaaccaactttcttgatgcttggatggaagaaagtggggcccctttatcaattagcaagtacccttctctttggtgctcccatccaacagtaaaagtgcctctctcgtgtcaaaaatggaaaccagcttgtgggagtctcaggaaaatatggttatgagattcatggaaaatgtggagctttgcatgggagctatttgcgctctttatcgccaaaagaagctaatggttgaattgacatgtgaagaacgaactaagtttactacactcaataaaagtcaggcttacaagtatgttaaatattaggtttgaatgctaggaaggaaaattattcatatttttacatattatctgcatacaatcttgagaaaatggtatccacataaattcttagaaggaaacaaaatgttatgtcaactatcaaaccaaaaccattacagttattcatctgtctaacatgcagccatcatctgtaatacaaccccatggtccaaaaaaaaaaacatcgcaacaatatgctaaactgagtttaaacaaattcatcaatctttgcctaaaaaagaacacaaaatgtttctgacaaaagggagtctcataatctatcccagaacaacctcaacgtcctctctgaaccaactccttccacacaggatctgccccttgatgccgatctcctccattctgctccaatggcggcgctctcctcctccaccttcctgctgcctcaccacctcccactcccacagcccatcgtacctaacctccccgtgccggagcagctccacctgccgtagcgccttgcacaccttcaccacttaccttcagggttttcaatttcgaaattagattttatgccggggtgaccaaaatttatcggtaatttcagaaatttctggctgaaattatttgaaaatttgactgaatttgaatgaatttaaataaaatttgaccaaattcacaaaaaattgcaaaaaaccaaaaattttgggtgagatttgagcatgctagtcagctagtgggggcgaaattaccgaaatttcagaaatttcgaaccggaatttcaaaccctgcatacctcacgaatgccacctgccccggcgtcggcccgaagcaggccaccactagctcccctagcttccggtgccggaacatcgccggcggccacatgatctctcgccccggcgccgccgccgcggccggctgatcatcagcggtggcggcgacgtggacgtgcagggactccagggacggcgcggcctgcaggaggaggcgcggccacgagacgtcccaggtgggcggcacatcggcgacgaggagccgcctgaggctgcgcagccgcgtgctgacgcgccacgggaggatccacctctccggcccggtgaaccggacgacgaggctggccatgcgctcgctgcggacgtgccagtcgagcttgtacttgtccggcccggggagagggtgctgggcgtcgtcgacggtgctggagtcgagggagaagctgaggtggactcgccggaggcgcgggacgtccctgaacaggaccaccaccgggttggcgtcgtggatgcacacgccaggtcttccagcgcggcggcgtggttcagctggatgccgaggaacaagcagcgctcgacgacgagctccgtgatcggcgccgccgccgccgccgacgatggcggtggcgcgtccaccaccagggcgaggtccctgcagtggcatttcttgaggtggagcttcttcaggtgcgggaagcccgaggaggagaagaggcgggggtagacgaaaccctgcgtcgacctcggcaggtcctccaggacaagaatggtgagcgcgaccggcatcgtcgacgccagggggacaattcctcagcgtaagcttcgtcagggggtgcagg

SEQ ID NO: 78290 - DNA, 534 bp, Oryza sativa
gacgatgacgaagccgacatcactatggctccctgagctcactgccaaatccgctgggacggcgccacgcgatttttcctctgccgccactgcgtccacagctggaggtggatctggagccatcgctccaagcccctcctcagccgccttctcgtattctcctgccttaggtgtagactgcagagagagatagagcaagggagggatggcttgactgggggagattacatgtgggcccatgctttttttctattttctttgctgactggattgccacattggcgtcacatgtgcaagcttaggtcaaaacaacctaaaatagtgctcaggggggttatttatctggtttgaataattgagggtataaaacgtatggtatttgagttttttttgggggggtaattcaatcgaccgtaatagttcagggggataattcatatttttttcccttaatatatctctatcctctgctattataaaaattgaagatgtttttaccatcagaaaatctagggaacgaagtcccatagacat

SEQ ID NO: 78291 - DNA, 1290 bp, Oryza sativa
  unsure (1)..(1290): unsure at all n locations
tgagattnntttttggcgctctcgtgatggatattttactatcgaaacagcaaaaaattcaaaatccagcggtcgccagctaacttcaaacactaaaacatagtaactgaacaatagctgggctggcgatagctagaagcctagaaccagaggaagaatatgcacgaatcactgaggtcgctgagctgaattccaactcgaaaaccactaaatcagagcgcagaaaaagcgggttcgcccatcgccgaccaccactcctcctcgccacaaatttacccccaaaatcacaaaaactcgcagcaacccaaacctcgagcagctagggctagaattcaaactcccgagagcatccggatcagcggggcgcctcacctgcctggagcccctcgaaatctccgtccacgctccccattcctcgccgcccgggccggcgcacggcggcctcggctcagatcgaggccgccgccggcgagattgggcggattcgagctcgggcggcgccgcctcggggcaatgcgggggctggttttgttgctccgccacgcgtctcgtcgccgtcgtgcgcggtgcgccgccccccggccgtgctttgtgttgtcctctgtgtttcgcttttggttttggtttgggttggtttgtcctctcgcgcaggtcgcgggtttggttgtgntcgcgtgagtttttttttttaatttcgttttcaaaattgaaacttcgcttgcgtgaagtttgctctggtcgncgttaccggcaattcgaattngtttaagaaatagtcgnttttttccattaacgtcacaactactcacatgtatatacactatacactatgataaatccctacacagtacacacgttaagactatatatgacacaagactaaaaaagtaccacgttaaaagagagcacgataagtttgttagtacactaaataagtattgaatgatgttgatgaaagtgaagtgggttgaaagttatggtaaagtgagttgaaaagtgaataaagacaatttattgtactttgcccagataattgggtaacccacaatatnttggtcagatcataacgggggtcaagtgttgataaaaataccttggtgcttagatgaaggaaataaaaaattgttgttttcctttgccttttaacagccgacccccccacaactcttttttttnggccgggatgcagcgatgcgccgnaatttagggggggggaaaaacatgttaagaatcggggcggttttttaacctcgcccggaggaatttctccaacttctttccgccgggttt

SEQ ID NO: 78292 - DNA, 11784 bp, Oryza sativa
tgacacggaagtcgagcgccggaagctcgcgcgggaggcgcgcccagcggcgggacagcgcgtcggtgccgagcgcggagcaggtgccgaggccgcgcatgacgatgagcaggagctcgtcgggcagcgcactgaggcggtcgtcgccctcgctgtgggacgccgcgcgcggcggggcgctccgacgccgacgtcgcggacgaacagccattgtcacggcaacactgacacaagttgccgaacgatttgtatttgaaaaaatatataaaaaagaaaattgccgaaggatttgtatttgaaaaaataataataaaaaagaaagttgccgaaggattccgattcggtctcggactcacgccggagtaagaacaatgtcactaaccaacacagtcacctcaccccggaaatcatcggttttcctgcaattccaaggtcacgacatttgttaggaccaaattgaatttacttgcaaaatacccgtactatttttttacttaagacactaccaggcttttgttaaaattttgtacaatattaaggaaaactatataaatggagttaaaaaaagggtgaacaaattttacaaactttgcaaccattcaagaactgtttgttgcaatgaatctttcatcctacaactatggagaactactttcttgaacaaagcaaatcatgattccacgtctaaccttgtaccttagaaaatacaaccatttgtctccttccagatatgccaacaagaaaaataagaattctgttacccttaattagatatgccaacaagaaaaataagaattctgttacccttaatttgttagcggattaaacaagaacttaaatgtatggtatcactaaacaagcaaaatgtgttactaaccggtgctaaagatgatttttagtctcggtttgtataattgagactaaaaatacccatcataagtcccgcattgtgtgtcccagttacataactggaactacaaagggttgccaaccgggagtaaagtgattatccccagcgatggatcctacgatgatagttgaatatttttgcttgttcaataaccatgtgatttacattgtctaactatagcacacaactaaaagaaattaatgataacatctaaatatcactattttcactactttactactagagaacagagacttataatatcgaaaaatcaatattttcactattttaaatttaaccatatagcatcgaaagttactagtttactttaacaacaccataagttaatttcgttctataatttagccgcttttgctgagtaggcgattgaaataagaaggaatttcaatcacctaggcttggccgttggatcaatggccagggcatcatctacaccattggaccaagggaggcaggaagagaggaaaggaagggaggagggagtttgcttatcgaccggtgatcgggacttccttggcaagcctacgctaccgatgcctaaacaccgacatgctacctatgtattagcgttctagggtaggagggcggttagggtggatttagagggatatttagggtggcttattacctatggttggcggcggtggcctacggagatgggagggcgacgaggcaccggaactgcgggtatggaggagggtggtgggtagggtcggcggtggcagcaaaggatgtcatcagatctagttgaaaggtatggttagtagatctggatttggctgtgtgagccacccgagatgggggatgagagatagggcggggaagcttactgaagttattgaagagggcgacgacatcggcgtggaggagcagcatgggaaggaagggagacggaggggtgtgtgggtgagaatcttggcccgccgctggcacgattttggcgaggtaccacaaatggaggtgtggtgcgttggtgtggggacgatttgcggcggcggggtggagtttgaggagaagagatagggttagggttacctgatttgcacgaatcttgatgagatctgaaccaatgaaaaatgaactaatggtggatagagaaatattaggcaacacattaataggaggcctccaatttagcacacagcccaaacttccgttaccttttcctaggttaatcattccttctttaccacttttctgttccggttcacgagcatgcaccattggcaagtgacacattagtgggtgagttatagaaaatatcacatatttgctactcatcaggtgacgaaaaatgtaaaaaccattagtcgaatatgcccaccatcgatccatgtgtgtgaatcacactctagctgtccttcttgatcaaaatgtcttttccaactataggagatgtggcagaaccactggattagcattcggggggttgtcatgggagatcaaggaggagaggtcggtcggggggatttggctagagctgaagaagacgatgagatgtcgacggatttggcggggattcgggatgagagagggagccgctggtgggcctcgcaaatgcttgccgatgaggggaggtggtggggagggtgtcggcaacctgacagatcaaatgtacaggacaaggaagggatatgtctaggataagtgttgcagaagtctctgagcaaccctagccataaaaaatgtaatttccatttaagcaaaaaaataataatgaatacactacccaagaatgcaaattaggaataaccaaaagtaaaagttataccatgaagttgaaggtttttacatatacaggtttaagtaatgcaacttttgtaggtgattgattagcatagcctcttgttaggcaatggtgtagcctatgtgcttgagatcattgatgtgcatgagaagaggatagatgtggtctagattgcaaaaaaaaaatgtcaaagttttgtaccctggggtgaaagcacacaatgaaactttcacaaagatgctcaaactacaatttactcattaataacaaatataaaacttccatcgaatgagagaaagagtttatttttggattttggcaaaataaataaataaataaatacacacatatccaagtgaattggagtcctgtccacagagaatgtgtgtgttagatgcaaacagcacacatacaagggttgtggaaagatttgagtaattatggccatcaaagtgtaactgacatttataagaaaaaatatatatgcatgataaatacacaatccaaaaacacaaattaggaaacttcgaaagtaaaagttataccatgaagttgtgtggcatcctggcccaattaggaccgacgaggacatcgggtcctttgagggtgtgtgtgttggggggggggagctcctgactcaattaggatgtagcatgtgtggcccataagagctatgtgtacatgtttagtaccacagtgctactttagcaagggtgaccttttaagtaggcctgtccgtcgattgtgttgggctgcacagttatgaagggcgggcggttacaagttgaagctttcttatgtgcaagtttgagttatgtaacttttaagtgattaattagccatatctatcctctccaaagacaaaggtgcaacatgcatgcacacaggtgggaggctcattggcatgcacgaaccattgtactcgaggtcattgatgtgcttgcagttgaggcaatccaaattgccgaaaagggaatctccttcaggagttcgcatcacatagcgggctttggcttctatctatttacggtgtgtttagttcctgaaaaaagttgaaaatttgaagaaagttgagagtttggaaaaaaaaactagaagtttatgtgtgtatgaaagtttttgatgtgatatgatatgatggaaagttgagaatacgtgagaaactaaacacggccttagtggaaggagccatccctatttgtggcaaggagtggatagtccaccaattccaattataatttgccaatgacttgtttcatggctttaatttgagccacacatcgtacgttggaaacaaaaataaccacattatagcaggtcaagcagtggaaaagaagacctctgaccacatgtttgttcaagaataagctggtgactagtaattggattttgactttttcttgcattgttatttaaaaaatttgtacaaatataaaaaaagttgtacataaagtactttagataataaagtaagtcacaaataaaataaataataatttcaatttttttttaaagacgaatggtcaaaaagagcaggcaaaagggaagaaaattatgtaggactgaggtcctaccctcctccgaaagacttggctcctctatgtgacacctgtcccacacgaatctcagagcagcttactccctcgtctctccagttcccattctcttcctttgctcggtgaggcagcgagctcgcgtctgaccagcgagctttagccgtgcgccccctggcgttgagcagcatcaagtccaagctcgcgctgccggcttgccgctagtctgctagaagaactctcatgatttggacgagactgcgctgtcgactcgaatctgctacatgattattcactgattcgatttttcttgcctcatagcgaaattattcaatgatttgatttttcttgccgttgagtttgctctgtatggtgtactgcactgataatcattgctggtgattgacttgaaggatttctttctttttgccgggtgagcattttaggattatagcgttaatttattgatgtttcttctcgacgagcgcctcatgtgagcttggatgctttcacgttactgatatcgtttgattccggcgttagcgacaacctgccgagcttcatgccgctcacccgctggtcggacgcgagctcgccgccttcaccgaggagaggaagagaatggtgaactggagagacgagggagtaagctgctctgagattcgtgtgggacaggtgtcgcatagaggagccaagtccttcggaggagggtaggacctcagtcctacataattttcttccagcaaaaagtgagtagcaaatatcaatctaaaacttccatctaatcagattaacagatttttgttcggacactttgttctcaaaatcgaaatcatagaaatccacgcgagagaattctgttgggaggcatccacgcgaatcggagtcgtccgcacgaagacggagatttggtcctgcactctactctagatcgcaaaaccgcacgtacggaaccccgcggccatggccgcgcccgcgggcaacgtcgagacccctcctcgccgccgcgtgcgccgccgcatcgccgccgccgcggccgatgacggcggcgaggtcgacgacgatggcctcagcgtgctgcccgacgaactgctcctcgtcatcctgggccggctcgacacgcgcacggcgctcgccgccgccgcgctctcgcggcgcctggaccgcctcgcgcgcgagatccccgcgctcgtgttcagcgtccgcgacgtgctcccgccgcgctaccacgcctgcgtccgcgcccacggcgacgccgccggcgcggacgccaggaagctcgacgcggcgatcggccggtgcgagcgccgcgccatccgcgggttcgccgactgcgtcagcgccttcatggagccgcgcgtcgccgtcgccccgcgccgcgccaggagtctccggctcgagttcttcgcggcgcgcagcacgggcttcgtcgaggacctgatcgccatggcggtcggcgcgtggggcgttcaggacctcgacatcaccgtcgtcaagccggcgctggtcgagcagggcccctgctacgccttctgcttccccgaccaccgcctcagcgcggagtcgctccggtcgcgcatccgcagcctcgccgtgtccaactgcttcctcccgccgccgtccgagctccggcactacgccgcgctcaccaagctcgtcctgcaggacacgcacccgcggacgcccctcgccttctaccgccaggtgctcgacgcgtgcccgcggctcagggcgctccacctccgccgctgcggcgcgccgtggtacgccgcgctggtggtcgacgggatgccggagctccgcgagctcgtcgtggacggctgcggcttccacaccgtcgacctgcgcgcggcgccggcgctggagcgcgtggcgtgcgtggacggccccgtcgcgctggccttcggcggcgccccgcgcctcgcccgcctcagcctcacctacgcgctcgacgaccgcctggtgctcgtccggaactggaggctctccggcctcctcggcgacgccccggcgatggcggagctcctcgtccgcttcaccggcgagcccaagtggatgacctcgggaccgctccgctcgccgctgcccggcctccgcaggctcgtcgtcgccgacatgccgtccaactgggacgtgtcgtggccgcgcgtcatcctcgaggcggcgccatgcctcgaggtcctccacatccacgtccaagaagaagaagacgacgccgggacaacggcggcggcggcggcggagataccatggccgccggcggagagcgcgcggcacgagcgcctcgcggagctggcggtggtggggttcgccgagacgcgggggcaggtggggttcgtgaggcacgtggtggaggcgtgcgtggcgctgcggcgcgtcgtgctggtgaggcgcgggcgcgtcgtggtcggcagcgaggggcggtactgggactggaagctggtggcggcggaggcggcggcgccgcgtgagggggaggtgggaggtggcggcggcgacggcgagcgcccgacggcggcggcggagtggagcgaggtggagaagatggtgatacggagccaggtgaagagcgcgtcgaggcctgacgtggaggtgttcattggatgacgtatgctatcacgagtccacaaacactttttggacctagtgccgattgtatgcgtaattgcgtataaagggtgtatatgatattttcacatctaaaatcttaaatcttagggataattgcatatttgcgctcgtttgaagcttatctattaaatgaccctactttcttatagtttgcttatttggctcggcttttcaagaatgaataccctgtctgaccctatttccactacaacgttacggtttcatttttttaaaaaaaatataattattattcgtaatgaccaaactactctcaaaccctatccattccctccccctctctcgtattccggttgaggtggcggcgcacggaggggacgagccggcacggccactcatggagggaggtagcggctgcggcggagggaccggacccgcggcaacgcgtgtgcggaggaggctgcgggtgcagagaaaggagcggcgacgacggcggtggtggcctctctcccacgtgctggtgacctccggcgcggcacagggcaccattccctccctccatgggcgcgtcgtcaccgctcgtcctttgtgcgctggcctgcttcctccgcacacgtgatgccgctgcccaccctccacacatcgacgagctccttcgccacacagggcgctgcttcctcccttcccgcgccccggcctccgtcttcctctgtttgagccccgccgccgggtcggccgcgacgacgacgacgccgtggcaaagaggatgggtggttgacaaatccaaaattttgttatattttatttatatttttataaaatagagtcaaataagcaagggtagaaggggcaatttttgctccgattaaaactgttacatgctcttaatggaatagggtcagattgtatcttcaattttgagaaaaatggtcaaataagcaaagttgaaagaagatagtcaaattggtagttagtcctcaaaacatggtcaaatgcacaattgccccaaaatcttattattgtgtgtgaggcaaaggtccgattggttggtaactaagagcatcaccaacagattatctataattttctcctaaaaatttggttttgggtttcttaaactaaaaatagaagtgaaaaaactcctccctccaacagatagcctaaattaaatccccaaaacttaaaaagtgggcccttctgttaaactactaacataaaattccgtttttttcttttatgtgcagaaagatcgctatctcccacgctcgggaacggaggagagaggcgggattgcgagattgggagcgacttccgcgcccgcatataaacggagcaaggaatggggagaagggaactccaaaactcgggtaggagagtaggggatctgttggagttgtttttttttttttttgactaaaatccctcaaaattagttttagaaatcatataggtagattgttggtgatgctctaagggtgggttttgatgggaggttttggatggataggacatgacgacccttttttttattgtttattacctctctcctaaaataaatttatttttcacccatctcacacataccaaaagactaaaatactcatattttttttccaatctcaatacaattatttttcactttatctacttccaatataattattctttgttttcacaaatttcaatgcaataattacttaaaaattaaatttattttaagacaaatgagatgagtaaaaaaacttaatatgaataggaggaaataatttatattccaacctttgcttcaaccatactccagttgtaccaaatttcagatctcactgtccatcgctgcccgaagacaaatcgtgtccacggcggaatcacaaagcccccgatcggacggccgataaatcgccggcgatttgatccgacggctggtaaatgctcaagcgcgactcatctccccccaaccttctcaacccacgaggtgggatctcacggcctcatcggcgggcgagatgaacgccttcaggctcgccggggacatgacgcacatcatgagcgtcctcgtcctcctgctcaagatccacaccatcaagtcttgcgctggtgagtgactgatcagccgactggcgcctgcttaagatgcatttttttttactgtattgagtcctggattggttgccagcagctcaagaaaggtagagttctggatcttgggggggaataggggacgctagcacaatgctgtttagtgagggctaagattggtggtgcttgtggatggattctgaggctttagagactggaagtttagagggtttgaggaaattaatcttggctttttggatgcaattggaatggttaagatgtaggtttggtagttgtacatttgaggctggatcctggaggaaatgttggatcttggcttgctctggtaacggcggtggcgttgcataagggcctatgctttttggaagatttcagtgatattgccactccattgttttgctaaaattagagattggtaggttagattctcctattatttttgccttcccccatcttttttctaacaatactgattgattgttagattctctggaaaatttgaggacaatgttgtgttgtctatgttttgtaacgcacttttgtcgacttattgattgttattgtgttaaaaccagagtggtatcatatatggggacctgtcctggtcatttgcatttgtgtttcttaaggatcccatgtacagaaaattttcatgtcctggttcaatcatatctgtccccaaggggccacatgacataaaattttcatatcctggttttttgttgtgaaatgatagatcaggtatatgcggatttatcacatggaacggtaaaggtattgaacttgtcatgtatccattggcatttttttcatttttgctactcaaaactttttatatatgtttcataatttgaaggaactaaacttgtaatagtttgtccattaaagaagcctttttgctggtcactactcactattcagacccgatttaactgcttgcacatcatgggtgtcatgtttgtggttcgtatgtaagaggccctcagaattactgcagtgctgtaccacttttaaattatgctagcgtgtgtcagcatgcggccaagtaatttacgaattgtattcatagaaccagaacattgaatggctaagattatgtgttgctcagaatttaataataacgagttggtgaattccaataatgtggttgctctcataagtgcagcaaataccatcattcctgtaattttcaatttttcccttgtagacacattagattttggaggatgcttgttttgaacaatgtctgtatcactcactcaagaagtatcatgaacataaaatcaatttttaatttcttttttcttgtaggtgtttccttgaaaacacaggagctatatgctcttgttttcgccactcgctacttggacatatttacagactttatatccctatacaatacagtcatgaagatgattttcctgggtagctcattctcaattgtttggtatataaggcgccacaagatggtcgcagatcatatgataaggatcacgatacatttcgacatcaatttcttgttctaccatgttttcttttggccttgcttatacatgagaagttcacttttagggaggtacttcatcaaatcaacttcttgaagttgagaaaatataagcttccaatgataatttatctcagcttttaggtctgaattgatatattcccctttagttttattacttctataagttatgaccaaacttttttggggtttatccgaattaggtgatgtggacgttttccatttatctggaggctgttgcaattcttcctcaacttgtactactacagcgtacacggaacgttgataatttaacagggcaatatgtgttcttcctagggtaagttttgaatatggataccattttcttttgagaaaacacaactttcaatattttctgatccatctctgaagcggttaaaccccaattgttgcttgtgtcttgttgatgttagttgtgctcaaaatatagtccacatttaatcaatgagcacataatctttcatcttaattattctttcaggctcctaagttcaacatagtcgagcactgatcattttgcattatcatgttaagttttttgtttaccctttccaatgatttagctgtttttcttccatggataataagatgcatatgcaacgttatcagttagaaattttcaaatgatgtacaccataatgtattccattgtcatctatttaaataagggcatgtgttgttaaagatatttcagacttgaatgatgtgtctaatgtctactgtttttttagtcaatgagaaacatggtcattggaaatagattcataccaaatatggtttcagtaagacaaaatcctaaaattaatcagcattgtatcaacatggtgactatgttgcaaagtaaccatttttttccaggttcagagaacttctgtggagaacatgcgatgtaacatgaaactgtccccttttgtcattaccgtaatttgtttctccattcatctttttggtcagtttgattgatggaatcaattgtccctatttgtgcttctactccacatgctagtgcttgcaaggattttcttttttgacatttgacttgtatatcatcacattgtccttgttagaggtaaccaggccagaaattcagaaacatgtacacattataagtttacgcagtggactttatccatttcattttcagattctatgcaccattattctccattggaagtcagtatgttctttagttagaaatcttgacgttttcattttcgcattgattgacatgatgcagcgcataccgagcattatacatcctcaactgggcctaccgctacttcactgagccacactatgtgcattggataagtatgtcata

SEQ ID NO: 78293 - DNA, 4082 bp, Oryza sativa
ttcattgtagcaaaaaaaatcataatcatataaaattaaatttaaatgaatatccaatgatattatttttaacaactaaaatttaatttataataaaatacagctttgaaagaaggcaccacgttcgctgtggaggctagaaattcccacattaatcggagaaaaagaaaaaaacgaaaaggagagtccaagtagaaatacaatctaaaaatagctgaaattcagaattaaaaataagcaatactgaaagaagtttctatataagaacccaatacaaaattaatcaaaattcaaaataaaaataaaataaaatccaaaattagaaagaaaaaaagagacccaagtagaaattttttttaaaatagctgaaattcgaaattaaaaataagtaatattgaaagaagtttccatataagaacccaatacaagattaatcaaaattcaaaataaaactaaaataaaataaaaattagaaaataaaaggatagtccaagtaggaatacaattttaaaatagctgaaaatcggaattaaaataaggaatattaaaaaaagagtccatataagaacccaattacgagattaattaaatttgggaataaaaaaataaaatccgaaattagcaaaaaaaagaagagttcaagtaggaatacaatttaaaattagctgaaatttggaattaaaaataaacaatattaaaataaaaatccatataataacccaatacgagattaattaaaattcagaataaaaaataaaataatattcaaatttagaaaaattaaaagagagttcaagtaggaatacaattttgaaacaactgaaattgaaaataaaaaattaaaataaaaatactaaaagaacacaatacgataataattaaaatttgaaaaaaataaattctgaaattagaaaaagaaaaataagattttaattgaatacaatttataaataactaaaatttgtgataaaaataaagactattgaaagaaagaccatctaaaacacatgacgagataaattaagtaacaggcctataaaggagtagagtggtggcggttgatacgacatataaaaactattaataaaacaccaaatagaatcctaatgacgattaaaaggagggacgataggcaggccatgaagcaaatgagcaatgcgattgccgggactactagaaagtaaaaaaaaaccccattgataatcatattcaatttttaaaatctcaatgacaataaaaaggagaagcagtgggcggggtgtatagtagtatagtttcagagccgctgatgtttgacgtgacttctagaaaataaaaaatgaattccaacgatagttatgctcaatttttagaatcacaatgataataaagaaagagtaggcggcggacgggccataaaggagcatagtggcatcgtttgacgagacttctaaaaaaatataaaaaatgaaacccaacaagacaataaactctaaaaactataaggttcaatttttaaaggttccgaacttcgaaaaagtaaaaaaaaacaatgataatcatgttcgattttaaaatctcaatgaaaataaagaagggacgcagcgagcgagccgtagagaagtacaatggcaaagccgttgacggtttggcgggatttctagaaagtaaaaatgaaccaaaacgataattatgttcgatttttaaaatctcaatgacataaagaaaagagacagtggacgggccatagaggaatataatggcaacgtttgacgggacgtctagaaattataaaaacgaaacccaacgtgacaataaactctaaaaactataagatccaatttttaaaggtttcaaggagaatgaatagaaatagtggtagatcgagcaagcaaataaagaaggagatgtcataaggggtagcaactggtgtgacttttaaaatatatataattagaaacacggggatgataaggtttaatctttcaaactcttaagacatgagatagctatttaataaattttaagtaaaatcatactaaaaaaatatatgattttatttgggtgctagccgcgcaattgcgcgggccacccagctagtttaaatgatgggaagaaaattacgattagttaataagagaaagtggctgaagataataacttaaataatttgtgattgtttgagaggatgtggtaagtagagaaatagttctattttaggacaagacaccgataaaaaaatagctatatactacctctatttcaaaataattataattatatttctatgtttagattgtgtttgagacttgaacaaagagaagaaaagatcattgctttttgtgttcacgcttcacaaattattaaatggtgtattttttgaaaaaaaaattctatggaaaatttgctttaaaaatcatatttatccttttcaagttaaaaaataatcaatacttaatttattacttcgttcgtttcaggttataagactttctagcattgtccatattcatatagatattaatgaatctagacacacatatatgtctagaatcattaacatatatatgaatgtgggcaatgctagaaagtcttgtaacctaaaacggaggtactatgtactaatagcttatctagttttgcatatcttcttaatcttctttattcctcatttctcaaacatagctgtggagaaatgctatgggaaaaaaatgatgtatagccaaaaatgagagggtggttgaggataaaattgaaaaaaaaataaataagaaatgattgatggaacaattactactttattatgataactttttaaaagataataaccgtttattatgacggaggtagtaaaaaatttaggatgaatgtagcaccgcagtttgcaatcgccaaaaaacgagcgtgatcaaactgtggggctttgcttatgtcagggcgctttgtttatcaactaagcgtgattagggtggacctgtattttgggattctttgaagcgatgcgatgcgatcaggtggtgtagtgtcaactcaaggcccatcacgatatgcaaaatgtgattttattagtataaccagtagctaagctatcaatgtccgttcagagattctagcatgggcttttattaggttacgcttggatgtcagagttgaattgggttggtgtggacatggaggtccaatcagggttgtggaaaaccacgaaattttgaggtttcgatgtggaacggaagtagattttgagtgaaattttaaatagtttttgagaatttaaattgaaacagtaaaagttttgactaaaatttaatgaaagtttgttaaaaaaatgtcataccactagtgccgtgtttagttgttttggcaaaaaaaaatgacgtatacggacacacatttgaagtattaaacatagactaataacaaaacgaattgtagattccgcctgtaaactgcgagacgaatctattaagcctaattaatacatcattagcaaatgtttactgtagcaccacattgtcaaatcatagcataattaggctcaaaagattcgtctcgcaatttcaatgcaaaccgtgcaattggtttttttcgtccacatttaatgctccatgcatgtgtccaaatatttaatgtgatggaaaaattggaagtttgaaggaaactaaacacagcttaggttgggttccggcactcattaaaaagatgaaccctaggtctaattcaataacaattataattggtacaatatttggctcgaattcaaatttaataagatgaaaatattgtttttgatgaaaaaagttactactagatcgctagcaaattccaacaatattacttaccaaattttgctgtactctatctctaaggaaaagaataacttataagggcgaatctagacaattgttcatattcgcacatagaagttgtttctttaattgtacaagtatatgatttcacatatatgatttccgggagtttctccacatctattaacatcttccacaagctaatgttccaaactcatcgcgttgtgcctttttcccttttctccatatgtatatcatgaattgacaattattttctggaagcataataattaagaa

SEQ ID NO: 78294 - DNA, 12770 bp, Oryza sativa
attgacaactcaactaatgattgtaacttttggtgttgtatcatctgaaatgtgggtggcttggcatgtccaaccagaaaaaacaaagatcaggaaaaaaattgttttcatacagttctgagaggtgtgacaatagaacagtgcagtagcatatgttgaaattgtggtgtgctccattatgaggaaaccgcagatgtctatgttgtacatttgaaaatcttgtagacgatacactgtaaattaaagagataattgcccattgcactatggagatgaatattactctgggtgatcagttgtttgtcaagagaaccttgaaacttttaagacagtatatgtgactctttctacagcattgccatgagctgctattgttaaactctttgtcatcattttgatcagcctaaaatttaaatcgtaaaatccaagactttctagagcaatgtgatgtgcatgtttagtttgaagagatcctatagtgacagttcacaaaaatcatatatgcaattgttggagctgtgacttgtaagtagcatccaattttgaaatgttgtttgaataaattcaggactttgttttttgtcacttctgccactttaactttagcttttggaccactaacaaaagaagtataaaagtattttacctttgaaattgctttcgttgtttatgtccagggttgacaaatatgatagtaaatcacttaattattgtggttataggacatagagttggcatgaatttcgaaaccgttcgaggccaaatttattcaaattaaaatccaaatatttggcaaaaattgtttgaattttaccatagccgaacggtaatagttgtaaccaataaaactgctcgggagcgttgttccgtgagtgaacgattttgtgatccttgctttggtcatgtatgatgtatctctggcttatgcgccattaagaaaaaaaacttccaagcaagtttaataatataaccaattactagcttcaaaaaattgaaacattatctatagccacctaatatcccactcatataatagtcagttatagatatatattgcatcattaaaaccaaatccactcatttctcacaaactttattagaggtcgtgctatagctggctacaaatctataatctattttttcttctctttgctctccgctcttctccacataagaacatatgtgatgtattaacttgtgcagcccacttacaccacaaaagaacaaatgtcaacttgtacaacatgcttatatcgccttattgtactcgctataatgagttgtctttagtagttcgtatgaatccaagtcagcatgaactccctaccacaaatatacaaaatagcagcttcataaaagacaaaactacaaaaaatccagcatgtacctttttttttacagccaccaagaaaagatgaacctacccgactctctcaattaacgcatgacccatcaaccaaaacaagggttaagccgaaggagaagggcgtcgctgccccctccccccttcctccaacatgcaacttactactacgtgctattaatatctaacctatctaatcatcaattatgtaaaagaaaatgggtctaacaatatactccctccgtttcatattatattataagtcgtttgacttttttctagtcaaaatttattaagtttgaccaagtttatagaaaaattaagtaacatataaaatatcaaattagtttaattaaatctaccattgaaatattttgataatatatttgttttgtattgaaatactattatattttttagaaacttggtcaaacttgaagaagtttgactagaaaaaaattgtcaaacgaattataatatgaaacggagggagacatcactatgtggctaatatttcaatttcaaatctctgaaatactagcacttgtaatttctttgttcattttgtctttttttgtctatttatttgtctatttatctagatttttagctcagatgattttatcatcgtttataatttatttgctcattgcttataaagctgaattgaaataaataaatatgttacaaattatagctacatgataagcctatatattatattatcattttttatgttgatatgatatattacctatgaaaaatcttaaaatttgtgtatatttttatactactttttttattgtaatcacttattaagttgaaccccctcatactgagatcctggcttcaccattgaacctaaacacatcatttaatttcatatcaacccatcgtccaatgaaacctaattcttggcctcattggattaactccatccatcctgtcccaagttagtactacttaccaccctttatcagttgtgagaaacctcaatggtcacggtttcccttctcaataaaatcatatatgcaattttgtttgagcaaagttttgttgttcgtgtctaggattaacaaatatgatagtaaatcacttaattattgtggttatatggcttaggctgtgttcgggaggaggtgttgggaacttctctccttggcacggaaaacgagatagccgattagctcctgattaattaagtattagctaaaaattgaaaaatagattaatatgatattttaaagcaactttcctatagatattcttttgttaaaaaacatattgtttaatagttcaagaagcgtgcatgtgtaaaacaagagagtaaaagatgagaacttgtagttctgaagacagccttggagttggtagaaacagttacataaaagtttattcaaatcaaaattaaaatctttagcataatatgattgaatcttatcatgatcaaacggtaataattattttccaaaataatgctcaagagtgttgtcacatgaccgattggttttatacacatgtcttttgcttatgtgacattaaaagaaatgagttgcctttagtagcatcgtaccaatccaagtcaggatgaactccgtaccacaaagtgacaaaaatagcagctccatataaaaaaaaaggcaacaaatcggtgggtactctttcggacagccacccataaaagatgatcttattcttattactccactatctcaattaacgtgtgacccatcaacccgaccgcatcgcataaactcatatcaatatccactccctagttctcggccttatcagattaactccaaacatatccatcgatcaatccatcctcctccaagtttagcatagtatttaccactgcccccacaccccctccatccatagcatcaaaatccaaccctagccagtcacaccccttccaaaacaagaaataaacacaccccaaacacgcagttgacaaaatcaacactccctccaacaagagattcaataatttaacactcatttaaaatgataatcgattattcaacatcctagcccgctttcattcacctaaatggtcccacgtatcatcgtcacaagcgccaattaaagcaaaattgaccacgaaaaaaatgtgtcaaatttctcatctgtgtcacccaaggccgtgtgaaaaatctcggattgggttatttaagggctaagttctctatttgataggctaagtttctaatttaaaaaggttacatatatccggttagatataaagaccggataaaaatacccttctctaaaaaaagcctaggtgaaaaatggtgtgggttaagctggaccttcgccagtttggcaccatggctgtggctgggctgggattggaatttggaaaggccatcaaggccttccttactttaaaaaaaaaaacgtgtagagagagaaaatcagacggatgagggggagagagggagagagagagtagcggtttgagcacgcggcggcacggagacccacgagagagagagagagagaaggtggcaacggccctctcgcccggaaaccagcccacccacaccaacacactcacactgccctgccctatcgcaatttccatttccatctctcctcctctcctcctccacctcgtcctacaaatgcggcgcaggacgagagtcagagcggagtagtagcagacgaacacgacgacatcggagcgctcttgtctcctcctcgtttcttctgctcccgagtcaagcagatcctccaagcccagcgagggggcgggcgcgccgccgctgccgttgttgttgtcggccgcagcgcagacatggacccgtccggcggcggcggcggagtcggagtcggaggcatcggcggcggtgaacaaatgtgggtgcggggtttacgtcttcgggggttgctttgcggggctggtttggtttggtcgtcgagacggcggccatggggaggggggggaactggaatccgcgagtgtttatcgcctccttttgggggatggagaagtcttgtggttgtggcgatttggtgtttagagttttggtagatttggggggggggggggtgatcgcctgatcgggtctgggtgattcgtgtatgttagtgtgtgtgtgtttcttttttttaattttaatatcacttgctgaatatgttattcgtatgacgatttagttgctcttgttggaaatggcttaaaaaccgtgggtatttaggttgatgcggctgggaaatgctaggatactaggaggaggaggacatgactgtccttagatttgtgtgttagattggaaatgtttcacttcaatttttgggctcaaggggtttgggaataaatggacacatactgtctttgcaatgccgtgtcggtgataatcaattccggtttaggagtctgccgtagcacgaagtgataacatttattatgatctatgtagaaactataaggaagaactcattatgattcaagctgtatcctgtttcgactgtccgcggaactgattactgtctaaaaatggcacgctatttcgccgtgttactttgattgcatgtctgatcttgtaatgcttactgcagtctttgggactggcaagcggcggagcagtgcgagagcaatgctgcaaatcatggtacatcactcaaaatccataaatcataatagcatctttacacagattcggagcatctgtttcgagtttccacttactatttgattgtttctttttacattagatgtttctagattcatgtgggactgcctcaatcaagatgatgatgacctactgggattgctgggcaatcaaactcctctaagagattgtcgcggcttctttgatattgatggtaggtagtttcttgttcttaccaccatcaattgttattcctctggaatgtttgcttaaatggagatgttactcgagtcagatttcacctgcaaggagacgttggacctagaggaatctcgggaatcaaagcgccgccgcatattggagtacccttctgagtctaatcaatcagaagatggaaatcgtgaaataagttctaccttgggcacatctgaggtaattcactagcacctagatatcttccaagttagtgcattgtgctcttgtttacacttcttacttcttttcctgatccatgtcttaggtatcagaaatttcattgctttgcaccgatgaaccgcagagcttcaattgggattcacagaacaattcaaataattttggtttgtcttttgtttttcatattatattgtttgacaacttaaattgctatgccttttttgttagctaactgaaaatagtggcatctgatacaatagattctttgtcaactggagcattctaccaaccatcaaatagtcattcgaaaaattgctctgatgaaaatcaaatgcatttcaggcatgaccaaatgttagctactctctgttcccacagaaaacagtatttactttatcattatatttcaatgatgacatgttaagcttggattcatttttaggcattctagccaggagagcgttacatataccaatgatcaaagtggtatttcaggtcagtgcaaagtgtacgtctacagcgttgtttaagtcaaattttcatttgtttttaaaacatggcttgtaatctatgcatgagcatcccatctcatcactgtttgtccttacgtccccatgcgagatatctgtagagaacatttttgtttgctgttttccttcgatgcaatgccatgttttcagtcactgcaaaattctatactgattgacggacatacagtttgagtgcctcgctgaaactaagattttgtagttttggcaggaaacttaccagttctttctatctataacaggaacaactgagaatgattcagtgacagaaagtcttctaatgcaggagactaggaagctttctacacttaaagtatctaaaggtattttcagtttgacagtatcttatcatgtcatcaacatttcttactttgagttttgtctatgctgatcatttgtctctgctgctatactaggaacctcactggttaaggcgaagcagaatttaactacaactatagcatacccttttaccctcatcaaaccatcctgggaggaaggagatgtcatcactctaaaggatataaatcagcgaatccgtgctcctccgaagaaggctccagaaaccctagggacttcagccttctctggcaagccagtcattggcaagacaaggatcagaactgacgggggcagaggcagcatcacgatactaagaacaaaaggttgagagtccaaacaacaagtttctcagccattacctggattgctttcagcaatttgatctccacagctctccagtttttttttttttggccatggatttggtatttaggatgactatcaatggctaactcttcaaagatttaccattcatcctgtgtacattagcggcatgcggctaatgttaaatatatgagagttttgtgttcagaaaccatgtccctctactcatctaacttatgttggatgttgttcagggttttctcccatttttctgaatagttgtccattctcaaatggacgcgtgtaatcgggaaacatttgattattttgttgcttacaatatatagcacagatacaggtgagtttatatacgattgcatccagtactgcattttgtatacatcctggtaacaagaagaatatgagatatccgaattcctactattgtatcagattcctctcattccttgacgcagcggtcaatcggatggaacatgaaacacatcttaaattttgatctcctgtagcggcactatgatccaagtgaaattcttggcacagaagctagtagttgatgattgtcatcatctcttactcggatagagaacccagtagttgatgattgtcatctcttactcggatagagaaccaggagttttcgtgaaggtgtcgacattctaggatagagagggcagaagaactcgaacatcggcctctcctctataaattattaagtaaataccgatcttgaattgagttctgatggataggttgcaatggcgaaataacaatagataatacttgctatctcttgcaagatcatgagtctatgatcatgtcatcgtttataaatgacgctagttttatcgaacacgcaagaaaaaaaggtttaaacataagatccccactactgtggtgccaaaaaaaaaagaaaggagaaaaccataagaatactcaagattaaagaggacgcgaccacagacaccaaaacaactctagccacccgctacctctagctaagccaagcccctaactcttgctatatactaaaaaaaaccctttctctgaaatccaactacacgcaaggagaggattcgttaaacacacaatttttttgtgtatgcttccaaagtaatgagaaaattcaggccatgcttgagcacctttggaataatagaattgacctttatccaccatttacaaaaataactatcctttggtcgtgatggaagatctgcacaaccataacggctaaagaggagataccaaacttgtcatgagaagacaacctatcaaaatttgctgaatggccttctcctcttgatcacacatcgaccctatttgcgagatttgatagtgtggcatccttttggaccgaaaattgataagtagacttattaggaggttgatttctaattcaatataaattgaaggatatataatcgaacttcacacattttatttttataagtcattgtattttttaaaacaatatttcagattaatcatacaattagtgtttttaaaaaataaattccagtataaatgaaaccatataatataattagtttagaaaaatcataaattctagtataaatgaaatgatacaagcaaaatataataattaacaaataactatttttctcacaataactaatttcctacaccatatacaacgttttctctttttttatcatcacaaattgttttcttccttttttttacaccaattgttttttttctagtagatggcaatccggtgctccttgtctgaactctctcaatctcaacttctcaagtggcaactcttaacccccttcaggtgtcaaaaaaaaaaaaaaaacctctcaagtctcaaccccttcaatcccagccgccaattttaggatccaacggctcctagatagcgtacggcaccacccgtaaaccgtgaacaaacccagcccgggacacaatctgcgccgcacatcaaaatcgggctcgagtcgacacacgagcgaatctgacctaaaccctagctcgcctcctcctcctcctcctcgccgccgccgccgccgccgtcgccgtcgagcaccacccgagcagccatggcgaatcgtaagcgagacgaagaaccgccctaccctctccctctcttgtgtcctgctccgcttccgactctgggggcgaatgggtggtttgtttaattggttcggtttggtttggtttgcagcggcagcagcagcagggccgtcggggggagcgaggtcgttcctgcaggccgtgtcgaccgtcaccgaggaggcgccgtcgccgctccgcgtcgtgcagatggagggcctggtgattatttttcttctcccctcccgttttgtcccttggtagaattcgaagcgcgtccgctatgctagcatgtttgttttgggcgacttgcgcttgggatgaagtaaggataagctcttgatttcgggaggatctgtttgtgtgatgaaacgcccgcagtgtgcgatttctcttcacccaaatgtgttgtttagctctttagatcgaggtaattacatgctttgccgtgtaattagatcggggtcctttggctctggaactggagggatttggtgaggttattacgaatatagttgtcccttttacaatgttttcttctacacatgatttgaaagtgatcggaagacttcctatcttaattaattacattgaatgacctccttcggtcattccggcaaaaaagaaagtgatcatctgcattgtgattgttgagaagaagtgtaggagaaactagggagagcagagggtgggagaaaattcttgcttgattcgcagcgcaataggagcctccaagagtgctctagtggagcacaaccatattgcacgacacacatgttgcttttagtcatgtacttatgttgaccatactctactagatcaaatttgctgcacctttacattggatgattttctgagggccagccgcatttttcttttgccctgtgtttgaataggcatgtttaggtatagtactcttatatttccactcacaaatttctctctctctctctctcaatcatgcaggctgtcctgaagatcattaagcactgtgaggagtttgcacctgctctagttacaggccaactgcttggtttggatgttggcagtgttctggaagtaacgaactgttttcctttcccagtgagtatttaacatctataacatatttcttttaatatgacttgagtattcttgtggttgtttagtttatagattaacagctactttaatatttgaccacagatgagagaagatgatgaagaggcagatgcagatggtgcaaattatcagcttgagatgatgaggtgcttgagggaggttaatgttgacaataacactgttggatggtatgataagacatttcattcaatacctattgctgttgttccatatgataattaacctctgccgcgtgcttctgcgagcagcctttgagtttacacgtgttacaactctgtttttgtagtctttgatcctctgcctttaatttatatgtgcataaatagttcattcgtatttctttgttctgaccgtttgttcattattatatttttggaatgttgctaacatctttggctgtagttaataatgcaggcaaactaaattgagatatgctcatttgtcaacatagtttagtgatgctgttgagtatgtgacactgaaaagtgagaacaaaataaatgtggaattttgcctctatgcatacatgtatagaaatgttgtttgtgtcatgtattcaccttgtctctgtttaaaatcaatggtgctctgcttgtttgcttggactgattattttatctaatcctcttttggaaacacttcatgagagtgttaaatttcttattgcatgaagcaaccaaacatcatcaagcttctggtagcaacctttagttatcgtgtatgtggttaacattgaccttaaagtggctggttttgtgcttactcgatgtattttccagtcttttgcagttgcattaacgacatattaacctgtgttgcattctagctgtttcatgcctcgttcaaaatatttgctatatttttaactccaataatgactaattatccaacgtatttcatcttgagcttaagtgatgtgtcctattatttgtattatttatgttgtggttttaagttttaacctccattcttgttgtacttgtttaacagattttgcacatacaactatcataatcatccaacaaagctgtagcctgttctgcttcatgttttgacccttttttttcccatgcctgtgtacaggtatcaatcttgcttgcttggatcttttcagactgtggaactgattgaaacgtttatgaactatcaggtatgcaaaaataaataaggtgcaattgatcaatctttccattgctgttgggttatcctctcccagctttgttgacctactgcagtaatagttttaggccaacttgcgcattaattagctcaaaatagctagcacagcatgaacaaacaaataggacagcaaacagtgcacctaattagcttctctaattagcatgtaacctattttgacacgaatcaaggttaagtctctgtatgcattacaatatctaacctgtttgtacatccaatgtagtatacgcagcagtacatgcatatcatatatcaaatatctatgagttggtcataagagttgcgtaattttctgcgatgttgcatgcagaacataacatttgcatgttacaggagaatatccggagatgtgtgtgcatcgtttatgacccatctaggtcaaatcagggggttctagctctcaaggccttgaaactcacagattcattcatggatctttaccgtaacaatggtttaactggagagaagtacggtttcttttatgtaacccagtccttctaatagtttttaaagattgcatatgcaaatgactacatgtttttacaggttaagagagaagaaattgtcatgggttgatatttttgaggagataccggtatgtacttagttatctttcatgtcaatatgtacaatttttgtgtcctgatgtatcctgtcttattgtctcatagattaaagtttccaactctgcacttgtcagtgccttcatgacggagctggaacctgaatcacctgtttcacaggtttagagttaacttgtgaattttttttatgtggcatctgttgtcatcatcctttagcagctacctaggatttatatttatcttcttgttacagtgtgattttgaccgccttaaattgtcaactgctccattcatggaaaggaacttggaatttctgattggctgcatggatgatctttcatcagagcagaacaaggttattttttgaaatgaacttttgcataaactatctgatgttactgtgacaaatatattttatatgactgggtgttgtccttctggtgtagttccaatattactatcgcaatgtctcaagacagcagtcacagcagcaggcatggctccaaaagagaaggtcaaaacaactgcttgtccattgtgatattgatcagttcattagctcttggaatgtgccaactttttaaacaagcgcactcttcctctcggaaataagcaaagcaggtgctgctatgaatatggcaatttacgtctcatattttttttgctactgacatgctgcaggcaagagaatatggcaagaaaagctgctggagaggagccattgccagaagaagacccatccaatcccattttcaagccgattcctgagccgtcacgtttggagggttatcttgtaaccaatcagatctccagttactgcaaccatattaatgggtatggattctcgcaagtttatgcctattctctaggagttccataatgcctgtgtcttttcgtcaggaatgaaccattagatgtagaaattttactgtgattattatggtcgtacagatgcatgtctcatgattgaactagtaacatgcaaaagtattaaatatacaatgttgttagcatgtagtggtgtagtctgatacacaaaatgttcctttttgaatgatccatttaattatggcaatggttacggtgaagtaaatatggcaaaatttctcttctggctcttgtttccgtcgta

SEQ ID NO: 78295 - DNA, 2394 bp, Oryza sativa
  unsure (1)..(2394): unsure at all n locations
tagtggnnttgttggcgctgtcgtgtgatggataatatcgcatatcgaacggatccaagaacacggagacaatggcgacctagatccccaaatcaatcgccatcaaatcagatccaatccgagaacgggtgggtacaggagcgaatacctcggcggcgaggtactcgaggacggcggcgaggtagacgggagcgccggcgccgacgcgctcggcgtacttgccggccttgaggaacctggcgatcctcccgacggggaactgcagcccggccttggagctcctcgacgtcgccttcttcgcggccccggcgccgatcgccttcccgcgtcccgccatcctataccccacccaccgacgagagaagaaaccggctgcgcgagcgagatcgacgcggcggcggaggcggaggaagcgcgcggcgaggcgaggggaggcggcggatgagacgatgttagtggtcgggggcgagagagagatatatatatagggttggttttgggtggtgggtgcgggtggctagccaatgggaggcgatcacgcggatcgtggacgtgggccgtcggatgcgatgggacggacggcggaggatgcgcgtcggggatttcggtggatccggaagcggcgggaagacgggcggagttttcggtttgggagggagggagggaggtgcgcgcgaagacggagacggcggatcggtgacgtggctctctggttttcgtgtcggacccactggtcgatctctcgtcgtggttcgagttttgtatgctgtggcaaattggcaaatagggagacagggagggacgtgaaggagagtatgcaacggcgcaaacgcgtagtagaaagcaatgagggagtagctattttcggcgtagatttattttttttcacgtaccgtttgtcttaaataagtacaactattatccatttaatttaataatttcatctatttttttcttttttcaacatattatataaccccatgctacagagtagtccaacaaggttgtataattcagtgtataaagtggagatacaaagtctagaggtgagactctcttgtcttattcaatccattcaccaagtgtacaaatgactggcccctcctctttttatataatgcattcgcaaatatgcaaggttcggtgatgggtccaattagtgtatttagactaggccttcatggactcccccttgacactcaccgtgtgatgtctatgccctattaaagcttcaaaaaaacccagtcggataaattggagaaatagtacatagcgtacgcatatactccctccgtactcgtaaaggaagtcgtttagtacaatgtttaagtcaaaccttaagaatataaatcatgaataactctcaagttattgagtttgaaaatgtaaaaattatatcgatagatttatcttgaaaaataccttcataaaagtatacatatatcacttttcaataaatatttttatagaaacaagaagtcaaagttgtgttctatacaccatgtcgctgtctaaaacgatttcctttacgagtacgaagggagtatgtcgcacgaattgcctcattaaaacccttaataagaaactagaggaaaacttgtcacaccctaaaaatcctaaatatataaattgttgtttaattggaattattagaatttattttaaaaagcctagaagagaagatctagttttaattaataaattccaatataaaatgaggccagataaaatttcattaaatactttgcttaattctataattcctagatttttctgggatttatttgagctaaggaagtatttttaataaatggaattgcatttcatgaataatttaaattgaaaaaggtttttaaaagtcttttggctttgggccgaaagtcggcccaaaacctctctctctccctcggcccagtcggcccaatccggcagcagncgnccgcgcgcgcgtncgnccgctgacaggtggggcccacctgtcagtcttcggcttcctcgcgccgntgncggcgnccgagccctatcgtcgcgccggcgtcatcttcttccaaattcggccacgcctttccggttccggtgaaatccatagaggggaaatgaatcttcggatctctacctttccctttttggaatcgtcggcttaaattggttggaaattcgtggaattcatcttcaatcggattcgtntctcttcccgaaccctagaaccttctttgncggnggcgggcaaccggggcctttcaacgctggcttctagccccttttaaaaggacccccaagcccgtggttaccggcgcaacccttggctttggctttttgtggccggttgaagcctaacatcgggtaaccttaaggcccccgttgccgcccaaatttccaccctggcgccgccgt

SEQ ID NO: 78296 - DNA, 2629 bp, Oryza sativa
  unsure (1)..(2629): unsure at all n locations
tttttttttttttttatacaggaagttctcttttttcaanagggggtggcacaccatatgtgtttaaatttttattaaaaatggttttgaatataattaaaagaatttgggttcatataaaggggtcctaaaaaaagtttattgaaagaaacaaaannnnnnnntnnnnnnnnnnnnnnnnnnnngaaaagagaagaaagtccttttgaattctttgttggggtgggccacggccccggtaattcataggttttttcccatcaaataaataccccaggggggaagccggtgtattggtccaaaaccccccgcgcgttattttttgacttccgcgagtttccggttgttttgttatccatgantttatagaaanatctgcaaaactattnnnccccaannnaaaannnaaaaannaaaannanaaannnntcaagtctaacatgttacttattatatgtaagtgaccgacaagagacttagatcttcatttaatattctaggctatgtgaagagaatagaaaagtatcatcccttacttctaataacactcactttagtntacattngctagtgtacagttttattgaccaatacccctanncagtgccctcctagggcttcgagagaccaccccgggttgccgagtttcttacgacaacctgtcatggccgtccaactggggctaaatacggagcagtaacctccccagaaaattgtcttaggaatatatattaacgtagaggaatgcccgtactgagctgtcaccatcagcatcccacttctactgtcccgcatcatatatgcccaattaatgatatataataatctaagcaccatgcttatattgtcaaatattactctgtatcctctagaataatatagagcaatcatttgcatgaacattaaacccacaccattgcacctctctggtaggctagtcacacaactatatcaacacaaatacaatgtaaaaccagtactcagataaagtaaagtaccaaaggtatataaagaagaatattctattaattctggaagtcttacaaaataagaaagaaaaactactagagtcataccgaaatcttctgaagactcgaggactccgagaactatcctattctattccacttagcactagagcactaaactaaacttgagatagagatcaaagcttcttgcttgagtgtgtgatggaatgaagaagtgacccctttatatagcctcccaatgacggttatggcagttgaaattgtcagaaatgccccgcaatagtcattgggagtgcatctgaagcgtccacgtggagggacgaactgaacggccactgtcagggttcggccgaacctgggccggcccagtagacctccagatttggtagaggggttgacaggtaagtcctcatggcgtttatgatagttatggcggtatctaggatggttgcacctgacatgtgggcccctttatccttgagcttgcttaggagtgagtttttcttcatttcttcttcatttatgtgctaatctctgcaaacaaataatactctaagtacaagtggaaataaattattctaaaataaatatgcattgcaagcatagctagttctcctttatttttagttatattgacgatcgaaactggtctataacgatcgtcaacaaatccgcccaagcttgaaactttgcttgtcccgagtaaatgactcggaaaaataaacttggttgttgatcaggagtttctaccatgatgtatatctcaaatgtacaagtgcaaagtttgagtactctctcttatattagtaagtaagcacggtggcttacccataagcccaatccccggggaacacatgccttttcgtcactgttgaccgtcgctatcgaacaattttggccgtcaatattactaaaataaggaaaactagtttttcctggcatgccgatttgtgttagaataaaaatattttccactagcactaggctttcaaaacttttgtagagaataaacataaaatggaggagaatcgacaataatttgacgatcattcaatcggacgttatcgagaatcaaacatatggatggatgggccaagaactcagaaatgacatgaccaactgagccaaaattcacgagtctcaagtgaggaacagaaaaggaggccatcgaccaaattgtgggccggttgggccacccctgggttcggccgaacctacccagccgtagcgccaatcgattcaggttttgactagacggctcagatggactccctatgacggttggagggtattatcgacctttccaaccgtcataactcagctataaaaggcattcacctcacttcctccaacacacacctcaagcaagaagaatcaagctctctctctagtttactagtgttctaaagttagtgcagtaggaatagaataagagtcttagtcctagaagtcttcggaaggattcaggtatggttctagtagctctactctcttttgtaagacttgtactttttccggnngctgntacaagtgtcagcctnnnnnnnnggggggnnatttaaattccttaatgttgaatgcaaaaatgaagaggataagggattccttcttaatattacacatccctcttacgttccata

SEQ ID NO: 78297 - DNA, 1178 bp, Oryza sativa
gcgccacgcgtgtgggttaggtgagcacagcggggctcacctacccgcatttatagcgggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcaacgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctaggaaaaaagaaagaggagagaagaaaggaggggagttgggactctggcaaagggtttctagagcctgaacttctttcgctctcggcctctctgtattccttcacacacagatccaccagaacacaggagtagggtgttacgcttctcagcggcccgaacctgtctacgtcgcccgtgtcttgcgcatttcctctctcgctgacgttcctcagatcgagggcgaagaatctcacttagcgcccccggccgaatcggcaaaggggggcctgcgcggtctcccggtgaggagcctcacgctccgtcagcatactataacactgatagatatattataataccaacgaatcgatttttttaaccgccactagcttgtatggtgtacagtacacgcatgtaatcttctactctcctcgataaggggagagaccgagagaggttttcgctggaattatcgtcccccgtttcactttgtgcagttctgcgagcataacagagtttttgttaactcggtgaagtttccaacgaatctgagctttcgttatgcaggacttgacttggacatctttatttacaattccatgaaaatatcgaatttttttcgtttttagattttttttttaatatttacagaaataatctatcgaccaaa

SEQ ID NO: 78298 - DNA, 2584 bp, Oryza sativa
  unsure (1)..(2584): unsure at all n locations
aaaaatagagagagaggggggggcgccaaataataaaaagggtccccccttggggtggggggggggggcacggggggggnnncnccccggngnccccncnnngtggtctttcagatgaataggtatgttttctccaccaacaaggtgtttttttttttttnnnnnnnntngttggggggngagaagagaaaagaaaaaaagatgaggggagaagntgtttgccggccccattcaaaaaaagggggatctattttttttttttnttagagcacccaaaaaaaaaatatttttcaaaaccggggtgcttctctttagagagggtgtctcatagtgttgtgaaaaaagagtgtgaacaccacaagagagacaagggggggttttattcaacaaaattttcttatttttttagggacaagggaatttgtcaaaaaagcgtgggttaagatattaaatccttagtggcaaaataaagggacaataaagtggattacttatgttncatccagtccgcattccttncgttaataaaaattctaagcaattttctgggagggtactggtcngtatttagcnccagttgacggccatgacgaggtgtcgtaanaactcgcaaaccgggttgtctctcgagccctagnaggcactgtaggggtatggtcaataacttgtcacagcaaatgtaactaagttgagtgtatatagaagtaaggaatgattatnttctatttctctttcacatagcnntaganttattaaatgaaagaatctaagtccttctgcttcgtgtcactctaccatataattaaagtaacccatgtttagactttgatatatatatatatatatatatatatatatatatatatatatatatatgtaatatatataagttattagcagatttctctttcttataaatcttccattgggattaaacaaatacgataccttggaatacttccgggtgaaatgctacaatagtatatccgtgcgcttgcggattacttctgtaaccataaatataccagggccatttccacaccattgctgggaattcatatttctagtaatgtcgttaagaaataccaatagctgtcagtctgaccgtcggtgtcccgccggttggaccgccgaacccgagcaaacacaaatcgaagatctctctcaaaatagattgaaactttattacttctctccgtgtttacaaagtgcaacaacaacactcttcacgaaaatctcgactacactcgaaaccctaacttttctctcaactcaactctctcaaaaacgataccaagaggacacaccctccctctctttatatacctgagataggtagcctaaagccacgaaccaaccttgtactagaagtcctaatcccatagaaaaccttcccgtataagaaataaactttacatactccaattataccaaatttggactattttcaaattcgactccacatcccatacgcacacaatatctccatcgtatgccatatggaatcttcaccaaccacgtgcattgatctttagtctaagcatcctgcatgatatcctgatcgtccggacgtcatcttctcccaagttgactcccgatccatcaccggcaacactcacccgaggcatcaaaaccacctatacatgcatcaaccaagaaaccatattcgagcacaagttctcaccaacctgactcattgttagcaaacaacagtattgcatattcatagtacccatctagaagtgataaacatgaattatccacggatatccagcgaaacaatccgaaaccgaaaccgacacagagttggctggtcagaccgtgggctggccggtctgactgcacgcatagctccgatctgaccggtccaaacagtcagcagcagttcctgttcatcacctacaaatcaatcatctccaaaaccacttcgctaataatcttcaaatatcaaaaccaataatatcaaatgccaattggtcatttaaaataaggaccgacacacttttgttttacagcattgattacatgctaatccccaactaggacatttcaccagttaggcttgccagaagtcattccttcgcctatgctatagtccctatgcacttaccgttaggtgttgcctctttatttaatcgnagtgcttatgatatgangtccgaatataantctattctaaacattatgaaaactacaagtnctgctcatcgactacattcacatattcatctcannactcaacatgtnntcttnctacatctcatggnaataggtctncgagggcatgcatttcagaagtaaaagctcntcaaactgatgtgnccatggatccaaccacgaaagctatcttgtacaantgacatcatggacacttgtataagcanggnncaaactangtnngaagggggaaggtcccanaaccanttaggaaatttttagcttccattcattagttnacattagtgtcaccgtccccttnaattaaaattggaaaatggtcggggctttttattgagatgaaaattaccgcggcacttgcgcattaaaagcgggggtggactcagttattccccccgttttttgg

SEQ ID NO: 78299 - DNA, 1259 bp, Oryza sativa
tggtttcttctttttatttttctcatgtgtttttctatggatcaccgctgcagtgttatagccttataggtatgtgtaacttgaattgtgctatattatttgtcaataatagtgccattttgtggtaacacatgctgttataatgagttctgtggcctattggttatatatattgtaccgttccggattctcacttcgtgagattacctgatccttatacgaattatctgaatgattgcgctcatgcttacgttcttgccttttgtagctattgcatcgcaaagttttcatcttgtaccaagctggtgcctggttcatctattgggtttcataaaaaatttctggcagctagcaataataggaaataacacaaactgttttgagcaatagctccaatgggctctttggaacatatagtggttataatacacgaagtgctggttttcctacctactaatatacagttagattgcaatctgcaatattattttggtaatggatatatcctttgtttacagccattacatgtttcagtttttttactggtcttcactaagcaacttttgctgcttagttgtcacctgcatcagaaggcagagaataacttaactttacatgagataggtgagcccaattttattgaaacaatattttccacttgcaattttgtattcagattaactaaaggttgtccccaatattttctcttctcagtatagctttcagaggtgaaaagagaaaaaggagaaataaaaggaggtagcagatcactctgcatttcaagttgctgacctagcctaatcaacatgtcaaatgtcagacgtgtattgagtttgatgtactaaccactacaacttattgaataagtatgaattgggttttttaccattaacatttaactgctgcaatggataagtacaaatgaggatatttagtattaacatattactatcttttatagacacttgtatcagtctatctccattacaggtgtaacttctgttggtttgttgatatcacaaaaggtaaaagaaaaagtcgccttaactataagtctgtaactgtacaatatggcatatggttcaggtaatatatctgtaaagctttacaaaatatctccaaataccaatctaatttgttgtccagaatttaatcttactaaaggatatcttaatgactgataggagttaggactttatccaatttggtatgttttctggagctatataaatttagataattgcttatggaacaagttt

SEQ ID NO: 78300 - DNA, 3545 bp, Oryza sativa
  unsure (1)..(3545): unsure at all n locations
gaacccgattttttaataggagaataggggtaggagcggcgcgagacacacatctttttgttttttttccccnnnntttttnttttaaaaaaagaggtgtggtgttgttttatatatatagggggaaccaaaannnaagacgccaggggnnnnaacacccacaccccaaaaaatataataaaagtatgtgaagaaacaacccccttttagcccaaaatttttctttacaaataaattaggccacccccaccagctctcaaaaatagactctcgaggaaaaaaaaaacaagatgttttccacccccaaagagaggcgcctcaaccggcgatgaccgtaaaattcaccatacgttgcccttaataccttgacaaggagaggccacacatggtgggtcaacaggcccaaaaactttgagttcctgcacacacgatnaaaagcgttgtaactctgttccccacgtagttccgtgaaagataccttgccttcgtggttcacatgaaagccatgagaatcatgtagtcttctcaactcatatctcaatgcccaacttctgacaacgagtatggcatcaattcacagtggcacttcatcccacaagcatcttagagacggcntttccatcnatatgacntttgagatagagaggcttcatatgacggtntgattcatcgggcttctcaaaaactgcatctttaggacctagtgaaaagtgagcaccttcggcttcatccatagcaaaaattccataggcaacatacataccatgttgatatccatgtcttctttaggagatgactcatctttagcaaccaattgttcttccttcttctctacaacaaccggtttttccttctctatggttttacgcctccataccggtggtggtcgcaactcattgaaccttttatccctttgctcttcagcctttttctctcttatttcttgggcccgaagacgttgcaaccttctcctttgagtagccgttaaatccttaggtatccacctaggtgtcacgtcccaaaacgaccctaaaatatatcctttaaattatgcctagaataattaaaatccgtgcgaaagcctccaaaaattaaaatgtgcaaagtaaaagtcaaataaggcttagaggatttttgtatatttcctaaaagcctaaaatgtgtaaataaattttagtggaattttcagagaacaaataataattgttaagaaataaacaaagttaaaaaaggtttcataaaaagtctccttccctctcttgggccgaattcggcccatctccctcccccctctctctatcctctcccccgcggcccactcagcctctccccgcgcgcgcgccgctgacgggcgggcccgcctgccaccctcgctaacaggtggggcccacccatcatccccgtcctcccgccgctcttgccgccccgctcgcaccaagcgccgccgccgccgccgaatccgccgcatcccgctgtccccgcgtgcaattaagtggggggaattactccccgtgatcccctccccctttcccccccatttttccctctctttctcgcattcaaacggccggatttgctcccgcaaatctcgccggcgccattgatggcggccggacctcccggccgggttccttcctctcctggccgccctctcccccttccaaccctatttaaaccctctccgcacctccttcgcccgtttccaccctttgccgcgccgtctccccgccggaaacgagctcgcgccgtcgccctctctctcctccgtcgccgacgacctccggccggccctctccgcttgccgggactgtctcccgcctcggcgtcgccttctccggcttcgccgcaccgccgtcgaccccgtccaccccctcaccgagctcgccgaccgctggaacgccgccgaccccatcgacccgagccacgccgccgccttcctccgctccggccgcctttttcgtcgtcgccgtcgacctagggtgagccgtggaccgccgcctcttttcccccttcccttcccctctctcggccgccgcttcgccgtgcctatggccgccgccggcgaccatagggtcgcgggcgccgcctcccgccggctgcaccatcgtggccacctacgggcgcgccgtgtggccgccgcatggggcccagccgtcagccggtcgcgtcctcgtgtgtggctgacgcgtggggcccacggcgccggccggtgcgagccgggtgcgcccggtccaccgtggactgtgaggctgccgcgtgggcgccacccccccgtggacccggtccgcgcgccccctcccctcggctgacgcaataaatcttttttaaattaaaatttaaataaagaaattcgcaaatattcacttaaagagcatatatacttcaaatggccataacttggtcatttgaactcggaattggaccgttcaagtctctaatttttccttaagaagtcaagaaccatttttgtgctttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgaacatattgaatcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcgggcacattaggaccggtctttcggccttttgttgcaaagcaataccctactttcacaagtctaagtggttaagcttaatttgtgactcagcttgttataaacaaaaggtcccggttggagaatgacaaatccggggtccatggccattttaggccattgaagcttaccaacttgggtttggattccagaatcattggccagggcgtggtccggggtagggctcaaacggctgcctttcccagggtcccgccaaagggggttggccggccctttggtttgggaggaggggtgggaacattgattgtttccccctttcccgggggattggcactggttttttaagaaaaaatgtttgggggtaatccacttgtacaggttaaccttttcaaagccgccctttttggcgcccccaaggcccaaagggttgaatttaacaccggggaaaaaaatataagggggccggttgttttaaaaaagacccccccggtttatgggtataataaag

SEQ ID NO: 78301 - DNA, 1562 bp, Oryza sativa
tgggccggcccatcaagtgcagatttacgtctactttgaaaccccaaacaagctatcagcatccacacgactctgcttttttttttttctgaacaatcactttcttttccattgatcgtttataacctgtttaagaactgacttgtgaaatgttgtaacacacttctgcaggcagtgcgggaaggagttcaagccgcaggagctgcactcgcacatgcagtcgtgcagggtcttcagggagaagatgaggagcagcaccagctcccgggtcagcgtcgacaggggccggacctccgccgccgcgaggcccgaacaccggaggacgagaagcaagggcgccgccgccgccgccgccgcccccggcgacacctcggaccgaccgtccgccgtgctcctcctcagggactcatgatctgatgatcatttcgatcgaccttggagttcgtttgtgaattttgcagcacacgcttatatggcgtgcataatatttaacagcttatctaggatactgtacattgatctcctttgggtcaaaacttatagatcatgccatgatactgctcctaattgaatcctagctacgccaaatggttttttttcaggaatacgcaaaagaaaagaattgtgcacctttattatattaaaaggaataaaatttacatagacggcaaacaaagaagtaaggggggtcgaggagaaaaaggaagaaaaaaatgaaaacaagtacttaagcctattctcgcgtttacagtgtgacaaccaaacgaccaagcacgctaaccaagaagctttggtggtgagggatgggcaagccgccaaagggcggcctcttgtgccatgcctgcgacaacctcaggctaggatcggaaatagttgttaaacacacagttgttcctttctttccaaatggaccaagcgccaagggtcacaatcatgtcgaacccacgacgacgctccctcagaactttgaaccacctagtatggagcgctatccccatgagctctaggttgtggatgcccaacccctcatattccagtgcgcgcgcagatataggaccaagttagccggcaatggccaccttgtgcgcttgcacaaccacaccaaaggaagccgtgccggatctcgttgatggctttcagcacccatttcaaggggtggggggattacaatgagcagataaaaccaggatcgcgctcagcataactttgacaagcgctaggcgcccggctggatggatccaatcagatctccacagcggctatcgttgtgcaatcttgtcggccaaaggctgaaggtcctcgtggtgcggttttctgatggagagagacaaacccaaatacttgcacgataactcctcaactaaatacttgcacgataacgcctcaaccgggcagaggagagagtcaccgaggactgcgacctctttctccgagcagttgatcggaattgcggaacacttgacatagttggtacgaaggttagaggcctctccaaatagagtcaggatccctattactagggtgggcgttcggtctgaccgaaaaattcggtctcggtcttc

SEQ ID NO: 78302 - DNA, 766 bp, Oryza sativa
  unsure (1)..(766): unsure at all n locations
gtgtatgattgctaactggttgcacgcagcncgactntataagatcccccaccccgggagaggtggagaggggagagtaaataggaaagaggcggcctgacaagaatcagcgcgtggggatgaaaagtcgagaaaagcggggtggggattagattgaggaggaaggcgtggggtaccagcactgtggggtgggtgacctagagatgaatttttggccaaaatccttgttggaatgggctggaggcacgccaagcatgtcttgcactgctactggcctaataactgttgtcttggctggcgatgggatggcttcgaggggaaagaagtgggcatggtggcataggggcggcgacagtggcatgagctcggctcacactttccgcgaggacgcgtgactgcgggagctggagcacgaaaacgcgaggcggttcaccgagtgcatcggcgttggtgcggcacggacaatagggaaaaagacagggctagggcgaggtgtcgtgcggctacagtttgggcggcatcggagtggggccagcgtgatgatgccagccacatcagccaacatgagtggtgtactggaaggcgagaaagtcgttttttggggccggcaagtggaggtgtgtccgaattttctcgtggaccggtatcattaatgcaacacatctcgcacaggataataatttgtgtccctttaaaacgccaattggtgcgtttttcccccccctaaatttttctaaaaaaagtgggggatatttaaaatcttctt

SEQ ID NO: 78303 - DNA, 71247 bp, Oryza sativa
  unsure (1)..(71247): unsure at all n locations
catgcagcttgctaaactgacgcgtggtggacgagagtgaccggtctgtgactggtctgacagctgtcatgtcatcggcaaacaaccgtgcttccacgttgcacctgcttccgacggagtggaggttggtatgacccatcccatcggagggtcattcaaacagcaccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggcccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgatacctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgagnggncngctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctggtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaatcaggcgcgcatcgatcctacatgtggttcggtcgatacatatgacgagtcgcggtgcgcatgtccacggctatcggtaggccgttggattcggatatactactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttcctcttcatgtgtctaaggttcctgcgtttttcctgtatgctaaccaaacgacagtttgaagactttcctgtgtttcaaaatcccataggaatccaataagcgtggtattcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatctaaagctaaaaaaatactctttttgaaaaaaaatgataaatgagaagtagtaaaaaagataataggtgaggagtaaagcacggggtgagtatggagtatggagtagcagtaagccagtaacacaagtacccatcaaaccagaggcgtcgccaagataggtcaacgggtcggattctaactacagattagtgcatcatgacatgatagcctgaagacagaatttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcgcgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcggttcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaggaacagaaggtgattttctcaatgccaacctctatatatacagaggtgaactctagaaagggaagagactctctctcttttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcacctcccgcccacccccgcacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggtgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaagtattcccggccaatgatttttaagggaaaattttaattctcccattatttcacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaactcaaatgacaagtaattccaggaaacctgcttgacctgtcttttgtctgaactgcaaccgtccctgatgctgcttctcaaagctgaactattgacctggcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctatccaccttacagggagtagtcttactttcgcctgactgggaacaattagactattgtccttgaaaaataaccaacacttctcttgcttacaaggaccctcactttgaaaactgaaacttcaccgattcatcaaaatagagcaatgacgacgcactttcatcccagcaagatttggaacttaatcctcagttgctgatgggagattccacataaagaaattctcgtttagctcctgattggtacaactttcttgcttctgacttgatttttggtgtcataagcctaaacagattgcatagttaacattccttgaaacaagcactgatcacccaacagatccaactcaagaggtcctttccatggcatgacatttcacttctttgaccatcctttgctaactcttcctgggttaacagactatagatcctgtaatagcttttcgaaaaatactgcaatctgatcaactatcggaaactgactttgatgctgccgagagtttctgcactttgatcataacaacttcgctttcatatgttcggtaaagatggtttgttgaaaagagattctatgccatataccttgttgactacacatttctatttctggaccaaactctcgtatcttcctgactcatgtatggaacaatttctttttcaacttctgggaaacattgagagttttttttttctggaacttatagcggttgccttgaactatggaaaccattcttgtttcataatcacaccactagggtgtaattgccgcttaccattctctaacagtttccaaggatagagattccttgtatgatgttacttccgaatatatatttttttttccgttactccttacacttgaatacccttggtactgcctttggagagatttcatagtgtcgagcaccatggatccaaccattgtcactttcaaatattccatcactcttttcatttgagtaccactgatgctgcctttagaaagacctcatcatgtcgaggtgttgagggtctaaccattttcactccgttggttaaccattcctctattggctcgcaaacaggttttggagctcaacagaattgcgatgagttagaagagaaactcttggtttcttgagacaccgacagatacacattttgatttacttttgcatgctgaagatgaatcttaaaaggagaggaactggctgactcatattttattcaatatttccttttcattacatggctgccataaacatatacgtacaatgagaagtactacaaaatcaaacaattgtagactgctgctgattagaactgcccttttcacgactgaacttgaaaaatagaagtcttgtctagaattgctattgcttccattattcaaacctgactgacttgttcctttagttcctactaccagaagtctcaccgggaacgttgctctgcttgttgatcttcgatggtggaggggcaactgtcttgtcagctgtaacgggtaggatcttcttgcccgtggggttaccgagcggtgatttgtcgatgggcctccagattggagcaataccaggtgcattgctagaactgacaacagttggacgacctggtgctgacaacacttgccgcgggtgctgacgaaggagcgtaccacctctttgtagctgtagcgagctgttgttctcctggcattgcttaccctgctggcgttggtgctgtaggcttgaaacggttgccggtggaacaatgcgacctttgacggtgcccttgacgataatccgttgaggcggaggttgcacattcaggtgtcgattggtgtcatgggcaatgctggtaacttgtgaatcacgacgaactgcctttgctgctcttggaagaggacaatcactgaaacgatgtcctggcttacgacagttacggcagaatcgacttgcttggtcccgaggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactcttccactgtctgagtttgattagccatgacttggggttgaggctgatcttcaagaggctgacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccagtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggcgggcggcgggcggccggaggacagcggcgcgcacggggacggcgacgcaccccaagaggcggaggtcggcaagaaaggggaacgggaaaaaaaggaagggaggagaggtcctcaccgaaagcggcggccggcgcggaggaagatgacggcgacgacgattgcccgatggcggcttgcgaggacggagggcggacggggtcgcccttgaccttcagaaagagaagagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcggccacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggccatctgcgccgccgccgcctcgtccgccacgctctcgtccgcggcgctcggcgagtgtcccgccgcggacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaacctatacatgttgcaacaaaaataacaagttagactaaaaatagttattgcacattcgcaactatattttttttatctttgttacaacttataacagttgaatttaaacttgcatgtttgtgaagtgatatattttatattaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcagaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggctaagcttgtgctctctctcacggtacatacatattgaactggaaatttcggtctcttcatctggacgtcagttaagtatagttgacatatgaaatggtagtagtaatataaactacaatcctgtttattttattagtctactttgagcttgcaataaagtatgtggcgagcgatgcaatttttttcaaacgctcgtgtcagttgattttccaacttcactcccagaagagacgtcggacagtgactcccctgtgccataaaaactggacagcaacattgcgatgtcgaatgcatagtagaattcatagaaaaacaaggagtaggtccaaaggagaccggccttaattatgtgcctcaaaatctacagaaacatggtacatgtcaagtgatgtccatgtgcctatgaggatgtgtttagttcacgtcaaaattgaaagtttgattgaaattggaacgatgtgatggaaaagttaaaagtttgtatatgtagaaaagttttgatgtgatgtaaaagttgaaagttcaaagaaaaagttggacactaaaccatacctgaattctgaacatacagaaggtcaagtgatgctcagaaggagttaatttttcaccaacttgccgatcgatcgtctgatggtcaaggagagtgatctgtgcccttgaattgtagacctggagtcaactacagtgcctcaatttagaaatagtagagataatttaattcaatctccactcgcaattagaaacttctaacgactcgatctcaactgatctaagctcaaaggttaaatctgactgatctagcttctaaagttatatatgtgagatgctcctaatcgtacctaccagagtcaatgtccagttattttctttagcacaagtcaatgccccaatcataagacagaactgtgtcctagtttgctactatgattacgattccttgttttaagtatgtacgatccgtgtacatactccctccgtcctaaaaaaaaaagataaaccctgattttcatgtccaacatttgactgtcagtcttatttaaaaaaattatgaaaaaaattaaaaagacaagtcacgcataaaatatttatcatgttttatcatctaacaacaataaaaatacgaattataaaaaaaatttatataagacgaacagtcaaaattggacacggaaacccagggtttgccttttttttttggacggagggagtacaatacattattgattttggctgcagtagctcaagattcaagagtcaagatcatatggtgtagtgacctctaataagatagcctttttttttctttacgagacccacaccaatcaaaggactggtcctaccctaacatatttgggtgtattccggagagaacgttaagaacttctcccctcacacataaaactaggtgacttacatgattaactaagtattagcttaaatacttgaaaatggaatgatatgaatttttaaagcaacttttcaatagtttttatttttgcaaaaccatatcgtttagcactccggaaagcgtgagaacatgtagtataacacacccttaaaatatcaaatttgttcatccgctttcggagtgacttgctaagggcatgtacaaggtgagagagcatagcactagtttctttttaactcgtcgccgcataagggggtgctaagtgtctacagtggtggggaccgactgaaagtgaagtgtggcctgtaataagtgccaagtaaatatacaatgataagaaatcagaaaacaattttctctgaatgccaaatatatatttttaaacgaactataccaaacaatgagagttttatattaatataataggaaaaaagaatacaacactactatagcactagaataatcaggaaaacaaaaacaaaaaccaccactatactatacgctgacagcacctacacatcctgaagacctagcacataccgcaccaactgccgctaagtaggatcgagcaccgcggaaccaagacaaggaaccaccacttaactaccgaccaacacacctccaaccagttaaaacaactagaccatctggacaaagcgataaggactacagaaggaaagcgcaatagagaagaaagactcactcgtccctcgtacacacccgtcgccgtccaaaatgttggtagggtcctgccatcgtcaacctccacaagccacggtccctcgtaagggccttcatccctccaccaaacagctgaactcctcctgggggagcgagcaataaccacaaaagctgccacacttggtgactgatgtagccatattccttcatgtccctatagcactagtagaaccctaagatgcgccaccaccctccagccagtgatctccttctaccacgcacacgtcgtggtcatcgctgcattgcactggtatattgcacgatgtgctccccggtcttgtgcacgttgtcttgtgctgctaatgtgcacaagacatttaaatgggtgttgttgctttccaacttcagcagcaacccctgagatgggaccccaagtgcacatcagcggcataagaggggaaacaattttggagcttaggaaatgggcatagccccatttagcttccggtcttaaaatggggactatttattgaagatgctataaaggagacaaaaaaaataaatcatgagcacttcatttcctttttcagcacggggagcgtaagcaccttttgtcattttggatctaaacactagggtggaaaaatggcaactttgtatttggcatttggcagtctggactagcaaatttcgccaaaaagtgcatagggacacggaccacccctcacggacgcgcaatacccccactcgctctctctctcttccgtcgcaccctctctctctctcgcccccaaaaaaatccccatccgcttgctccgcctcctccgccgatctcccccgcggctccgcctctttctcccttgctccgcctcctccttcgccgatctcccccgccgcaggcgctcacgcccgctccgcctcagccgtcgctcacgctcgcttccgactcccttgctccgccgttgatttcgcccgccgcaccaggtcacggcagcctcgacctctgccgatctcccccgccgcaccagtccggggtggagatggacggcgacggatacggcgatggctccggcacaagggacttcatgtcgcagtccgattcacacgccgaccacgacgagctcgacccctacaccgactccctgtactacactggatcccgcagcggcagtgcctccaggataggcatggccgccctcgacctcaactccggcggggatgggtggccggatttggggagctacgagggtcttctttgatccggctcgcaaggaggcgtcatcagcggaggagggggccacctttggggcggcgcacatggacgcggcgtcggcggatctgggagccaccatcgctccgcctcgcaaggaggcggctctgctgatctccctcccgtgcgtgctgtgagtcggacactgggcttacgctcggcccgccctgctccatgtggccgaggcgccacggcagctcgcgccaattcctcaccgtatggaggtggccgttcggcgcccgcggccggagccaggggccgtggtggtggtcgaggcacgcaggcgaccggagccaggggccgtggtggtcgtcgatccacatccacggctgccaccgtctctgaagtcaacttggacgtcgactccgacaacgtcgaagatgccgccgagctccaagaaattttccaaaatcatgggaaggtatgccgaccaaccatttcatcttcgtggctgtgctgctgtgatgtcctgtgattccctttgcttcaattttaccatttccatttcataaacctgtgctgtgctgtggtgtagtacgatgtagttgtgtgctgttgtgtggtgccctttgcttcatctgtgaccatatcataaagatgtgctgtggtgtgattaggtgtgattagtttggagattttaggagttatgttgccttgtgatttatataaccgagcaaaaaatttgtgattcaaaagtttatataggtgtgatatgtttatgtcttgcactctgattcctgtgatccagaagctatgttgcattgtggtttatgtctcctggactgtgatatgtttaggtttaatatacttgtgctttgtgatttgctctattaagttgtcataactgaagatgtatttgtttcccttaaatcgtgttaaatattttttgcttaccgttatgggtgggtttaggttaaacctgacagggccaattggacagaggacaataccagcttgctgtgtgaaatttgggttgaccagatcaataagggaaactgcgtgaatggactcatgcagaagactgggatgagggagattatcgctgcttatcatgcagcaaccaacctgcggcatggtagatcccaaattactaataggattaggcaactgaagggattgtggcaattcattcaaaccctacgcacaaacactggattcaatagaatatgactactgtagtgttgtaatatttgtgttgtatggacttttaaaattgtgcactgggacttttaatatgtatgtggacattttaatgtttctatgctatggacttttaataattatttggacatttttttgttgatatgctacgtacaattttgcgagctattgatacatttgaactatctggaaatggtcatttgggaactgttgatacatctgtgcactgtcaaattgtggcttgtaccagtaagagatgaatctcttgttttcaacttagcagcagcagcatcatcatttgcactaccctcacggccgcagcgcgcatcagcaatagcggcagcaacgacaagcagcagcagcggcaagcaacaagcagtacaagcatgagagagagagagagctacatgttttgtggggggggggggggggggaagcaattaatatgggcaaatatgtctttatggaagaatggtaaaacttttgtatgcctctaaacaccaacttgcaaaaatgcaatgccaaaacttttgctaccaaaactttgccatttgccatttgctattccaaatgcctctaaacatggccttaattattccctgctcaattagtgagcaagtaaccattacgtctcccgcaaagaattaatatgtattccccgtactactcaattcctgatcaaataatggtcacggttaattttaaggtcgtgaccgtacgtgaatttgcactcggtccgttacatcagtaattatcatcaccaccattacagtcatcagggagataaacatggttaccaaggtgcccgtggtcatagtccaaaccatacctgagcgcgtcccacgtcgagaacaggtcgcctccgtcgttcatcgtcgtcgtgagcggcggcgccgccaacgcctcggctgccgtgaacgacgacggcgacgcggccgcggccgtggccggcagctggccgtcgggagggaacgcgtgcggctgctcgtgcagctgatggctgctactagaatcgaagctcagcatcatgaatggccttcttctcgctgtattttgctgctgtcgttctcgctcggtctgctgctgatgagcgccgccgccgccgccgccagcggaggagccgaacctgaggaggtacgcgtcgccggcggcgcccggcggcggctgctcggccacgacgtcgggggtcgggacgggcgtggtgttgcaggtgtgctcgtacgtgtaggtgaccctgtacagtggcgggtcgtcgtcgttctcctgctgcaccagcttggaggcaaggcactgtctgtcctcacggtaagagcatctgtaatataacctgcgattccatttacagtacagatgcataagatttaaatgcatcttaagattaggatctcgccgcgcggttttaccacaaattaggttgattttgaactctgaacttttttaagtactagtacagttactattgttaatagtttgttgtagccaagtagcctactgctgaccatgcataatatttcaatggaaatcccaatatgcaagaaataaattgactaaaagctacttttagatgggattgctacattcacaacacacatatttttttcccaaaaacttttgtatgagaacttttagaaaaacgtctaccaggaaaacattcatccagaaagcttttattttgaaactttcatcaagaaaactttcatatgaaaactatcatctgaaaatgtgtgtgctaaattaaccataactttgctagatagtaatttcgagtttttgttgtttgactcctggtagcttaatattcccatctgtcaattttactcttcacttttttatagtaattcacagcaaatgaaacattctaaaatattataacaatttatttctataatatattctcatagtaaacaataaaagaacaacctagatgattgaaaccaacaagagcacatattatatcatttcttaatatgtcatttctcaatatgaacagaatgcatgacttaaaactttttacagctgatagtcaacagataaataatttaggttctatttagataatgactaatttaattacctagggaaagcagagtccttgatgttcttctggccatacttcctccacaaatgaccatcaaaatgaggtgtgaacgtatgtttcaccaatgatggtctatccttcctgcagcaatactccgtgtatacagttcaaatagaaaaagttagcaagtaattttacaatgttatgaaaataataaaacctgctatattaattaggatacatcaaaagtgacaatatatacttcctcggatcataaatatttatttcatgcaattgatttgcccataaaatttaaccattcatcttattcagaattttagtacaaatatataaaaatatatgttacgtttaaagtaactttaataataaaacaagtcacaagaaaataaaatataatatatattttttaaataagacaaatgattaatgtcaaatgtgtcaaatatttatgatcggaggaggtaatatagaaaaaaatgttccaatatacatgaataatatgcaaagaatcgcacatgactgataatatacaagaaaaagatacctcgagtacagaaatagttctacaggactaaattaataatgaacgatcgatgtttacatgaagttaaaaacaagcaccattacatatataattgctggcctaattaattatgtggccagatattgcaacatgcacgcttatatatatttgaaaaacataaccttgtcagttagttgttgtacaacactaatgactacttgcaaacaaagtcgcattataagtacaacatataacaaattaattatgtgtactatatatgtatatatatgtatgtagtatccagggtgtatttaccacgtactatatctgaacttagcgagattgaagtactgtgttagttgtttcgtgttagcatggcctctatatcaaaatcgactcagtgcaatcttatgacgcaacggtagtactaccaccgtttcacaatgtaagtcattctagcatttcccgcattcatattgatgttaatgaatttagatagatatatatgtctagattcattaacattaatatgaatgcatttcccgtattcatattgatgttaatgaatctagatagatatatatgtctagattcattaacattaatatgaatgttggaaatgctaaaatgacttacgttgtgaaacgaatggagtaagttcgaagcttagtcttttagtttttttttctcttgtttcttagttatgagatttaaaatttaagtattctttatcctttaagtactgtgtatatccccgattttttatccattgttaaaaagaagcatgcatatgggtgagttggatggcctccatcagagtaggacatgtacacgagacatgcatgttgaagggggcctagctagtagtagttgcttgatctccgttatttgcatgcatgcttatgtcaatgtctgggtcattagcttatttaaagggaaatggatctgaatctgttgataagttggtaaattaaatacgtaccccttctaaatgggttaccacctcccccgaacgcatgccatatgagacatgaagaatctagaataattaaagattcttttttcatcagacagattcagaaatgcttctctagcttttcatgtgatccatagtactgtggatctatggaaactagctggaatgtgagtatatatattagtggtgcccactttttattgacatgttgagaatagtggatgagccaggaccacaaaaataatctaataagaaggggcgcaaagcagtgctaattaacactgttcttaacattcctaacagtacacaaatttatatgattttaagatagaataatttcagccaaattcatgacttgtataataatggagcctagacacgaccgaggaacaatgaaatacatgctctcccaacctttttatcaacagttaagttgatattcgaacttgaatttgtttggacaataggttaattagctagatcagctgaaaatacacttatatatgcatggtagttttactgacgctctcgattcttttataaggatgaaaggcaacggtttcaagtgtactgtcaaaacgttcaaataatggggtataacttgtgaaaaatagcgactaatcttttgatgttgtcctttagaaatttttggtcggttttactatgcaatggcatggctatatatatcaccctttctttctttattttaatctcaacaaattcatcacattgatcttgatattgcatgttgcaagcatcattttttttgtgggagttgctacaataagctgggcggtttgttgtttgaatagaaattttgtgatccttaatatggaagcaaattaattaattcattatttcttacttacatatgattttcaaggcaacatatatatactaggcaaaatataggttgcaactgcttagaaattaaaagagaggggccgagagctgaggaactgcttagaaggtaatcatgcttttcccctacatattcatgtgttggcgaaaggtggtcatggtgtagccatgtagtgatcttggaattgcagctatggagttgtttgcaggttcgtcggatggaattttagaaaaaagaattgtagcttggtgttaagtttggtgtttgagaatctgaacttttgttaattatgtttaatgcttcctcgtgtgagggctagagtctagaactcgtttttattttgttgccgatgtacatccttctttgaaggatgtagagaccgggttgatatattcattaattatctgaaaatataagagtatggttcctgtgtgtgtgtgtgtgtatgctctgatcttctgacaaatgtcactgatatcttgctgtactaatatctagatttcaatctatatatcaagatcaaaatttaattgttggtgtgaatatatagtggctaaacactattcatgaatctttgtgaaataatgtgtgtgcaacgtacgcacttcagattgtcacatgcaaaaatattatgatcaatgaagcaatgccgtcagaaatgcccttttctcattcttaaaatgaaaaatggccagaattgaataagctctagtgttcacttacaaataggtgtagttcgagacaggattaatctgagtggatagagaaagagttaaacgtctcccgtaaataataaatggcttagtgttccacataactgatcaatatgtccttatctaatactatgagttaatttgatcaagtctacgcactagttcatacgtatgcgcttggtctctgaccgtgtacactcccccctggaagacttgtagtcaactcacactatgaagggtcctaattcccgattaataatgttcatgtccaaaaaagaaagaagtttaccagcataggaatatatatataaatgaaggatcaaaacattttgtttagaactaaggagtttcaatttgccattgcattaattgaggttgaggcttgaggacaacagaagaaaaactgtatcaaggatacataggtcaatagtaagaataagtcaaaacactaacacacaatactacacaagttgatcaggataacactgtatagttagggggatgggagtgtatgagaatgagaatcacaagtatgaataagttcatggatatatcttaaacttaactaggaaggagaaatggttagtggaactttatggatgctgcatgcatgaagtgatgaagatggactgccgacatgcatgtgcttgttactttcttgtttcctttaatttttacctcttttagaagaaaagtatatgcttgtgagtcataaaatactactaattgtggactattactgctaaggaaagaaacaaaggttggttcgatcagttggtaattcgatatatatatataacaaagaagattcgagacttctctatgtgcattctttgttttcttgttataagctagcatgcttaaaatgtgcaggaagagctccaatctagaactagtagtaaggtagggttctcaagcaattaatggagccctccactatggcaaagatgcatggacatatgttaagaaaatggaacaacatatgatcacttcgggttcctaagtgtcaaaaagaaatggtcttcattcaaaggaggagaatatgcatcttcttggtgaattatgaagaatgctgaaaatggctattagcatatatgtgatgtttgatgattttaatttattaatggcatgtccttttactgtagtgcagaatctcaatccaaacttgagcaaaacattatgccccccccccaaaaaaaaaaagcgtattaattttccgctttcacctcagctcatgaaatatagctagctcactcaaaagtaggacaactcaaaggaagaaattaagatcgatggaggaaagaaaaaccttgatagttggggtagtatgcatccatttaattggtttaatttttcaatctgtttgttttaatagtgcagacgagctagcgttatcaccctcaatcgtacaaggtttcgtcattctttttagtagtaattaaaccattaaattcaagttgcaatatagtacatactatctaccaaccccacatatagatcctaacattgcctgtttatgaccatgttaatgtttcttcctcctccttaatttccccaaaaatttccccatattggcataccacacagaagccagaaactataattcccattctccttaattttggcagactcaagaaacgaagaaaaagaaagggcaaacaggtacacacaactcaaatcagcaaagcgcagttaggatcagcggctccagaaattaatccattcaagacagcaagagaggtaaacaagaagtggttggagagaggcaaaatatatgaacgaatcgacgaaattaaacacgaagcaatcaaggagatacaggtactaattaacaaattaacatctgtgtgtgctagcttagctagctcgtgtagtatagtaccttctcttccggccgtcgcgcggcgaggactccggcggcgagatgccaaagacgccgccgcccccgggagggctgtacgacgccgacgcggatcccacggcttcctgcgcgctcgcctcctcgaagtcgaacgactgctccctcttcagccgcggcgacgccattgattcttcaggccagctctctctctctctctctctctctctctctctctcgtcagctagaacaagagctaatgccttgcaagctagctagaagctgcaggcaaggggagtgggaaatggaggaggcagctgcgtcgctttcgagctgctcgccggagactttaactttgggaggggagcagggctatgcctacgcttaattagccacggcgtgcggtacaagcacggtcaatagtttatggtttggttttgttgtcaagtcaagaggcgttgctgggtcttttgatatgtttaatgtttacagatatacattagattcgagaggatgaatctgctgccccctcaaacaattaatcatgtgccctattatatgggcctcaagcattggccccctcttgatgacttctttttccccttaaattaacttaatttcttggtcagtatgcaattaggttgtgtgtatgtatgtatacatatatgtacatatatatgtatatgtatatgtatatgtatatatatgtatatatacatatatatatgtatgtatatgtatgtacatatatgtatatgtgtatatatatgtatatgtgtatatatatatgtatatgtatatgtatatatatgtatatgtatatgtatatatatgtatatgtatatatatatatgtatatatatatatatatgtatatatatatatatatagcagatgctagctagcttgctctcaatgcatgcacaatttctcatatcgttttttttttagttttgaggatagtttctctagtactactatgagtgtattatatatgttttgcctcttgtttattgcgaccttggtgaggctcttgaactgacgtaagcgtccgggtgcgatgcgggcatgcttttttactggcaaattgcagcaacggacacaaacaatgggtggcagtggattagatgtatttgcaagttgggattacaatactggggaacgccatcgttagccaggatggtggaggctaccaatcccgagccactctcacgtttcggtgcagcctgcatgcagctaagcattttgctgcaaggtgctgaaagaaggctattttatcaggagaatttgtgaggaagacgattgtatatgatacatttatatcttgagggtttgctgatcttgtttaacacggtttagttgcattgccagcggaagtcactaccacagaacacctaataggtgccggttgggaatcccacaaaggtgccggatttcccaaccggcaccacgaaggcggcactgatgtgaagagaaacaggtgccggttcctaaaccggcacctttgtggttccacgagtaaaaaaaagccggctcgatgcatcgagcatgcaccttctccatccatagcaagaaaaaatcatcatccatccattccatatccatccacagcaagaacaaatcgttattcaattcaatccacaacacaaattacacgaactatttgcatgcatcagaggtaaagcaaaagaaaaaaaaaaacaaatcaagcacagcgcctcgcctgatccgaccacccccgagcaccggtgggagtggcggcgccggatccagccaccctcgagcgccggtggccggtgggaagcaccgaatctggaggagggcggcctgccccacgtcgtcatcgccccccagcttggatgtttcggtgaccgccgccgctaggtagcacgcgtcggcctccccttccctcggatctgatggaggggagggtgctgccgccgtgaggaggtgctgccgaggggaggtgagggcgtgcccacaggagaagactccgccgccgccgccaactcaggaaaggaggaggaggaggaggaagggaggagaggaggatggcggagaggggaggaggagggggacgatggaaagtggaggagagggagtcgacggagagggtgcgagagagagagagagaggtatgggagagaagagagacgagtggaggagaggataagggtcacgcactcgcgcacaatcttatccgagaggtcggcttgccagctcggctccgtttgatataggtgttaatttttaaataaaccgacacctataatattttatagtcggtttttaattaaccgatacctatagtgtattaaaggttcttatttttttgaaaaaccgacacctatagtatatataggtggcggttttattgtagaaccaacacatatattttggtaaaggtgttggtttttttattttcagtctatgggtggtggaaaaaacactataggtgccggttttagctgttccggcacctatagtgccgacttgtatgtgactttttgtattagtgatagtcttttctaacgaaatacaagtgtgagatctcatattgatataccaggaaaaaaacaagaccatagtattagctagaaggctatgatcgggaaaggaaacaaaaataacagtcacaccacacacctgcgacaaaattaattctttgagaaacaaacgtgagcacaacgccccaactacaccagactgtctccgtccatgcctttgggtttgagagggagagaacgagagacaagatggatccattctcccccacgcagacccgccaacataggcatcttgtggcagtcagaagcaccactgcaagataaacaaaagtctgaagaagagattggcttgggaatggtccttcgaaaacgagcctctaggaaggtcgcgacatcaagaacgttcccgtcgcccactccggtaaaccaggatgtggttttcacctgaaggaaaacaccatgcgagagcaaggagccacaacaatgcccccaagaggtttacggtgcccaaaagcgtcgccgctgtcgacctcgatttaggccagtatttcgcctataaacatcctttccttgcatgtcgttttatccttgttgattctgtcaactgccaccaaatgaacaccttcagcgcatggttatcgtattggcgccccaccgcgagccaacccttgggaggatctatgacccacccgttgtctaactctggcgagtctttgacaagtcggccaccaggacctcacccgcacatcatcggagcaaaagacccatgagctctactgctgccaacccacaccactgccccgtgccatcccaccgtctccacgtcaccaccatctcacgccagtcgtcgttgtgaggctggatccaccgggtacagtctcctcgtcaaccttcatcgcacgcgcctcgctccaactgtcttcgtcgcctccactgttgccttccctcttccctattgtcaggccgccaccctcccttgctggcatgtgcccgccgtcgtcgcctcgccggatccgagcagtggcggtctggatctaggtggcacagagccaccaccacttgagacgccctggtgtcccactcacgccagccagcgtcttcgggtttctgatcgacggccgctggaggctggacgctagaggccgccggaccgagcgggcgcaccacggtagatctgatcgacggctagttaattactggtgtggcgtgcgtgcacgctccattcggtagtgatcagcggagaaaccgagtgagagagttgcgcgcgcgcggtggaaatcaatcaacgtcgtacgccaccggtgcgccgtgcagatgtagtagtagctagcccagcgtacgtactatataccagccacatacgtcgcacgacacggcaggaagcgcgcccgtgggccaggtgcggtgcctggggaatttagggggttaattggaggagcctacgcgtcgggcgcccgattggagaggggaaaaatcgggcgctaacatcagcatgacatatgcgtgcaaaaccactttaaactattttttctcttaaattatttatccaaatcatgatccgattgcatcattaaattcattgcaattaatctttaaaacaagaccacacatggatatattccgatgaattttttttagcttattcttgaattatttttaaatgttgcacaatgttttaacaagtataccggaattgtttcactaagtagatcgaaaatgtttcaatcgtttaaatcgggtgttatttcgccttatatcaaaacaatgtttcagcaaatagcgaaatgatatttcggttcactgcaacatttgatccatacatagtgaaacattataagtacactaggtgaaacatttttggtggaacaaaaaataaaacgaattcccttaatagagggtttccaaaatatgtggatgatttgttgcaaaaaaatgtttcaattcattgcaacattagatctatacatagtgaaacattgtgagtacactaggtaaaatatttttgatggaacaaataatgaaacggattttctttatagagggtttctaaaatatgtggatgatttgttgcataagaatgtttcaattcactgcaacattagatctatacatagtgaaacattatgagtacactagatgaaacattttttgtagaacaaggggagggatatgtgggtgggcccgggggtgcacgcgtgggagggaggggaagcgaccgattttctccctccccccagttgaccgattctaagcattatcggggttaattagttagggatgatcgatgcgggcatggcgcagccggggttggccgtgtacataccacggccgatgcatcacaggcgtacggacttttttgaggatttaattggtctctctggcagagttgcatggtggtgcgcggctatggtatcgatcgatcaatgatcaatctatatccccgattgacaggacacgatcacacgattggtcggaacgtacgtggctagctgttttagtttagtgtcctaccaaattaccaataatatactacctttgtattttaatatataacgttgtcgacgttcgatgtcgcgattccggtatttgcatagtatggggatcgttggtactagaatatacgcgagactgaggtaaaagagatgagacagtgatttttatacaggttcggacccctgaattgtcaggtaataaccctacatcctgttggctgaagccggtattgctcttattcaccataatcacaccagtacaatatttggggtagcctatctaactgttgtcgatatggcggtctgaagttctgactcgtagtcgacaacagggtagtcttcctcctcgagttcgtgcccggcgagatcaaagataacgctttcgtctctcctgacagtatccggagacaccgtaggggactagccgtgcttatccctaaagtcgatatccagcgtcttgtcttggcgtatgttggcttgtattggcttgtggcgtctatgttgtctgtgtcccctctcctcctagggggccttatatttatacccataggtgtccccttatctaagtagaactaggaaaaccaatatggatacaatccgagtagtacttgtcgtttctatgtagaactctggttgtctttccttatccggaactcctcctatatccgcaggttgttttcgtataggacatggtatgtggtgggtcctgccgagatttagtcaactactattaggtatgtggtatccataaccctgacaaacgtcgttgaatttttaataaatgtgtttgaccattcgtcttatttaattttattttgtaaatgtaaaaaaaattaagtcatgcttaaggaatatttgataataaatcaaatcacactaaaataaatggtaattacatttttttaataagatgaatggtcaaacgtattttaaaaaattaaccgcgtcatatattaaacaacggcgagaatacgtctttgataaattttaacactaccaatactcttaatcgtgtacgagcaaatgttttggttttggtaaatactattgtcaatccaaacatctagggtatatggtattttttaagttgttaaatatttatttagtaggtttattaggacatgttttgacataaaaaacagattaagacttaagttgattttttttaaggaatcgtctcctaagtagtacgagtatcttcctataaccaagcgaggaccgaacgacccggccatatatacattgatcagtttgtaataataaaagtgtatagtcatcgattgatgcacttgacccttatataaaacataggcaaaacgtatctgcagttctgtatacaagcgtacaattatatattcaaggaaattaatccaacttattgtcaaaggtgtgcgcatgcccgcgaaaggacccaggcgtttagttcacaccaaacttcccctaaactcttaactttccatcgtatcacatcacatctaaaatttttctactcacataaactcttaacttttttttcaaactaccaactttccccaaacttcttcccaatttcaaaaactaaacacagccctaattaattaagattaaatctgaagagtggacctagattaaaatagtacggctgctgcagattttaatatattggcacgcggttgcacgatcgatgtacttacttatgtacgttggctgttagccagctgcttagctgtcctgctagaaaatcattttccgaagataattttgcttatacggaacacatcctaggtgagaggcaagaaatactaacataacatgtggattcattgaatatagagtactcttgaatatataatgaatgctcatttttcagttgacaaatgcaaacctgcgacctgccgtattaggagagttgggttaacataagcaccttgtcagggcaatcactcgtcttatgctcacgtcatgctgatgtgtaagacccagctcgcgatcacctggccacttgattaacacactgcctgatggaatcaatcaggtggccataacccatgagctagcagagtatcatttggagaacatgtacagttcctaaggaatgtcaaatctattgcgaccatcgattgttcaattgttttaccgtatatatttcaaaatataaacaaacttttgtacgtgaatctaaacgtagtacatgtctaaatttatgtaaacgaatctatgaatatacaaaagttaagataaagcgaatacttagaccacatcgaatatgctttggattaagattaactacgagtatacaaaatgagaaacctattagtttatgattaattgaactttaattattttaaacttaaaaaaggttttatatgatattttagagcaacttctatataaaaagttttcgcacaaaatatatatatttagaaatttaaaaaatgtgctaacgaaaaccgaggtgaaatatgtatctcagcgaagaaagaacgggaccttatttatttaccattcgcttttgattgtttttttattttattttctaaccgatggccggataggagctccaaaactaattataagtcggcataccggatttacataactcatctgcttacataccggatcatactccaacctctcagccataaaaaatttagaacttttttagataatgaacttaaataaaaccccggcatctacattccaagagattcagaactaataagacatactgttgttaggccctcgcgtcaccctccccctcgggcgacacgggaggtgactaggccgccgtcgccggcctctccctccctcctccgcctcgctgccgcccgagcggccgcaaggacggcggtagcggggcttcgctctcaccacgcaagggcaggggggctactcggcgtttgggacggcggaaccgtccagatccgtgccgtccggccggatctagcggggaggatgtcggcggcatcggcgtggtagtgcggtgtggcggcgacgtttggcaaaggtggcaccggcgcttggaagtgatgacagtggtagaagtgaccaccagatccgcgcctggatctggcaggtaagtggccggtggcggggtcttctgctggcgacggacggtggcgcccggtggcgcggtggcgggtgaggtccgactctgcgacggctggatctggccggacgacgagcatccagccgtcgctattggcgacggaggcagtggctggcggcgacggtgcgacggcgcggaggctggtgaaggcacgtgcgatggtgcggaggccccggaaaccgtgacggtggcggaggggcaagaggccgcgctcgcagaggaggtggcaacatgcgcgggcgacggcgtgcggaggcgcagcaactggtggttgcggttggccggtgaggtcggctcggccggcagcccgcgacggcggaggtggtgtcggctcgctgaaggagttgcggccggcaactgtccaacgcgtgtaggcttggccggcgacgtcgaggacggccggtgcgtgatggctgcgcagcgagaggtgatgtcggtggaggcagagcccggtgaggtggctgcatgcggagactggccggcgggggcgccggtgcagtgtacccacacaccggcagaggttttgatggcggtggagcaatggagctgtggtagattggtaggtggtggacggtgggtgaaaacccaacccgaccccggccggaccgacaaccgatgaccgatgatgctcaagtgtcattcccctcctgagggtgttgtcgtgccgtcttaccccttaagggtggttgctgggcgaaagcttagtctcggctctcttgagaccttggcggacggcgacggtggtgtttccgtcgttctctccttggagacgttgtctagacatccccttatcaaaaccacctgaacttttggcgcaaacgtgctctagatttcttcctcttgtggcggcatcctagtttctacaagttggccatggcagatggcctaggggggagaggtgttccatcttctctctcaccctctctctctctctctaaatcctgaagacgtggatagagttgagctttgtgttgtttgtaagggtaaggttttgagcgatctcggttgtttccgttgttggcttagcggcagtcggtctcacttagcggcggccggtctggtgctagtcttctccaatacttgtggttgaacgctatcgatatgtgagtggtggtatatttatttttcctggtgtgtaatcttgttttttttcctgttctattaatagaatttcgcaccgagtcgttcaaaaaataagacagactggcaacacttgccggggagcaatgctgagagcttggctgctgggatggggccaagaggttggagacacatctagtgacgactgacgagtacaagcatctactagtactttatttgatccaagttgctaagctaatctgattgctaacttagcttatcgactgggggctgcagaaaaagagcaaatatgattaaagctcaagtggcaaggtgtcgatgccgacgaggattagttaatggtcagtgtgacagcgcattggcaggtgctactttaaatctaattaagggaaaaccgcacgtgattttgggagcagggacaggttcccctggagaaaacgccagtggcaagtggcagcacgcataaacaaaatttgttgccctttctccaaatcctgccaaggatagttcaggcgcggatctagcggccattgcatcactggcctttgtgaccaggacaaagtcatggcggctcaaaaaccaagacagctaacaaaaaagaaatatagtaatgctcacttcttccctttaaaaaaatattatacaaaatatataatctaatatgaaatgtgatacattctaacattataaatctgaacagattctaggactatgaatctaggtagacctcttatcaaattcgtaataataggatgtcacatcccgtattatatttattttttatgagacgaagggagttcttgatattcctttgtcttcaaatataacattgttactccctctgttttacggatgaaaatggagcggatacggacggataatgctcgtatcatattcgttttcatattttttgtcggatacggaaaagaatacggatagctcgaatacggaaacaaatatggactatctcgaatacgaataagaatcgaatatgatcggacacgaatacggaaacaaatttttctcggaacacgaaaaccagttcaacttctaatagaaacaaatatcaacatatataattagctcattttatataaaatatagtataatttataaatatttttaaaattttaaataatattaataatgtggactagtgttaagagatgaactactattaaaatctaaaaaggtacattgaaggtcatagagttataaagaaatagggtatgtcttgtggcttctgtgcatatccgaatagcactgttcaccggatatctgaattattatccgtatccgacggaaaccctgataccatattcgtattcatatccgagagaaaatatccgtattcgtatccatactatccgagaattatccgatccgaaaggtatccgtatttgtttttatccgaagcggacggaaactatccgctccgttttcatccctactctatttcaatataaacaaatccatacaagatttgtttattttaaatcggagtgagtagatattatgtttaattatttattttattttaaaacttaatataaatatatgtaaaaatacaagtcaggtttaaaataccttaagtaataaaataacaagaaatgatacttagtttgtttagtaagacgaatactcgaatgccatacatacgatacttagtttgtttagtattcactccatttatatccattttatattataagtcgttttgatttttttttaatcaaactttttttaagtttgatcaagctcatagaaatatttgccaacatttataactctattagttttattaaaactaatagttaatatattttaataatatatatttctatttttttctataaacttagtaaaactaaaaaaaaagttgactagaaaaaatcaaaatcaaggtgatttatagtatgatgaaacggagggagtaagacgaatgctcaaatttcatatctagaagttaaccgcatcatatattactttacaatactgctcataataaatgctgattgtggcaccataattttttttactgaagattaacaagtatggtaatcaggaatcttaaatcaaagagcgattttaggagtataagagaaaactaaatcaaaacgttgctgcatatatgcagctatgcttaaagcttactgcacataccctcctttatcattcatatggtatatatagtatattaaatttagctaaaaaaagagctgtgcatatatacactagatcgacatgtatattttctgcaaaagtggatataatatactttcttttatgaaaagctagaccaaaagcaaagaccctttttagtatgccaatgaattaattccactcaaccagtgtgcgtggattctttgagccaagccaaatccagaggctcgacccagtggggatccagtactgaatccagcatgaagtccagtgtcaggtcgtcggacgccggcaacaattcaggcgaaatcgcatagctgcagctgtaatggtcgcttctggccaccgccggcggcggcctgtttaccggcaaagcagcggcgctattattaccagctgattctgcaatgtgacagcctctgatgacggtgagcagcgaggagacgatcacatccttctcttctttcatcgccatgttgtagccgccgctgcagcgaggaggaggagaatgcatcaggcgaggtgtttccacctctgcctttctcagtctttccgccgcctgtgcctttctcaaggaggcgtcggcaatctgctggatttgcatggaggaagccatgtaatcggaggcagaattgctggtgccgcatgtgtgctcgttggtgtagatcacccggaacaaaggcgggtcctccgagttgtgctgctccacgtgcttgctcgctggacagccatggtcctgatggtacgtgcacctgtagtagcacctgcatttgcaagcaataatatatgatgcttaattagtattacagttgtttagtgctcacttttgcattccttgaaggaagaatgctaagaaaagagggccgtcgacatgcatgtggtagccagaaactttgacacatgacaatatttggcattgtacaacacttatctcgtaattgtttaaccatgccgacatgcattattagccccaaaggagtattcccatgcaagcatgctttgggatagcacaatgtgggggatggtatccccaggtatgggatcgatacatacaccacatgcccccaacaccaaggggtctagtatatatcctcatcaaattgtatatatagtagttccagttaattaatgatggactatttacgtcttagtacatcatattatgaatcaaaacgtttagcctcaattagtgtatacaatataccgtggtctacattacataatcggcagggagcctgagacatgcaaatctagtttagttatcttgtcagacgggaaactgttttaacagttcgagtggacgtccacccgtttactgtatgtcatctaaatggctatgaaaaaattgaaaaaatatgaataagatagatcaatatgtaatatatcaattcacaaacatgcaagttaaaattcaacttctacaaattgtaacaaaaataacaaacaaaactcaaattactatatgtatatttacaattaaatttgttatttttgttacaacttgtagaagttaaatttgaacttgcatgtttgtggagtgatatattacatattgatctatcttgtcaatttttttgaaaatttttcgtaaccatctatttgacatgcaataaacgggtagatgtccactcgacctactagaatccatctcccaaaccgtgcagtttgcccttcattgcacaccgtgtagagcatacaatgctctagaaataaaaaaaactaaaaaagaatgagatttggaaggagagatgtccctccaaatattttttttaagaataaattgtgagcatgttagagattgaacacgaggctttagagttgaatcaacacaccccttgccactacactatcaagtgtatctctaaaataaaaaaaaactaataaaggaacaattattgtctgatggtaagtgcatagcgcgcctgtgaattgatatttgcgttgggagcattccttcatttctctcagttcaagaggtttcagttaaaattatattgaataatatccccaaatcaaaatgtgatttgaaatatcatgcaaaaagctgaattaatcccatgataaaacccaagtcttccccaaaaaaagatgaattaatcccatgcaaaaagtgacccctatcagaaattgcggcagggtgtaaacaaattaagctgcttcccataaatgagtaataggcatctattataaaggaaaagaaatttaaactaatattcagacaacatggtctacggggtaggcaccgttatccagtaacaacttgaggattattcggagcaagaaattatatataaatttgattgtgtcgggtttaaattaaaatcataatatgattttcgccaagattgaattacttaggttctgatcgtttgtgctaactacggaagcacagccgtagttcatttttttttagtgtggatatatactgttgctgcagctgtaacgcagccacaagtagaacaaacatgttccttatacaacattgcaggtacaatgaaaccttcaactatccctgaaaattcccatggcatatattgctagtacatggatgttgcaccaattccttgttcgattcataagtatggtacgttagaaaatctatcatagcaaacaaaacaaatcaaaagcttggtgtaatcaaaggcaagttgagttggatcatttaaatatctaatcctcagttcgtgcatgttaattattaggaaactaataggcatcttttggactactaaacaacccccagtggagcacaggagagcatgtaccatgacaattctgtcgacgtattatagttcttggttctatttttccctatttggattattgtgcttcttagaagttgctcccattcaagcatgtgatttttggatacacgacagcctaaaggcaaacaatacaatgtgatgcgagggtagctactgggaagatggacggcacaatttaataaactgcacatgaacaagatatctttttgcttgaaacacacttcccattaaactatatatatgaatgcaaccagaaagccagctttccggatagacacaattattaagttccttaagccttcaaacgggattaatcacatgcacttaactaatatggaaaccttgcaatgagatcaatccaatgaacttaactgataagggaagcaccctatttacatacagtgtgtgtttcaatattattttgtattggtatacatgtgggtatgagttcgatcagttaagagttaaacaacaacctttataataattaaacaccctcatcatgcttataattaaggagcttatattatgtgaaatcctgaaccagagtgtaaattaaggagcttatatattatgtgaaatcctgaaccagagtgtagcccagctgggtcatctacatggattagttctactgagcctacaaatatctttttactacatttcacctttcattcttgcaatatagagagttcagtacaagctggttttccaacccatttgaattccttgcaagtgcataagcttacaattcgtctttgccatcaagtctgacactgtataaattacactagtggcatctactaccccattatccaacattttgattgttcaaaatttggccaattattccccataacagacaaatgttgattaaagaactacaggtaattgagtagtgcatgtaccttgggaaggagttgccccggatcatcttttgcccgtattttctccactggtacccatcatgatatggtgcatatgtgtactcagttcttgttccgatgcaaacctttctatttgaggaaattaacgctaattacttaaacatttaaataaatgcaccaaaagatcgaagaggaatattacatgcaataggaactaactacaaacatcgtttgcagcaagcaccaacgaccagacgaattcattagctccatcaatcgcaactcaattacaatttcatcgaaatacgcaacaattaagaattaactcagtttaagcgcgtgcaaaaccagtgaaatgaatggctagctattgttatacatatatatatgcatggattaacttacttcatagcgttctcctggtcatagctcctactgtcctgcagaagccttttatgggctcctctagaacattcactggagctgtccatgttgtcgctcctcttaaccatggtggtctcttgcaaccttctgaaacaggtcgacgtgatatgcaagttggtgcttgcaagataccttgaagttgctgaacgtcgatcagtcggattcccacagtaagtgctgaactcctcgccggcctgaaattaatggggatgatgagtttattctccttgtctagtgctgcggagaagtgtgcgactgtgcgctcatataaatcctctgcacaacctggagtaggtgcgtgctttgcttccagaattttaaattttaactcacacaacgcggtatctgcacttgcaaacttcactgacctatgcaacgtgatacgcatggacaatgttcaagtctcctgaggtgacaaatccagtcaaagaaacgatagccctacctgtcagtgataccagtatcaaggtttagccatgttccggagattctgatatatatcggtttatatgtgcacacatatagggggaaagaacactatatgtgtttatatattggattgatggatttgatatccaaacagtaacctgtcagtctgctgcaaacttatatatgaaaatgcctccagattggtttgattcaaaatttcaatttcaggtttgagaacaaacaggacctgaaaggttgagatgcaattagattagagacatgaacaggatctaattctaactttatatccaaaatttatatgtaggagtactacaaaatctaagtttaaccttctcggtttcttggttctcatcattgtttcgggaatatggttctcatcattgtggggacaacttattcttcctttttgcttttgaatagttaggtgtttgtttgtttaaaaaaaatagttaggtgtttgctttccttgtaggtacacaaataattaacacctatgtatatgtgtgcatatgaccacgtgaacacagggccccaaatactgggaatgtttagttacaaaagtagttcattaatacggagggagcaaagcttcaggcttaaggaaaacaattggtgatctacacaacttcagtggactagtagtattatgtctcctacaaatcaaggccgaatggttattattataagttaatagtccaatttattctaaaatataacaacttcaccaccaacattctcttcccaactaatcataatcctctaccattcaatttccccgcacacctccatttctcatcggatcataactctccctcatttaattctacctactttcttaataattgtgtacacccctaaaaatccttatattgggacagaggtagtatatatatattatctaggcaaaagtaatttactaatgcaaatggagctagcttcaggtgaaaaagaatggtactgtgtacatacaactacgatgaagtagtagtcctgtcctgtctcctaccaataaatcaaggctgaatggctattattatcagttatcagtttattgcataaaaacccgttttagctagcatgattcaatctaaataagtagaaggataatacaatattgttgtcgatagcattgatcatatagttaatactccaataaataaaacgaatcatattttagacacgacagctatcacaatactagatttcaattttataatggaactacactgtctgaactcttagatcttccttctcatacgttaggtttcatcacccaaaatgacattacaatatttagtattaacggtagtaagtacttcctccgtttcatattataagactttctagcattgttcacattcatatagatgctaatgaatctagacatatatgtgtatagattcattaacatctatatgaatgtgggcaatgctagaaagtcttataatatgaaatcgagggagtatttaacatcacatgggaaaaatgttaccaacacccaaaggtgaaatttgcaacagtgaaaagtaaagtggcaaattatttattttgatatttatctacataagtgcactgatgagcatgagctgattatcaattaaaaacagtgagcccacccatattgttcgttaactaaaaatgtatatattaagtgaaatgtgattcatattgtatggctggtgtgtggaaatttcttgatgtgggatctatgaccttttgaaaacagtatgcaaaggtaccactaatgaaacatatcctgggtagctgtcttcttcaatgtaccagtcatagtcaactatactctatttgaccatcttttgatcaatcaacagttagtgtgaagctcaagtaaaggattactcatttgtattgtcagcctttcgcttaaatcaatcataataacacggttcacactatttcaattatgtttgaatcccgagtcaaaaatgcaaagtagttaaaaattgtcctttcagggatcaggtgttcattgtatacaataaataggtccattcggatctcaattgatattacaatcagaatttttaatttttaaaaatgcaaaagcagaacagagggtgacagcatccttacatgtttcaggtgatgtgagcacggtgatgaagctaatacgagagtccatttcgaataagtcaaaagttgtacatcctgatcatgctttcagatagcttttctgaaaagagagccccaggaagtgggattgctgaattttgccgtacaactttcattgatgaccaacacggtatctccaaagtccagattgctactccacaatcaaaatacgagaaacttcccagcaagcagtacggagtaatcctctagcacaagtgacaaaccgacagttagaaactttcatggcacagggcaatcacacgatttgaaatacagtcaagtgacacatcattccacgagctcattggtaaatcgtcattgtttataccatgacagtatttgagatgatagcgattccatatatgattttcttaatttgagaagaaagtgattctatgattttctaaagaaaagaggtacagaagacgcaccattcctaaaataagctccacagtgcaacgcagaccatgactaactagatcagctccagggtgcagcatcttgcgggctaatctacatctgtttggacattgaaggcatacttcatcaagaagtttttgacaaagcgacaatattctgagttctgagcatcgtaaagtagtacaactgtaaactgtttgcagtacaactgtttggacatcatgaatttgtatgactagtaaagatttccattaaaaatgcagaaatttcacaagaaatttcagagaaacagttgaattcccacggagagatgaacattttcgcacctccaaaaacccctcaccacggacgaagcagtaataaaacacatagttcgttatcctcgatctcctgtttcctggtggcataagcatgacatggaaattccatctaggttttcagcatcaaccatcgatgctggctaacaacaatctctgggctaaaattttgggaatcgaagttgctaaagcggggcaagctttgggccagaaccggcaaggtcagtgctgggctaggctaaacagaactggaaccgagacggaggagtaagaacctgcaacaaggaaccccccccccccctcctgcggcggctgcattggccggtgcgccgcgcctgaacgatccccctcgtcgccggcgccgcatggattcccctcctccagccgcgtcctcgccatcgccttcctcccgacgaccccgtcggcgccccgccgcctcgccgtcttgcccgcgtagcgtatgtgggaaggattcgatggttggagatctcgtgggctctccttgcgctttattttggcccaccccgacgtgtgccacgccacgtcgcttatgatccagatgggctgaatctacttaaccggttggaccgtgagcccatatttagttggcatgggctatatgtttcttcttggtcatcgggcagtaacgtgtgccacgtcataaaaacgccatgtttttttttaaaaaaaaggagtagatttgtaaaggacgtaactatacagctagtgttagctaaaccagctaccactccatctaagaggcaccatccacctatacttcaaatacaattttctcttaaactactcatccgatctacgatcgattacaccgttgtgttcgtaacaattaaatctttacaacaagatctcacatgattatattttgatgaaaaatcacaaattacttttatgatatgtctaaattacttttagatttcactaagttactttttagatatataaaagtaaattcagtaaaacctaaaagtaatttacatatattatagaagtaacttagaacaaaacgaaggtaactttaacatgtcatttgaagtaaatccgttgtagagataaaaacatgactctatctataaattaaaataatcaacacaaattatggaattaactaaaataataataaaagtaatcacctcagagcattatgaatgtataggaagtatttgaaaaagtaactcatatatatatatgataatttgttcaatgaaaaaagaca

SEQ ID NO: 78304 - DNA, 1869 bp, Oryza sativa
ttatagcatcttttattatggtgagaagtgtgaaactaatcacgaaagacattgttagacccgcccataaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacggaggacaccaactcgtagagggcaacgtggcgaacttaccggtgaccaaaacaacggcggaagatcaacggacggcgacggcgtcgaggaagaagcggcggcaaccttcggcttgacaacgacggcggtgctccggcgacctacggcgacggcgaaggggtggacgagatcggcgacggcttggtgaccacgacggcgacctcctcgagcagcgacgacgaccggagcgacggcggcgcacggctggagctgcggcggcgacggcggcgctaggctacacgatgctagggctctaccggcgacgagaggcgaaggcgagggtggcggcgggtagcgacgggcttgggggtccttttataggggctaggaggcagcgttgcaggcccacggtgaccggcgacggcgaaggaaggtctagggttcggggagagagacgaatccgattcgagatcgaatccacggatttacaaacgattttagcggacgatacaagggtccacatctg

SEQ ID NO: 78305 - DNA, 1443 bp, Oryza sativa
  unsure (1)..(1443): unsure at all n locations
cagagtgantncagattatttatagccaacttctcttgaaatttagaatcttaaaaatgaatatagtacaaacaatctcacatcgtctattggaacacaacaatggcatatttgtcacgcgcactgtctgagcgcctcgcgccaaacttgtgccatgcatcggcatgaaccatgacgcgtgcaagggccgctactagcgtcgcacactagatgtcgtactatgcactaactcgcaaacccgctataccgagcactggacgaatcatgctgcgctagcaacgcgccatgctactccgaccatgcgccataattgcatcggttgtataccttgtggtcgctccgaccatgcgccataattgcatcggttgtataccatgtagttgctttggtcacgcataccaccgaaccttcgatgtgcatcaaactgagcattacattaattcccacatatcttgaaaggtatgctcgaaaaagaaacggtaatactcacatacatatttagtcctttgaaaggatcatccgatacataatgcgcttatgaaatagctgcaattgtgtctatttgacactacgctcttcccaaaccaatctagcaagatcacacatattggcacctgcacaatgagaaaaagcactaggtaccggaaattggtaatgaaacctattatgggcaatattctcttcatacaacagaaactcattggcattgacctatggttgaaaatcaacctgcaagttgacctatagttgataatgaatggctaaagatatttttggattgagcactcgcatacaagtattaaaagccccaaaccaagatgatgatccgaatatcatcatataaaaaataaaagctcactcttttggaacgagtttaagataaaattgggagaaacctatgttgcttaggcctgtaagcctacaacatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagaatttggtgcaaaagaagaaccctcacgcatcccacaacaacaacaacaagaaagtcaagcctgatgtcaaaccaaaggctactaccaattttaaggataaaggcaagggaaaggccaaggacagtgactatcttcg

SEQ ID NO: 78306 - DNA, 1635 bp, Oryza sativa
  unsure (1)..(1635): unsure at all n locations
gcccacccgaccggtatcaaacggaggtggcgaattaaatgcccnctcataaacaatggcgcggtctattcacctgtaaaatggccctaactanncccnnnnnnaaggagtgtggcactgtggaaagcaccccncanacgattgggagaaataacccgcctaggcaannnannncagccagggtcacatcatgatacgcacgacagtgcatcactacaagttttactaaacggtagaatgaagcgccggacaaagggggggagcaaaacgaggcacattaggggcacgcaccgaaacaaaagcagcagctgcggaaaaaggctatcctagcggggctaaaggtccactccacaggcaaaactcaactaggggctgagcctgggtcctcgaagtccgtcttcagctcagaagtactacacttctgaaaagggggaataaaagcaagactgagtacaaccaccgtactcagcaagccacaccaacgatacagatgtgcaaggggatacaaggatggtttgtggctatttgcataaaggcggttgtaaaacattttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaagccgtcgcagggcccgccccgctccatcacgcccacccttgcctggatgcgtcagctagaggtaagctacactacaagcccagcccgtgcccacgctggcttgtgggaagtacgattagttctttcaaggcattccgcgaacccgtccctaactacccatggtgcgaccagcaaaaccatgcacccacaggccaacattcagtcgcaatttagtggataattacgaccatgaagcatggcncagagtctcgagcacgcagctctatctgatactaaaaagtctcatactgtatntnccatcaactggagctatggtattaagcatggctatncatatantctagtagtcacataagtacatgagcggcgagcacaatagtatacctggtncctgtatnggccaccctgctatttattggaacgccaaacatcataaaaatggtcaccactccaggggggaggtggatggctctttttncactgactttgaaatttttcttgggaaaccaattccaaaagagttttaactctgccccaacggggaaacttttttaccccgggatgtctaagaggaacacaccgcggctcttttaaaattttagtggggggtcatcggtcgagaaaaaaataaattaaattgcccctaagtttttaattataacaaatggt

SEQ ID NO: 78307 - DNA, 542 bp, Oryza sativa
tctttaactagtacaaaattggaaggaactcagcatatattaattgttgaagattactattgaacaaaaccaaaaggaattgttgaaccaataataacagtgatacaaatataacactttggtttttaaggatagaaaaaacaagtgatctaaacatcgtatgcctacagttatccattcagtgtctcaacaaaaatagaatagaaacaacagtgtcacatcttaccctgagcacctctgtggcattgcctgcactgtagccattgcaaatctggtattccccttgcaagccataaatattatttactacaaagactgatgggtcatcatttccccaatttgtgctagcaccatgatctgcagtgactgaacccatggccttcacctaacatctcaaaaggagaaatatatttacaattgacgatgcagttaatctaatagaagtacgtgcgactgaaagaaaccttaaaaaaaatgatttgcataactactacacaacttgcccgctttatcaaaccaaatgcagttctcgaatagccaca

SEQ ID NO: 78308 - DNA, 2139 bp, Oryza sativa
  unsure (1)..(2139): unsure at all n locations
atcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcggccacataaggaccggtcttcgggcctctgttgcaaagcaataccgtacttccacatgtctagtgggtaaggcttagtttgtgactcagtctggttataaacaaaagtacacggatggagatggacgaagtcgggggtcgatggacatctctaggacaaatgaaggctacacgagctgcggctcggtagtcgagatgtcatggcacagggcgggtgtcctgctgctaggggctcaatcctgcctgcctgtcccggaggttccggccgtaggtggggttgggtcggtactcttgtctatggctaggatgggttggaaactatgtcatgtcttccgtccgtatgccgtggtggtatgtggcacgtggttatatgtgaggaagacatgtcttgtgggtaaagatgtacacctctgatcagagtatcacctattcgaatagccgcgtccttggttatgggcaagcctagcaatgtacctaagttagtgttttaaattcttaacacctgttgaacaactaaaatatggaatggatggcctgggttgacttgggacgagttgggaccctgggtcgggttgctagttcggtttgaatcatcgcaggccttgggttaaggcaggttcgtgtgggtccacggccttgattaataatattgtatagctctaggatcgtattaacaaaatagctttgagcaactaagtgtcttttaatgctgtttactgcaaaccctaacccccctatattataactccattgtactcctttgcatttattctgcactcgtgggtgtgtcttgttgagtacggtggttgtactcagtcttgctcaatttttcccaaacccagaagaggagttcctataagatgtaggctttggtatctagctcgtgcctgccgtcaagcgcctgtggtcgtcgccctagtcttccgctgttttttgtttgtcttcatgtgtgctggtccttcgccgcccatgtaataaattaactatttacgcttccacttgttaaactctgtattgtatcaacttttggtgtaccttgcctcctgggacaaggaataatacacgcacgtaaggaacgcccgttgggttatttctggtcatgacactagtgtaacgccccgattttagttcggaattaaaaatcaattaataatgcatttcaagaaattatataaaatttaaatcaatttaatcaagtgaaattatagaggaaattaaattttcctttaaaaatcattggccgagaatattttgtaatattctttgtgccctaatgtactctgcggattttttccgcaaattttcggagctcaagaaatagttttaatagcacaaagatcattgcatcaattaaaataaaaagaaaacaaataaaaatctccttttcctcttctttggncgnnggngcagtncanncnggcgngcgcacccttnctcttgtggtncagnncaagncgnnccttcctttttcccnggacgncacaggtgggccccactgtnnggccngnntcttnnctcannncgggcgcgngccngnaaccggncgcgngtcacgtttncgctttttcaagcacgtaacacagccccgcgtgtgcgctatttccgaaccaatttttanttttttttcggnccgcaccggccccgggcagaagagcggaataaaatttgaattcgncccctttctctccctatcagatgtgcgggaattcgccntaacggcaaaatcgggttcct

SEQ ID NO: 78309 - DNA, 630 bp, Oryza sativa
ctctcttatggaatgctggttggcatcaataacctttttcccacttgaaacccctccaaaacggcctggaaaccctgaaatcgcatgagatctcgccctatttggcatggggttaaaattccccaggcgaaaacgggtgccatgaactgtccctaatgccccgtgtaaataaaaacggcggaaattacccagggttggtgttaccaaaacaatatttcatcaaccccttggggatacggcgagttttcccggtcaaccccctttctgtgatttatgtggataaacccgcggaacactgcggggtatcactctcagacgggaaaaacgctcactctgtccttgacaatcgggtgactccggtgataactctctctattatccaccttcctcgtttctagcgccttttattctcgcaacaatcatccgcgtcgcaaaacttaataacggccgcaaacaatggcgtctctttttcggcggcacaaaaggccatatataccctcacgcgtctgatttagcaacgccccatcgcgtaaatccacaaactctttcaagcactcggatataaacactgagcggcgctgctagtattcaaggatcgctcttctttacatgcggatcttatcactcgcc

SEQ ID NO: 78310 - DNA, 2083 bp, Oryza sativa
  unsure (1)..(2083): unsure at all n locations
cttcttatccttcccccttttcgttctttcttcccctcttctcgagaaaagtgcacagtaagtagatgggtagcgattggcgcgcgcggtggctgacagagccgacgacggaatcttcgtgcgcttcaacatgtcaccaaggttgggttgtgggcacggtaagccggaaacccccggcttatcgaacggacggcatggtcaccgcaccggcgacacggccccgtggtggatgtccgagcacagctcccgccacaccagctcgagcgtttggagcgcgaccacgacggtgaatgtccgcagcggaccccgacctcgattgcttgatccctacagcacatcgtcggcgacgatacctcccccatcctcaccgccaagcccatcaccacggtctccaaagggttggttggttaattggtggtagtagcaaagcctatggcctccggtgatcagcttgctcaagctcatgctcgtggtgtgcctccgtgtagcactggcacgacgcaggggaagggcaagtacctgctgttaaagggaaaattggaatcatgtcattataattttataaaatttaagatatgctattctgacccacatgtcattgactcatgtgggtcctacatgttattgagataccgatgacatatctcaaacttagctaaattataatggcatggttctaatttacccgctgttaaatgacgagctcgtctgatcgttgatatggttttaccgaacatccaccatctcgttcatgaacaggtgggtaccacacattgtcgctacagtgttttttcttttttttaagttattttattacctgtcgaactgccctatcgaactgccccagtttgacaggtacccttttgaactgccccagttcgacagggtgctaaacttacgattttgtctaaccgacctataattttgtgattttctattaaaataatattatttccacaaaaaattcactatacataacggaagcaggcgaagctaatccagctgccatgtgtaagtgcacaagtgcataggatcctagctaatagtaatacctgaaataagaggcggtagacggcagcggcagcggcagcagcagcggcgctaggcgatcgcagagtcatgctgcacctcgtgccctactgccatcgaccgttgtgcggagtagtggaaggaaaatgggaagccggccgccggcgctccgatgcgtggccttgcgctgttgcgccgcgcgaattcggcgccgtgaggagaagatcagaagacgtgggcggtggcaatcgcggcatcgtgttctattcgccttctgcttgtggctttcgcgcacaatgcgtttgttcgccttcgtgctgggccaggcctcaggcctgaagatgcctggggtttgggacgggaggccccaccaccccagggggggggggcggcgtgctctggggtggccatgctgtggtacgcataggatgtttgtcttgacgtgcaaacataggttcaaagacgacgcctttcctgtttctctgatctcataaaacctgagtagtcaataagaagaagctaagncattactaaaatttcgaattcacttctatattatgtaaaaggcctgatataggcatgtaattttacccaaaaacttctacaatatacaaaccggtactttgatattgaacatctttctaaaaaaacgtaattttcgagtacattaaaggtacgtgctcatgttttcaaaacaggagaagtttgcatccatttcttagagaacctaatattaccctccctcccctaacacaaaggaataagtttggtttccagttgacccttattaatcaattttttgaaattaaaaaaagaaatgggctaagaccgtnnataatagtggcccaataaatatattatttaaaaattggaataaacatttgaactcagaaaaaatcaaacctctttgggggggggggttttctcaaaaatcaccttttataagaataaagggggggtgggaactttgggggggtttttcgggccaacaaagagggtttttttaaaacaaatatttttttgcttcttcgccgggaaaattaaaaacggatta

SEQ ID NO: 78311 - DNA, 763 bp, Oryza sativa
tttttatcggccggctttccccggtactagttgttgtctatgggaagaagctagtcaaagaacatctcagttctcagaataggaggccccccccagtgaagccggggaatcattggacctggggggtttgactaaaaaacatctgggtctgcaagggtatatcgaccatgctggtgtttcatcctaccatgtcccatggtggtgtttcatgcattgtttcatcctcctactccttggagttatggtagaagtcgacgcaggtctggcacccgcagtcggtgaagcggcagatctcgcacccgaagcacacgcacttcacgcagccggtgcacgacgtggagcgggagcagcctctcagcaccttgcggctcgcgcgctcctcctcatcgccgcaggtgaccctggtgggatcaatcaaggttatatatatatgcaaatgtacacaagaacaaagcaaatatatgaaatatggaaaaccaagaaatgtcaaactgaggatggaaggaacacagaacaggtaacggtgcataaaagtacactactggtcactaggcaaagcaatgcttcttttttaaaggaaaatttaatgtaaacattgcagccaaatttagaatgcatgtactcatgttactgaaggaacagcacccttcagcgatcctagaaaattttccctacatgctactgaatgctacagggatacagtactgaatgtgtcctgtggctacaggccgcatgagtacatgaccctgcagagatctggaag

SEQ ID NO: 78312 - DNA, 1410 bp, Oryza sativa
cctatatcctttttcctgctcaactgagaaccgacagcttttgctgccaacggtgatgtccaagccttctggagatcttcttggcaatctctagcttctcgcgcagccaaggatcactggtttcagctccagaaaaggcatggcttttgaagattgtcaagaaatcagtatctttcaagctttccagaggaaaaattttcttgcagtcaagaacagctggaagtgcattccggcgggacgttactagaattttgcttcccctctgcagagaagctataggagctaacagttgctcccagtcccactctgtctcacttttggattcgtcaaaccaaacatcatccaacactagcaggaacttctctgattcttgcaatatgtcccttaatttgcactgaagggtatcgagattgccaatacgtgggcactcgccctttccagcggactcaatgatctcttgcgtgtgacgatgcacatcaagtttgcgcgagatgcagacccaaatcctggcatcaaaatactgagccaccctttcatcattgtagacatgctgagctagtgtagtttttcccataccaccaactccaacaattgccagagatgagtaccacctagccatgctacctccggcattcacaggcttacagagaatatcaattatacgatcacgatcctcgtcgcgaccaacaacatttgatgaggaaaaggaagtggtggtgttaggcctgatgggtgctgtgaccataagttctgtcgaattgccagcttgtatgccaagctgatcgtgaaaagccttagcttccaccaagatttccttcagttcttcgagcttgctgattagcttcctgttcttagggcgcaaattggacatcttgttggatgcagcatgcagaggctttggaacggaattagaggaggcaaccatcaacgatgcttgtgcgcctttctctgctacacgcttgaggatgtcatactcgagctcatccagcacatcttcagtgtcatagaaagctgctttcagtttgcgcagccacctttcgatcttgcccttatggggactcttctcggctgcttcgatcaccagctgaaactgtggcaggatggtggcctccagttcttggagctcacacaccatgtccttgccaaggtaggttgaggcgcggttgatgaacttggtgatgatcggtgataccacccatcctaaggcagccagcgctgctgcctccgccaaggaaccgtaacagatgttcccttggtttaatagtctcgtggctgctgcttctcagagtggaaagagcagcacatgaccaaaggactttctggacttcaggcctataatcaaagaagcaaaagtgagagatgagaacctgggagttatcagagccaaggatgaagattagtgctctcaaa

SEQ ID NO: 78313 - DNA, 51923 bp, Oryza sativa
ttcatacatggagtgaggagatatatgggttcgggatctcagaatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatacttatatcgtgtaatttcaattgaatgttgttgtaatgagtacctccgactattgttgtactagtagtattgcgaactattcggtgttgtatcataatgttatcgtgatgagtgttcggactagtaactgcagctattgttgtaatcagaaatattccgtatggtgacacttttgtttgtttgtactcttgtttaatatgtgttagtaattcgcttatgaacatttattacttatgttgactaattatttatatgtttctgaccaatctatttgatgcaggtatggcgtacgacacaccggcgctgttgaaccgtgggattgacaggaaccaccgctcgttcctgtcagcagtcgagggtgcacagctcgacaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcaggtagaccgctggagacctgagacgcacacgttccaccttccctgtggggagatggctccgacactgcaggacgtgtcgtacctgctcgggctaccgctggcgggagcaccagttggtcccgtggacggtgttgttgggtggaaggaggatatcactgcgcgcttcgagccacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctacgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgatacttacttcatcgagccatataatttacctcggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttatgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacaaggtactttactttttattaatactattaaatacatgtatgaaactgatggtccttgtccagtaggatttgcagccgggatcttcggtactggggcctcttcgtctcacgccggtaggactggtcctactagccagttctacgacgacgacttgcacggtgcacatcaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcctctacatagttcttttcattcatatggtgctagaacaacttatgctcacgacaacacactttcgtacaatggattgacacagtcagagttacttcaagtggcgggccgataacgcaacctgaaccgaccatacagttcattcatacttggatggagtacgaacgtcgggtggaaattgcaagcttagactggaggaacaatccattagggttacataaatggtccgagcgtccaaagtgtgggtgcagggatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaatagaccctaaaaaataataaaattgtattttaccagtcttggagattttaatcttgtataattttcaatataaaaaaaattgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcccgcgttgcggcgttggcacgaaagatttgtactccagacctccagttccttcgcaaatgtagcacccgtaacgacagttgatcaaacattccgtcgatcaattttgacgtgtttggagctgaggtatactagctaacccaagctggtgattggtatgtttcgcagcagcagtgaacgcgaccacgtttggcgccctcaattggtagtcccctaaccttttcatttcccggtctttcaagtctctttcgtatggaaaatatgctgctctgaactccaaccatgagttgtaaaaaaaaaaaaaaaagtccaattgagaactacaccggccggctaccagtctccatcctcgcttcgtgacattccacattaacctcagtgcacgtgcaccgtgcccacgactactgtatgcgactgcaacccactgcacaaaattagtacttttagtctggcgatagatctcaacaaatgcatttacgaaagatttactacgaagagatcgattggtcgaaacagcggatattttaatttgcagatgggcagatggtctgttgtattgtcctttttttttttctggagtccgtacatatcgcaacgtgcagccggactcttttccatttcattggattattgcagcggccgattaatggctccgagcttttacggtgtttataaggtacttcgaaatactaagagataggataatgtataccgttgattaagagagatgcaagatataaaataaaattatcgtaaacgatagcagtggggaaataactagtcaaatatggtattttctgtgagtcgagaatagttagctccatgtgattagtatcgttcattaggaagcaaactaaatcttcaaagatttagtggattgtattgtttgatagaaataaagtaaattttccgcaaatttagtggattgaattgatctgcatggggaaaaaaaacaagattgatgtatcatttgttctcctccaccgcttcgttcttgtccatggtcatgcttccatcctgccatcaagctccaatgcttccaaccactcccgcaccactttcgtcaataagttcaggaaaacggaatccctatcagttgggacgcgtggtgatgcgcttaggtgcccgcaaataccaactgaagcttgctacatgccattctttctttccctgactcatgcccttaggttgtcctttgtgcctgccttcacttcccgggggtgcgttgtgccacgggacatgtcttaccgccatcaccatcatcatacaaccaccaccagaacctcaacgcccttagcctcctcctcccatttgcccaagcttggacgagaagaagaagatgaacagtgttagggcactgtttcttctcggttgggtccaaccaactcccaaggactcccatgttattagataccaaatatatatcacaaaaaacacgtaaatgacacaataaaggatcatagaagataaaataccaatgcggtacctatgtaactagagctaatatttagacaattatacccttctccatttcaaaaaaaaaatatttttacccttcctacctaaataactataagttataacaatactcaaatactttttaagtggtatctttcattgtggagcgttggatgtttatcctttttaatacaaacacagtatgttttctcaagattttatttatcgtctattgtactgcttggatcaattggattttatttatcgtctattgtactgtttggatcaattgttctatgtagattatttttaaaaaatatttaatttcccccctacgatgaacaacaaaatctgcccgtcatcgtgtaaataatttaactcaccatgaaatcgtgagactggatcacatgcggcgtactttacttgtgttaaccgatggagaatccttgtttactccgtgttactactactccacccgtccagcgtcgtggacctcgtggtacgtaggagtacacgcagttaccgttcagtacttaaccccgtacgctgatctgcactgctccgcgctgcgctgtgcaactgttgcgacacatggcatggggcagagctactcgaaacgcgacgagtcttcccatttggcgacgggtatagccccgatgtgacgcgaccagaagggctcgatccgtcacttccacgagtagttccattcacggcgaagctgatgttcccgcggtgggttggtcttggccgacgaccggccggtggccagcctcacgtttcgatcacctgggcgcgacagatcggttcttgccgcatgctgatgtaacggtactgggtggtacgcgtacgggcggagtttctgtcaccgtccgtcggtccgtgccagagatctcgcgacgcgcgacgcgcgcgtgcacgggccgaccaggcgtcgccgcgctctgttgcttgacacgatcgggactgcgtccgcatgcgcgccgagcgtgacgccacggcgaccggcacgggacgagtggacgacaggtacgcagcattgcagcgttcgaacgaaacccagccgggataacaaagagatcgcctgacttacctggagagcacgcgctatccgaacgattgagaccaattttaggtagtgtttggttgctgggatgaggtgggatgggttggtccctagagaggaatatttctctcagatccgggaccaactcatccggccaaaactggcggactgggacgagcgaacggcgtgacgacgctgctcgcgcacttgccctgctcgccctcaggagacggcggcgggctcatcgacggcggcggcaacaggctcggcagcagcggtggcgacaggctcaggtgacagcggcaggctccacggcggcggtaagccacaggctcggcaacaccggatcttgtggtggggaaatcggcggcgctggatctaacgatggggagggctcgggcggcggaagatggctcgggcgacggcggaaggctccacggcggcggatccaacgatggggagggctgcgccgacggaagacggctcgggcgacggcggcaggctcggcggcgacggtggagacaagctcggcagcggcggcgttgaggggctcggcggcaccggatcctgtggtggggaaggcggcggcggcggatccgacgatagggagggctgcgccgacggatccggcggcggcccgaccgtccgtcatcgtccccgaagctcttggcgtcatcgtcccatagcttcacgtcccttcgtcggcccgaaggtcgacgccatcacccgccgcatcgcgtcccttcgcgaccgcagctcggtggcggagatggaggtgagggcagaggcggcggcggccatagttgttgccaacggcgtcttcagtggtggcaaacggcgtccatcaaatccctccctcatcccttcaaccaaataaaaaactgcgatcgtcctattctataaaccaaacacgtaagtagaatcatcccaacctcaaaataatggatggtttcatcccatcctatctagttttagaaccaaacactaccttattttcggaacaactgaatatggatatggaccgtgtacgcgcccgccgcacacttgcactccccgccgttgaacagtcggagtgtaaactttaaagagcgttgagcgagctgtaaaaattagcaagtgacggggaagtaaagtacccacggtacggtagctgaggagacacaaaatgtcttcggatgcctgaaccttacagcagtgcgcagttgtgcttgtgcaccaactcgtgtgagtccttttggtgcctgaccacgagtaaggtgttttagtttttcttaatttaagggagtagctatatttgtgacgtcatatttttcatcaaaaaataattagcatgtatttacattgtaagtccctaaattacatatgtaaatttagtgtatttataatgtaagtttcaaaattacatatgtaagtctaaaaattacacagtaattatatgtgtaagtggtgtgtaagtgggatttaagtggggtgtaaatttgtataaagtatagtatgcatgcgtgtaaaaccttgaactaatgaagacgttaagctttaattaatcaattaatcatgttgacagcctcaacgttagcctgccatagcaatatgcacggacaggatcgcattgacacgggataaaggaaatcggacgcttcaaaacgccgactgtgatggaggagaaaatgtgtcgatacaattctagcaatttcgtaatttaatcagtataagatccggtaccaacaggcattagctgatggcctggtgtcgatatggtgccaacataggatagaaatatgacaccttatagtactatttaacaaatatagtaaggccctgtttatccagggatgaaaagtttcgacgtgtcacataggatatagaccgcctgtattaaacgtagactaataatataacagattaataatatccagggatatacagatacacatttaaagtattaaacgtagactaataatataacaaattacagattccacctgtaaactacgagatgaatttattaagtccaattaatctgtcattaacaattgtttattgtagcaccacattgtcaaatcatgtagcaattaggcttaaatgattcgtctcgtaatttacacgtaatttgtgtaattagttattttttatttatatttaatactccatgcatgtgtctacacattcgatgtggcaggatgaaacttttgccaggagatctaaacaggccctaaatatttctggtttgtatacatgcttttatattgtattaacagtacctaagtagtcgagatactctgtattcctgttgaattgtcttaaaacaatgagaaaatctatcctgtatcactgactttgccctggaaccacaatctgccactgactttgttcagttccatactatgccatcgctttttgtttaacttctataatttaccatcgccgtcaagttagcctccgttagtaccatacaattttgttctaatgacaaaaatacccctaagatgaaaactttcagaatttggttgaaaattcacaaatatcatactgtaacatgttacagaggttgcccggctcattttcttctatgatgatacatgattatctaagcatacatatgattgttttagcaacttgtttgacggaatgttgcacttacaaaaagtatatctctgtgtatgtgtgtaggttcaaagcaggttaattaggtacatgattcccatgcatacatgtacgagtgcgagcacctgccggacttttggtcgtcgcatccctgtgtacacttaattagaattctatcaatacgtacgtatgtatgcggtcgccacgggcttgtgtaccacggacacagcctgcagtgcacgtgtacttctggccgtaattgaggcgggcatgaaaatgaaaatagattgggttaattttaggatttttgttcaggggtattttggtcattagtataaaattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatacttttccgatgtgcagacgataattaagtcacactgtgcactcaaactgtactccctccatttaaaaaaacgaatctattattatatgacaccacataatacaacagatttaaacaaatatatattacatatattattaggttgattttttttagagttaattgtatattggaccactaatatttaccttggttgcacattggactagaggtaaatctatcttttcacattgggcctgctaaatctacaatagttatatattgaaccggtattcttctccaactctcttctccgttgagttgaattgtacccaatttgtaaagtctccatacctgtcatctagctcaaggtcgctaccacaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccaacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatatgaactttttttatgattagtattttcattattgttagatgataaaatatgaataataatttatgcatgacctacctatttaaatttcttcaaataagacgaacggtcaaatgttaaatactagaacccagaaattgagttttttttttgggacgaagggagtatccgttaattgttggccaccagtgttcgagagagataagggatactgacactgactgacatgtgggccactagtgttaagtgaatttttggtaataatacctagcccaaaatgaaaagttgtgctaccacccagttcatcatgcaacaaaggtaataaaaactagtccattataaaatttactcttttttataggacagagtgagtggagtacctagagggagtacctagtactcccttcatctacttttaattgtcatatttccaaatctgaaaattttatttttgataggtatatttcaattcaagaacttatcatcttaataactttctcggatttaatacgtgactctccattcttccatacaagattagctacatgggcatcgagacatgtaaatattaatgaatcgtttgtttacgaggagtagaattacttatccttcatctgtgtgtcaggataaaatataacaatcaaaaatagatggagggagtagcatcttgcaagaaaacagatcagtgctacctatggacgcattgcagcactcctagacaggctaaacctcccgtacgtcatgcttcacacaaatcttcggtcgaatctactcctatatgactgcacatgtgctcgttagtctcacacttgacccgagaaagaccagctagatacagtactactagtcactgcccaaggcatgtctgcgtctccctcttggaccatgtactagctccccttggttggacccctcggtgctgtgtactcactccgtcaaaaaaaaaaaaaaaaagacaaatcctactttccgtatccaatgtttgaccgtccgtcttatttaaaaaaattatgaaaaaaattaaaaaaataagtcacgcataaagtattaatcatgttttatcatataacaacaataaaaatactaattataaaaaattttcatataagacggacaatcaaacattggcacgaaaacccacggtttgtctttttttaggacggagggagtaacttctggcaagtatcacagccttttcggggttgcacatgcgagcctttacgactatccctacttctccatgggcaggaataactttagggcttattaggatcacggtactgcaaaaacgtaggagtagaaaaatcgtaagaatatgatagaaatatatgtgtaaaacagaggattgaaaaacacaaaaattctgtagataggattggtaaatatgtgttcggataggcagaggaaaaacataggaaatggaaaaaataagatacgagtggatggaaattttcctttgtttctctattgattccacatgaaaggaatttttcctcttattttcctttgggttgattcctatggactgaatgtcaggaaaggaaatatttcctatatatagtattcccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaagtgacgaagggaggactcaggcgaggatgcaaagatatggtaaatagagggagtacgttgctagtgccactgttctttctcgctgatgtattaaacccgatcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaagcgatttgcgcgagggtggcgcgcggtggccggtgggcgtgccgggccgaggtactagcacagtacagcagtgcactgctgcccgatcgaagcggccgtcgcgcatggggccgtttcattattgcgatgcgggccgggagcacagtggcagtgtggactgttgccgcgcccgcgcgcgaatcgggtggaggcgcgcgtgatgatggcctactgggctgctgggctctggaatttgcgcggccctaccacgaggagcggtggcatggggttgtacggcgcgtgctgcaaagggaagcgagaaggggagcacgaggcagttgctcgctgcacgtgtccaggcaatctgttgatatgttttggttcttcctccttgtccatttggatttggatcttcgaaatcccatttgtatctttgtgagaaatgatagtcgttataggccatttatgttaaatttcagcattattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcagaggagcaggccgcaacatcggcacgccctcggcctcggcggcgggttcttcgtcgacctcctccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctccagcctcgcccaagaagagaagaaaggagaagaaagaaaaaagaagagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacgaaagcgtaggaggctaggagccgttccgccactgaaagagcacggatgacgcactaaccggcggcggggcagacgtgacgctcgtattagcgacccggcacgcggcgccctcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcctacgcatccgcagcacaaccacccccagaatcccgtggaatcagtcgagattaggggcaaaaacgtgagaaaagccacccgtttcctcaccgcgacagctagacggccgcgcactacctgcctgcctcctagtagtgggggagcgcgcggcgcgccgtcgtataacctcgcgctgagagcggagcggaatcggaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactaaaattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatttattttgttctggagtatgctaaaggtggtgagcttttcaacaaaattgctaaggagggaaagctcagtgaggattctgcgaggagatatttccaccaattgatcaatgcagttgactattgccatagtcgaggtgtttatcatcgtgacttaaagcctgaaaatctgctcctggatgagaatgaaaaccttaaagtctcagattttggtttaagtgccctggctgagtccaagaggcaagatggtctcctgcatactacatgtggaactccagcttatgttgctcctgaagttcttagcaggaaaggctatgatggtgcaaaggcagatgtatggtcttgtggagtaattttgtttgtgcttgtggctggttaccttcctttccatgatccaaatttgatagagatgtacagaaagatttgcagagcagacttcagatgccctcgttacttttctgctgagctgaaggatcttatacataaaatccttgattcagatccaagtactaggatttctatcccaaggataaagagaagtacttggtacagaaaaccagttgaaataaatgctaaaaacagtgaggcagccacaacaaacagcatctcttcaggtgtagctacaacctcaggttctgcagagtgcagcacttctgaggaaaatcaagggtccttaagcctcccaaacctgaatgcatttgacataatttctctctcaacagggtttaatctatctgggttttttgaggatacgcatggtcaccaggaagaacggtttaccactaggcagcctgtgacaacagtacttggaaagctgaaggaattggccaaacgcctgaaactaaaagttaagaagaaggataatggagttttgagattggcagcaccaaaggaaggaaagaagggctttcttgaacttgatgcagagatttttgaggtcaccccttcattcctcttagttgagttgaaaaagaccaacggggatactatggagtatcgaaagctggtcaaagaagatataaggccagcactcaaggatattgtttgggtgtggcaaggtgatgagcacctgaactcacaatctatcctgcaaggagagcagcagcagtccccattgccaccagagctaccacaggatcagttgcaaccatcattgccacaacaggagaagcaggacatgcctgaaccaccgttgttgccacaagtaccacaagaagaagtgcaaacatctatccccgcagaacaaacaaagaattagttttaacagccaactggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactgagccgttgtatgtaaggattatgaatccctaattgttggcatctcctgtcgatttcttgcactgtccgcagttgcgcatcgtctcaactcgctagtctaatgccttgctgaagttggttgaagacttgaatggattgccctttgttgatgtgctgactttccatgcattcccgtactgtttgcagcccccagattctgtaccaagtacaggaagagacgaggaagaagggtcgtcgcaccatggaaatggctcaggcgcagccagagagaacccagagaacccattgccggacctggcgctggcgaaatccgagtcagaccggataaaagccttttaccagacggtcctctcggccattgtcgtgttcatcgtggcggcgctgtcaggatacaaggacatgaagccgctctactcgaccacaaatcacaagaaagttcacctcagcaacctccttgtcatcgaggggttctgcatgattgctaccttcatatgcgcggctgttttgatgatgtacgagttctacacgtaccaccatgagatcgcccgcgaggtcgtcgcaggtgcagggacctcaccgtcctcatcgcggtcgccggagcgatgctggttgcgacggacacgatcctcgtcgtcatcgccaacagggacaacgcggtgttcgccgttcttttcgtgccggtgctgctgttagtcggcatggctgtgtacaccggagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcctgctcgcctctctggcgctgatggcggtggttgtctccgtcgagttcttggacggcttcgtcgtgctctccgtctggccggaggccgtcgcgctggtgctgtactacgcggcacagctctgctcggggcggcagcccgggggaggagtcgggagccggccatggatcgaatttgtcttccggattgtcgccaccgccgggttcacgctcatggccgggctgtacgcggcgttcctcgggaccaaccactacagcgtgtacctcaaggccgccatgctcgtgctcctgatggcagttctctcgagcctcagccgtctggcgaacccggtttacatgcccgagatcgacggagctctccttgagttctgcgtcgccggcgtggcgctcgccttccccgccgtgtcgcttctggttgcttgtcccttggtgcttaaggtcttcgttgacctatatattcatcatagttctctttgaaccaaggaggtgggtggaaccatggtactccctccagcccataatataaaggattttgagtttttgtttgaactgtttgaccgctcgtcttattcaaaaaattttagatttattatttattttttgtgacttactttattatccagagtattttaagcacaatttttcgggttttatatttacataaattttttaaataagatgagtggtcaaagagtgcaataaaaaactcaaaatcattatattatgggacggagggattaggttactaggtttggtgaggccgtgaggtttcccatctgcttgctgttcggacatagagcaaggataacattagcaagacatactccctccgtctcaaaatataataacttttagctctccggatttgtcccaaaatataacaacttttctagcaatattctcttcccactcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaataaataatataggaagaagagcctagagtctatatagtaatacaatttacaaacaatgaaatttccgaattaaaaataagaaatattggaagacgagtctagaatccatataggaatacaatttagaaataactaaaatttgatattaaaaataattaataactatcacgtatatacaatacggtatgaatattacacaatggtagtttggtaaagttagtaaaaaatttaaaattatgtcatcattttaatatattttaataataaattgagaaaacatatatgctattatataatagaaaatataatcatgccagccgcgtaatctatgtgggccaccatgctagttcatgcatagtaagaaaaagagggttggctgacctcagggtgtccgtgtcgctcccaccctagggcgacactgacagggggcgacatggacggcgaccaaagatccgccgccacccatccttcctcctccttcggccttgcagccgcccgaaaggccaccggcaaagccgactggctccaaggactacgacgacggggcttcgtatttcccccgagggtgccattctggcaggtggttctgaggcgacccaagtggaagaggtggtgccgtcgcccagatccatgctctcctcggccggatccggtgaggagcagtgacacgatttggagcagcggcagaggtggccgctcatgctgctggatccggcgacaatagtttgcgtgggtcgacgcgatggtggagggtgctggcggcggggaagagggagcgaagtggaggcggctcctttggccgggtcaggagaggagccatggcagggaagagggtgtggaggcgacaagcccggatatcggcatgaaggggcacgactggcggtgggaggctggcgaggtgcatggagaacgtgacacaaaggctcatggctggcaagcgcgacgtggaagcgacgaggtcggcgtggaggaggcgatgaggtcggcatggaggctggagtggtgtggagcgtgctaaggtgggagcaccgcaaggctgggacagtgtggcggcgaggcttccacggtgggaggacgaaggcgacggcggtgcgaccaggcggcccgttgaagagacacgggtagcttggttgaggcggtgacgatggtagcaccatgaggtaggcgttgaatgctgttacgagctcctttccaggcgtcagtcttgttgtggcgatggctagccacattggacgggctagtgggaggagagaggatccatttttctctctcaccctctccctctataacccacccacaaggatggatctggagcacgccggaggttgagatgctactttgatggccaaccggcggcgaggcatcggcgcggtggcaagttgaaagggattagctggtggtgactgttgaatttgacagatacttaatcaatcgttagatttgttttggacgaccgatatgtacaaccccccccccccccccccgcggggggtcccgcgcggcacagcgcccgcttctctggtctccgagtcttttacccctatgccgttaaaaagttgctgcttatctgtgtgccacaaaaaagtttagagtcacatgtatgccatgagcccaactttcgttgacccgtgtgccattttggatggatggagacataacgaggtgttaggggctgtgtaaagacagttttgtccttgtgtacaataacccatcggagccaccacttttcctcacccgggaaatcgccggcggcgagcccctcgtcctcctcctccggtgacccgcagcctcccgcgatgcgatccgtggcgaggctgctcgccgcgctccgtcgtgccccgccgcacccgatcctcctcctcctccccggccgtctcttctgcggcggcggcggcggagatccggcaatcccggtgctgccttccacgccgcgacgccccagcaacacatcgctaccatgccatcgccgtacaaaccgggggcgcatcgtggcacccccggagcaaacaccgccgccgccattttagccgccgccgttgcatagccgtcgtcgcccgccgctttgccgccgtctcccattgcttccaccgccgccgcacgacgccgtgccaccgcccgccgtcgtctctctctctctctctctctcttcctcccggccgcctccctcttttgcctccccggccgccgccgttccattcccggcgtcgacctccggccgctgtcaccgacaagcaccagccgccggggctcctccctctcctctgctcacgccctctctccttctccctgtgtgcaagaagaaagaagagatgaagaggaggattaaaggaggaatagagctgaaaatccttcaggggcaaattagtcattttccccacatgtcagagctatggaactgttaagttctaacagaaggtggacggaatggcacacgggtcaacgaaagtttttctcatgacatacaggtgactctaaacttttttgtggcacacatgtaagtagtaacttttttttaagttgcataggggtcttggttctccttctcctcgcgccgcctctactcactctggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccgggactgataaattatgtcctagaacattaccagttgctgcaactgcatgaataactgccaatttgtagtgctcgtatattggcaaacaatgaacagaacgccgttaaactcgccagacaagagcgcaatacaatttgaatccatccaaaagtcagtctcacccaaactcctgggcatctcttgttagttgtttcttccattctgtttagccaagcttacttagtttctttcaattgtgcagatacatgctggtggggttgtgttgattgggtggattgcagtaaacatatcaccttagtatgtcagaaaagcaggagtccatggcaaagcttctgcctgacgatgtgcttacaatcatcctccgttgtcttgcgccacatgaccttgccatgtctcgctgtgtctgcaaactctggtgcaccatcatcgacactcatcgcatgctgcgtgtggacctcctcccacactcagtaggcggcatattcatcaactttcatgatctaggcttgtcagaattcttcgcccgcccctcgacaggccccacaatatctggcaacatcaactatttgcctctcacatccatagttaggggccactgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgaccccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccagacataatttatattcttgatgaatcgtacggaaaaatggagtgggtgcagaagaacgctattagctgtctggtcatacatgcatttcagcaaactgatgggccctggaccttacaagatataactatcatgaatatcctgatgcgtacggacatgacaacagtgaggcaatagaggaacaaaactttgattgggactctgacaatgataattttatcaacactacagacgaaagaaatttgcgctacggtagaattacttttctaggatttcacccttacaaggaagttgttttctcaagtcactcattgagccgaggactggcataccacttaaataccatgaagtttagaggctttggcaagattcaagacttgggcaatcttggcccaaaatattatggaggatgtatgggtatccaaccattcattgaagagtcttttctgtgcacaccttggatgggagagttcccaaaggacattaattaagatctcatcttgaagattactacacaatgaatatggcatattgccttactgtcattcaggacaagtatctcaagccatgaagtatcttttgatagcttgtatcgctgagcttctcgagttcttgtaatttatctgctgtcggaatattatgcaagttaagagtccattaattgacactgaacaaacatcaacactcagtaaggagtcattagatggtactaattacagagcacggtgcatggtgttacgatttgcaagagcttttgctgtgtgcaatgctatatgctttctgtaatgcaatgccagatgttccaaaccagttatgtttattttatgtgtgttactcccctgtcctaaaggagattaccctctacattaatgttaagtactgcaaatctagatggactggtaatatttgtctctctctctctctatgtgtgtgtgtgtgtgtgtgataggccatatactgtggagcggcatgcttgtggcagatgaatagctaatagagtaatctgtgtgaaaagttccaacctttgacattatatgaagaaggttttgtataactgtaagttgtccgcacgttataaaccatacttaatcccctccaatcaaaggcgattgaggggaatactagttcaatttctcccccgattcgaggtgattattttgccaaacaaccccttgaaaatggcttgagagcgaagggccttgtgacaattgaggattttgtataactaaagtcgtccacattttacgaacagacaatgtttgactttttgagagcaaaatgatccttttatcccttcgtcagtttaactggaaatggttcgccgcgtgtccatgttctcggctctccccaaggaaaggctgtcactgcagaacagagtgtataatagccggccccatacggggcatttttggacgattgcttcacattgactctagtaagggtgtgaggtgagtcattagcacatgattaattaagtattaattattttaaacttcaaaaatggattaatatgattttttaaagcaacttttctatagaaattttttttgcaaaaaacacaccatttagtagttcgggaagcgtacgcgtgaaaaacaaaactatctttctctctttctgctgcgctcaaacgcagcctaaatatagtttgttaatatagaaacgaagattacttacttatctaagcagcgtaggctgattataaactgtatggcttattaggaaaaataataatttgtgagtaactttcatatatatatgttcttaatgattaatggtaatgctgaaaacacttagattaaaaatacatcaacgtcaagttctaaatttaaattcgatgaaaatatatcaaaattaagttttaaaaatttaaatttagtgctgattgcggaccttgtcgattgtttggagtttcaactttcacggaaacacaacgaagaggctagcaggaaggggaagccatcaggcaatagaaattttgtactccatttcaggttataaaatattttaacttggatcaaagtcaaactgttttaaatttaactaagtttacagacaaatataataatatttataatactaaattagtttcatcaaatcaataattaaatatattttcataataaatttgtctttggttaaaaatattacttttttttacaaacttggttaaacttaaaacagtttaactttaaccaaagtcaaaacgtcttataacctgaaacggaggtagacggaggtagtagtacttaagaggtacgaataggtaccaattttttttattgcaaatttggtatatcctattattgaggtaataaattttatataaaaaatactctaaaaatactccctcagtcccgtaatataagggattttaagctttttacttgcattgtttaaccactcatcttattcaaaaaattttagaattattatttattttttacttactttattattcaaagtattttaagtacaacttttcgtttttttatatttgcacaatttttttaataagacgagtggtcaaacagtgcaagcaaaaactcaaaattccttatattaatattatgggacggaggggacgggaggagtatgatacaatacactgtagaatcactcataaggtaaagggcctttgtcatttgctaattgcttgcagatgttccaaaaactactactactaacatagaagcaaacttaaattgcggctgcttgttttatcctgtggtgaaaattagctccgtttgaataactgaaggcgtatgctactctaaaaagactaaaaatgaatctgcaccatcctcccattgcagggcagagctagaacgagatgaggggtgccacctatttaattgagtaaattacacgagcgatccttaaacttgtaacgaacttttacttaggtccacgaacttgcaaaacatgcatcaagatccttaaacttagtttaatgtatcatcacggtccaaactctgatttgaccatggtcttacctatatggtatgccacgtggacgatgacatggctaaattttctttttccctttctttcttcccatcttttctctccttcctcacctcgcgtggagaaaaatgcagcagaagagagaggaaggaggcaaagtggagaaaaaaaagagataagaagggagaaaaaaagaaggaagaagggagaaaaaaataaaaaaatttcatatcatcgtctacggagcatgccacataggcaaaaccacggtcaaacaaggctttggaccgggatgatacattaaaccaagtttaaggatcttgatacgcgttttgcaagttcgtggacctaagtgaaacttcgttacaagtttaaggaccactggtgtaatttactctgctttatatcaagtttaagctaatacaggtgtttaaatttgtattgagggggtgcacatcagtggtggatttaggccatttctgcggggtcggctaaccccacaactttttaaaaatgtcctataaatctcaatttttatgtataaatccaaaagaatttagagaaatgaccccacttaaatacaaaccactagtaattgaccccacaggtttaaattcctggctccgccactgatgcacatatgataaaattaggttaggtatagctacaaacttttcttgaacggattcctggccacccccctcagtactcctgcctctgtccccatggcatgttacacctaaagacactattaatatcatatctaccttcgacatttttcactctcgcactctccatgatgcatttttttatccgtatttttcaattttataacggtgtaatgataatattgattcctagtagtttatattactgatcaagctttaacgtatagactatgaaaaaggaaaagttaacacacgacaacgacccattgagaacttttaaaacgaaattgccaagaagattagtggcaattgtttttctatgttgactagagtccagagagagtttagtcgtcccctgcatttccccatctcctcctctgagcaactatatcgagtttcgactaccatctcagcttcggtctcgtattctcgtggatcatcggaaagatgatctctacggaagaggactctgattcttttcaggtaaagagaagagatctcttttatcttgcttcgtgcttgttttgtttgtagctttgtaccaatcttttcgtccaatttcatggatctagaccaaaattttcgtgttcctaattagtttcttttcatgattgttttatgatgcaaatctaactgccatgtcaattgttttatcgttagtaaatttcttattgttcgcgtccgtgcttttgaagctaacagcatgatttttttttcgaacgcagctaacagcatgatttggctagtcctttaaaacatgtgtataaaaatcatatgtacatatattttgaacaaagtcacctcttgttaagagagattctaatgatataaattattttaagttatttgcttattagactctgccgagatgctgaagtaacttgcataaagccgataagtagagaaaggagtacagaaaaaaaaatcaagatctaaactctgttagcatggatcatggacctgtttgaaatactgtacagacaactctgacaaaattagttaaccagtagtacagctttcttttcttaggaaaacaactttcttttcagagagtttcatgtcttgttaccaatttctgtttgattccatctctgacatatattcagtgtgttgggacttcgagaccacagcaaaatactacttgggcagctttctaatagtactagatttagctaataagagaccatttgtggatctaatcgccttctgaaggcgattagctagttttactcgggagataaaacatggaaataactgagaaacataaagcctccgccggccattcccgttaaccatttccgctctttcttcttaatctgcctgtgggcaggcacgatgtggtgttcagacatcttcaacgacttcttcgtcggtgtatcgatgatgctttcttatgggtttagcatttaaagtgctaagatagaattgtcctcatagcctggaaaaatattctattgttctctcccggccccaaaactctgctaatctgttatggcaaagctgttggtttatgcctgaactctgatagcctgtaacccgttactcacttttcaatggaaaattcaggtggagaaactcttaccctcgagtgatttactcccaaaaaaaaatggaaataactagtgataattttttttaacccttcccaggatgacagcgaggaactgcaaatgcaggtgacaaagaagacgttgaagcgtgtcatatcactagccgaaaccttcatcgccatagcaaccggcatcctcgcggcagctttctcggcaggcaaagatgtccacctgcaccgccacgtcctggccgccggcggctgcttcctcgtcgtgacatacctgtccgctctcctgctcatctacatgaagctgttcttgtcagatcacaggcggctgcgccgatggcacgtccggtccctgcagctcctgtgcgtgaccagcggcgcgtcgctcgtcgccacgaactccctgctcctcgtcctcatcggcgaaggcaatggcttgctgtcgctcaacctgctgcccgtgcagggcatcgtcggcgtgctcgcgtaccacgcgacgccgacggaggggagcgcgcgcgacgaggcgttcgaggcgcaggtcaagagcgcccgcaaggtcgcgctgttcgcggcggccacggccttcgccgtgcagaccacgctcgtgtttggcgcgttcagcaacgccgccctgcaggcgatgggcggacgccggctggacctctcggtgtcgttcctggcgtcggcgctcagcgtgttcttggtcgtggcgacgtgcatgccgctcgggttcaggaaccagggcgccagggacaaggtgctgtccatcgtgaggtacctcaagaaaggcgtcatggccgtgctcgcggtcaccgcggtgactctcggccaggagttcctcggtggcgccgcggcgctcgcgctcttcccggagatcaccgtcgccgccatgtactacgccgtgagcatgcccgccgacgaggcggccgcggccgctgaccgcaagatggaggtgcttccgaccgtcgtcgtggcgacgttcggcttcgggatgctcggggcggcgtacgcggcgctgttcggcacgccggagtacgacctgtacaccaaggccctggcgttcaccctgctcaccgccgtcgtgtccagcctgggccgcgtggcggggccgctctgcaacgcccagcgtgacaagagctcggcggcgtgggtgacattcctcagcagcatcctccccatcgtggagatgctggtcgccgtcccgctcgccgccaaggtaatggttgattttctcgccgttcctggtaatggctgattttctcgccgtgcactcactagcacttgatgtcttgatcacttgtacaaattcttcgaacacgatacgtgcatactctgacacgcaccatgttgttgttgtactttactgactttgtacaatgtcatgtacttatagtagtggacctctcttggacaccctgaagagcacatattttttgtgtgattttgtctgaaatagtactgctaggagtagtatttgccgcagcagcattgcggagttgccaacgcctcgaaggtattcatgggcttattagattgatgggctgttttgtacagacaatcacggccccggttggctgtcagcctataactccatcagattgtgtggttttggtttaaaagaagagcaattttacaattcgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgcaacgggccggagttgtagtgaagctcttttttttttccttaacgaacatagcgaagcttgagtatcagaacaaggcattttatacgcatggggatcacatgatgatattaaactacttgaccgacacagcgttcatccgtgaaattatcgcccaaaacgcaatgcctcgtccagccagtagtacatcggctctgggtttcttcattatagttcagttggatcgtcggtttcatctagacaagtatccgaagtaataatctgtcgcatcggtcaatgactatctgctactggctgatgcagggagcagagcatactctgctctcgcaacgtaccgattgacgtacatggcactcacagcaatgcagcatcgtgcagtggtcgatcgacatggtgaattggcgatcgggttggctcggctcggccgtgaagcaagcaagcgtacgtgagcacgacaagtgacagccaaccaccgaacacgatccgctatataagacgctgcatagtgcgcacaccttcaagctcgtacatgtacgcaccgcgacactgcgagtcctgcaagaagccaagccaagcacacgagcgcagcagcagcagcagcagcagctaagctagctagcttggagagatcatcggagatgcctcccaacgcggcggaggtggcgcggccgaagagcccgctccggggcatcctgccgcagagcccactccggatcaagcaggacggcaagttctacgagcggctcctcgccaaggagaggtcggcggcgagccgctccttccgccactactgggccgccgagcccggctcggtgccgttcgtctgggagtcgcagcctggcacgcccaaggtcgacgtgtcccggatggtcgccggcgcagtcccggccatcaccccgccgccgtcgtacctgctccggcacggcggcaaggctggcgcggcggcgccggcggcgccacgccgtcgtccgcaggggaagggcaaggcgaagacaggcggcaagacgcggtacaggttcaagcggatcaagatcggcttcctcgccggcatcttccggaggatcgccctcggccacgtgtggcggcggtcggcggcgtcggtccaggtctcgtcgttgtcaagccggtggctcttctcctcggcggccacggcgccggagaaggccgaacacctcgaccacgacacgcccgcgccaccgccaccgccaaggccgaacaccgagctgtccacccgggcgcgcgcgcgtccgagcctttggatgctgcgatttcgcggattccgaagctggagccgcgacgacggttgggcgtaggtcgctctcgacttctcgagtgtatacgtgcgtcatcatgggggattagaacgtgacaaatgaaatgtttatggttgcgagagatgttaacggttgtttgtatgcatgctgttgttgcctagcgtttcatggaaatcatcattaattacgcgttgattatgtttacggatgaaacccgacgtgttcggaacagttgatcatcttttgtcactagtttaacagggtgattaaaaggatcatacacaataatctgattagtacgcttggtattttctgtgataaattaattttattttcccatatggtctcagatatgtttggagatgtagcaaaggaaatgtttgatgtgttcgcttcggtttatcggagatgtgatcagtacggtacggttaaagattcttaattagctacaggccctagattgaaagaccaagaacggctatagagggggtgaatatagcaattcaaaattcacccttgaaaatactcatcaaaacgattttctcaaaattcttactagaatcgcagctattagaaaagccggacctagaaaagaagagagaaggaattcccgaaactagaagagagatgagaggaagatagcaaatctcatcattgcaaagttcaaatcgcaagcagaatttaaattgtagaatttaaatggacaaggcaaaaataaaatctttcaaatcatctcattcataggtgttgcaaaataaccgctcaattaggagcaaacatacaccttcatagaaacattaattcaaacttaaaaacctctcgggcaaacacactccaaactcacaccgaaactctctcaccgagcatcttaaaaggattacaaaaggagcaacctccacccttacatccatctctctatttatagcctaataccccctaagacattgtctcaaatacctcatacctctagggcgaaacccaccctggactcaatctcagccacttgcttttccttctcctcaaaggaatagctccagatcgctgccacgtagtcaatccgaactcctccacgctgcactcccttgcacgatccgcgtgctcctgctccaggccagtaacacgccgccacgtcgcgcctcagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagacttatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtatcgatcaagaaccagatcaggtgctgatcacactagtttggtttatgggctgatcaggtgctgagttgccatcctgaaactagcctaacagtgaagtatagcatagggttataagtgtggccgcctctgtttcggcatttggttgttgagcttaattcgtgtaggtaccttgagactgtgtagaagttcaggcgaacagtacagggagggggccgtttggactgagtagggagttgcaagtctgcatgagcaatggcagcatggacacatgcatcgtccatgcgtggcggcgccgacgcccacgtacattttgtttggtggattggaacagcgacagcttcagaattacgtttcgctcaattgtacacagttcgtttcgatatatcttacactgtcaattagccggcttaaatacataattaaggaacgtgtccttcgcgtcaatgtactgagcagtgagcacgtacgcatcttgcaccttaaagtagaaccactagttagcaccttgcaccttacccccagtaaagaattacattttaatcacataaaagaaaaacaatgcttcctccgtttcacaatgtaaatcattctagcatttcccacatacatatctatctatattcattaacatcaatatatatatgggaaatattaaaatgacttacattgtgaaacggaggaagtacctactttgagaataatgtgggagaattactcggactcgaacaagactcaaccaaagactgttaagaacagaatacaggagaacctagggtataaaggcctagcaccagaaggaagatggaggaggaactgaacagaacaacaatctactcaaaccttgatgctcacaaatcccaccgcgatatccagccttcgatccatcaagagccaccggagccgagttttcatatgtccgaccaacatctcgttaaaattcctagcaagactagcacataggcttaggataggcacatatatcaataaaagtaataggcctacccaaaccaataggacgtagggttattatttcgagtaggccctaaacttgtataaaaatgccacgcgtcggactaccatacctcacacaagaaataagacacacaaacaagattcaggtcttataagtttctattgtcaggatttttatcaacaacagcttgagccacggtcaagctaggtttgcacaacataatctagcttagttagcatttgtttctccaaccaagcctagcaacttagtttgcaaaagtttaactaggtgtgctttttaaccatcgattcatctgttggcctacatcatgatgctatagctagtcataaaaaaatgtataaatcatctcctctttcctcctcatcgctccctcccgagctcagctgatgtggcagcgacggcagagttggcgctagagaagagaggagaggaggcagcggcaccaaatctagtgcagtgttggcgctcatgacttggcaggagacaagggctaccaggtgcagcctttggggaggaaatgagagacgacggagttgcattggggttcaagttcgacatggggagacccaacaagaagttggcaacccatggtgctcttcttctagaggatgaatacgtgattgtatggtggcttcttccgaaccgcgttggttggcaagaaggatgaagtagcaagcgacttttggcccgatacctatatatggccagcgtggttgggcgagacacaagtgctacaatgacgaggagctggataccagttgcattagagatagttatgtggctttgcctcttcaaattttacattttggagtgagatgcaagtccattgaagattgcctatgaatgcaattgacataatcaacctactgcagtaaaaagacactgctctattaatttgagaggcaaaataagcatcaacctatcgtcgtcctggctactatctagatctatatataaattgcacagtgaaagtttgttcgaagtataaaggtctacgaagctacttcctccatccaaaataaaaacatttctgaagttagacataggcatgaagaaagtatgtgtaaatgattaaaataaggttataattagttgagaaataaaaataagtgaggaaaataaatggagaatagttatggttggttgagatgaggggtgtagatggagaaatagttttattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctcctttaattaactcagacaactcgaccaactcacgtgaccctccgatagtaaagacaaagcgacgactctggttagggatttagatcaggctagggagggaggtagtgggtttagaaaagccaagtgatggaggctataggagagccgagagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtagttcgtggttaaaacttgaaatcttgcattgtggtttgcatctggtccctctcctgaatccatgcaagaaaccctaaaaaccttcttcggccctttccaatttccgccagggaaagactcgatgagatcggcaagaagatcaagcgagagccggacaccgccggcgtcgtagtcgccgccgtcgcaggcaccggcaccggtacagccacgccgatcgagcaccgcgtcccccatcgcctcggcctcggcggcgccgtgaacaccgtgaccccgtgcgccgcgtgcaagctcctccgccggcgctgcgcgcaggagtgccccttcgccccctacttctcgccgcacgagccccacaagttcgccgccgtccacaaggtcttcggcgccagcaacgtctccaagatgctcctggtacgataccattacaggtcaaagcattccttaaattgtacctttcgctagcttgtgcattaatggcttcgtcggtgcaatgcggtttcaggaggtcggcgaggcggagagagccgacgcggcgagcagcctggtgtacgaggcgaatctgcggctgcgcgaccccgtgtacggctgcatgggcgccatctcgatgctgcagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgtttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgttttttgtcctcggatgccatctcatttctttcatgtcatctaaataattacaaaaagttttgaattttgttacaacatatattaaaacctactagatcggtccacaaatatacaagtttaaatcaacttttacaagttattaacaataataacatatataactacgaatatgtgtatatatactagttagagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaaattaaactcatccaactcggcagagtttataaaaaaaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaaaaatgaggaatgcaaccttgttgcatgaaaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttcaggtggtgtttggatcagggatttaactttagtctctgtatttagacattaatttagagtattaaatatagactacttacaaaactaattacataaataaaagctaatttgcgagacaaattttttaagcctaattaatcaataattagagaatatttattgtagcatcgcatatgctaattatggattaattaggctcaatagattcgtctcgtaaattagtccaaaattatagatgagttttattaatagtttacgtttaatattaataattagtgtctaaatattcgatgtgataaagacttaaaagttttagtcccatctaaacagggtcttattcggccataccttggttaaccaagatgactgaattgctattttatttgtcctaatatataacaacttagtattaaagtattaagtattagataacctagcattacttcattcatagtgctagatggtgtacaatctagtgtagctggttgcttctcccctgtcacaaaatataagaatttaggaccaaatgacgtattcttagtgctacaaatctagataaatacaagagtctagaataggatgatgcattcttaatactatgaatctggatgaaataagttcttgtattttgagacggagggaattctgaataagattcgtagtattaggttgtgactaatttagtatatatgttgccatattttatgatggatgaagtatattaatattggttactattatcttgtgctatttaatgggtggctaatgggcgggtgatcgctgtgggcgatcacccgcccattagccacccattaaatagcacaagataatagtaaccaatattaatatacttcatccatcataaaatatggcaacatatatactaaattagtcacaacctaatactacgaatcttattcagaattccctccgtctcaaaatacaagaacttatttcatccagattcatagtattaagaatgcatcatcctattctagactcttgtatttatctagatttgtagcactaagaata

SEQ ID NO: 78314 - DNA, 3874 bp, Oryza sativa
  unsure (1)..(3874): unsure at all n locations
ctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgattatgacgggttatcgtaagaaactcggcaatcagtgctagcttctcgaagcactaggagggcgttggaaagagggtattagctaagtaatcgtataactaggatgtgtatataatgtgtatgtatattagaagtgtaggaatagattctttctactcttgttgtgtgtcactctaccctatccattatcttaaccactgcttagactttgattattacaagtaaaatataagatattagtatagttctctctattataatctttccacgggattaaacaaatacgatactcttggaatactcttgggtgaaatgctacaatgatatatccatgcgcttgcggatgaattatgtaaccataatataccatgagtatttctacgttattgctaggaattacacttctagtaatgtcgttaacaaataccaacagtcgccttgagtggttggagacagaacagatcatagagtatcattctctcattctttgcttaactcttattccaaaatttttcaaatgattttgcaaataaaatccaagttcctcaaatgattctctcaatcactcgaagtgtatatttattcctcgccaagatattgccttgagcttgcttaggagtgagttttacttcatttcttattcatttatgtgctaatctctgcaaacaaataatactccaagtacaagtggaaatatattattctaaaataaatatgcattgcaagcatattgacggtcgaaactagtctataatgaccgtcaacaacggcatcgcaccgattagaccgacaggaacgtgtcggtcagaccggcggcagcgacaggaggcagaggcgatcgcagggcggttcggctgggagatcaacaccggttagaccagcggcataggcgcggtcagaccggcggatcaaccccggccagaccgatctacatcggattctagggtaacttttaattccattaaaagtttagattttcggctagtttagttcttgctattcgatcctacaaatgctttaagaatgtaggtttaagatgaacctcgtaacaaaaaaaaccgtattatattatatttatttatttataaataaatgcatgtgcgagatggtgatgagctaaggcaacatttttttcctattgattaggggttaggcagggcaaaaagtgtgggtggggcgtgggatttggcaagcgaaggggagaaatgcggtgggggaaggggaggcaatctgtcacgcccagaagtttccccctttttccttgctgtaaatatttgttaaataaatcgtctgaagaaattatcttaattaacctagagctaattccataattaataaatgcaattaataatcggaaatagcgtggtggaattgttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgtgctcggcctccttcctttgggccggcccgttcccctttcccctctctccgggacgctgacaggtggggcccacctgtcaggtcgtccccttcctccagccgcccgccccacgacggcaaccgccgccgaaaccgtccacgccgccgccttctccgctccatgccgcgcccccactccacgtccccacgtcgccgccctccccgccattcctgcccgcacgcgcgcccgcaaatgggcgggattcgatttgaattccccccccccactctctctctctctctccccccacgtcgccggccaaatcggggggtttcccggccgtttccgcccctccctcgcccataaaaaccctcactcgagctctctctctcatttcccccattcaccgtactatcccacgccctctacagccgtcgcgccgcgctcgccgagctccgccgtcgccgcccatcaccggccgcgtgccgtcgacactagggccgccgtcgcgccaagccgncgncgncgctagctccgccgccgtgtgggccatcttgggcaccgcctcgcgtcaccggaaccccaccggaaccccatctccctcgcgagccggtgagctatccattctccttcgtctccggccaacaatggtggccgccgtggtcactctctctactcctaatccttctcaactccctccgtaggtgccgccgccgcccgtccacccctcctcgtcaccaggtcgtcgccgccaccttcatcctccgctccggccgccatactcaccggtgaggatccccccctcctccctcttcccctctctctcatttgcgccgcctctctccacgcgcttgccgtcgccttcggtcgacgccgccgtcctgtaccccgtctgccgtcgcttcccgcgccgccgattgccgtcgccggcgaccgtgcgcgtcgccgccggttgccatggccggccggccggatatgaagccgagctgagccgtgcctagccgccgccgtgccgtccgatcggcctcccggccgatccggaccgtcggtcccgtggaccggcggtggaccacccgcgtggtcccggtccacggtagaccggccaccttgagccactgcccgtggggcccatatgccggcgcccccttcctcttccctttgagcccgtgacccgtgggccccgcctgtcggcgccccctggatgacgtcagcccctgatattattgcgccataataattaaggactttttctttattagtaaaaacacaatttatcctcttaaatacataagtaattcattccagcttcgttaaggtcattcaaggctcagtaaatcaggaaaatgcaaagaatctatttaaaaatggggttgttttctggttctataggcttatagcatggtttgcctgtgtgccttggtttggccataagtttttggcccgttcgtcgattcgcgggttttttgaagaccttgcttgaggcttattagttcgagagccaagcaaggcatggcaaaacgtttgatcatattgtgccccaattcaaaattcccgcattttttttaaagtggctttttttacaaaggatgggggaggggccctttctcaaacccatattggtcacctatgcactggtaacttggtttcaaaatgacttaaggtggcttaggaaaggctatccatgctttgttcaacaagtccacacaaggggcgccactttncataaacatcggctttgtgctacaactaaaaagaggcccccccggggggcggcgagtaaaaatatataatatatgactttgaggccgtggtttttttgttcccctgcgggnataaaacgattacggaaaacattcggtggatatggtgtgtctctc

SEQ ID NO: 78315 - DNA, 1671 bp, Oryza sativa
taatctttataggcattcgaagaggaaaacctgcaccgtctaggacgccctgcaacaaggaagatggattaacgacgtccgccacagcctcaccattcctcttcttgatgaattcttccatgtttgggaaattttagcccgtgacaccccacaactaacagagggggtacaagactcgattgtttggcaatggacaactaatggggaatacggtgcaaaatccgcgtaccaattccaattcaatggaatggtactctcgccatcaacaaagttgtcttgggaggcatgggctccggcaaagtgcaaaatctttagttggttggttcttcaaaaccgggtgtggacaactgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagagctctcttcttgctcattgcttgggaaatctggaaggaacgaaatgcaagaatcttcagagcaaaggaggcgacagtacaccagatgattaggtgcttatgatatgagtccgaatataattctattctaacatttatgaaaactacaagtcctgctcatcgactacattcacatattcatctcaaactcaacatgttttcttcctacatctcatggaataggttctccgaggcaatgcattcaggaagtaaaagcctctcagcttgatgttgtcattggatccaaccacgaaagctatcttgttacaatgacatcattgaccacatgtaataggcaggggcaaagctaggtaggaagggggagggtgcccaggaaccagttaagaaaaattttttagctacaattcatctatgttcacaatatgtccaccggtaccccctcaattcaaactcgagactcgctccggtgctttctacttggagtagaaaataatcccggccattgatcgtatttaatcgtaggggtgagaactagttctacttccaccccaatttattggagaaaaaatgtgggacggctatatttgttccaccgataataaatcacctaagggtattaatcccaaaaccggcattatctaactgttcaccctgtccctattctattctaatcgaggccatttccctccatttgcccgccaaaaacaaagcccacagccttatctgctcgaacccccccccactgtttgtttgggaacatccccaaatagttcatgaaaaaaaggtttctcaaagcgaaaaataacctgccttccttaaaaaaccaagtccccgacccccttttggaggagcgtaaaacagcggctctctgtgtaaaaaaccgcgcccaaacctatccctggcaaagaagacccaacccaccccccggacaaatggaatttccccccccgcgcggggtacccgccctcttatggaactcttattcaaaacccccgacacaaggccttggtgtttctcccactcaccaagtttttaacccctcccctttatccgaagcgagccctcatctttgtgggacttccg

SEQ ID NO: 78316 - DNA, 2063 bp, Oryza sativa
ggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgtttcatactcccaaactgcaactcttctatcgctcgctgacggagcgaggggctcctcaccaggagaccgcgcaggcccccctttgccagttcggccggggaccctgggtgaggttctaagctcccaatctgtggaaggttcgccagactggaaacacacaagacacgggcgatgtatacaggttcgggccgctgagaagcgtaataccctactcctgtgttttggcggattcgcgtatgaagaagctacaaagtgcaagtcagcccccgattctcctgggatcgttttttcctcctcctcttttctaagtgggcaaggtcctccttttatatctcaaggggatcccacatgcaccatctctccctccctttctttcaacttgacttctcttcattaatggacggagatttgcatcgctgccatccgaatcaccttctgacgggacagcccatacctacctccacttccgccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggagctaacacgccggctccggctagggacgagtgcttggagactctcgtcctgactggacggggcgaggcgtgcgtcagaccgcctgtcgccacctgacccacgatctgaccggtctgtgactggtcacagaccggataaacgagcgcgctgcactgcgttacacgcggcgtgacgcgttcgtccaaaccgcaataaatgcagttaggtgagcgccactgtgctcaccaaacccatacacgcggcgcaaaatccacaaggggtcggggcgccccagccctcggggccaaggcgggagcggtccgaccccctcggggagacaaagaggagggcgaacacaccaccctcgggcccgacgccccccccccccgagggtgccaggccacgtgggcgattgtgtctacctcaagcctctagtcacgatactcccggtcccatgtcatcgacagtagcccccggcgttatgccgaggcgattaccctcctcgagggaagcggtcgggcgtgacgccacttcctaaggcctggtgacaggtgggaccggtttccacagttgggcagaaacccaacagtcgcaaatcacgcacatcggcaatggttactcggctgtcaataatgaacggtctcttcaagactgccacattacgcgcgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggataagtggaagagtgggcgcgagaatcgagggggcaagatagtgggcgcgagaaacgaggagccgggcacagcgttggcaagggtataaagtcgccgaggaagagatttgcttcctttctctcgccattattccccttgtcttcgccgcttgcgccctaactccttgtttcatgtgccctaccttcgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccaggagatagtctcgctgggcgaaagatgcccggcgccacgctacccggggcgg

SEQ ID NO: 78317 - DNA, 3049 bp, Oryza sativa
  unsure (1)..(3049): unsure at all n locations
agaaacggtctctggtgcccacggaacaccttctcacaccctgtgttgttaagaggtaacacggttgagacggccccatccattttaaaattacaggtctcaaaacgaaactccaaggggtccgggaattggtctggttggccgccctcatttctaataggatggaaccgtggctttaaccggcgcaaaccccgaagagagaaaggcggccgtgcgacaatgattgtggatgccacacgttggggaacgaattgggatccaccgttgtggcggcgcgaaattgaagaagggccgcggctatcatgatgggcncggtacgggaatatggggcggcaaatgttcggcggcgcaaaagaaggcgcgcccccctggggtggcgtcgttgcgccccacgcgggggaagaaaggcaagcgccccctgggcgtcccctggggggcgtcggttgcgcccaccggcggcatcggtagcaccaaaaggccggcggtgtccgccaaaaagggtgacggtttaaccggcgaaaacggcggcagcagcgaattcgtgggggcggttagggttaaaccctacccccccgacggcttcccctgcttttttgctgagggccggatgggcgggcccaccgccccccttgcctgccagcctagtgccacacggtggtaggccgaatcctttagatttcggcccacacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattctgtattttgatttagcaaattctcttaattatgtacaacataattaatggaggatttaatacatgttccacttcacactttgacttggaaattaatcacatgtcgatggagtcctatactttggtcatatcgaccataacttaggcaacgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctggagaccgtgttttaggcagcaagtataacttgcccaccattaagagatctactccactgtttaattacttggatattatccacattgtgccacctaacattacagaatatgaagtcttacatttcgcattgagattacaaccacaatatcatgtttttattaatttacctctgtaaattaataatgttaaccatgattgtagggacatggcaacaaaagagttcgacgaactcgccctcgatgggactaactatcccatctgggcttctgatatcaaaatcaattttgcctctcgggggattttaaatacaattgaggaacccaatgatggggacccagcaattgagcccaggaagctcaatacagccctttttcttttaagactctacattcacaaggatctcaaacatgaatacatgttagagacgagccctctcaacctttggaaagctctaaaagagcgttatgatcagcaaaaggaactcatttggcctgaggctaattatgagtgggttcatttacgcctacaggactttaaaactatggcagaatacaaccatgctgttcataacatttgttccaggttgaagttttgtgaacaagagccaacggaggtagaaaagatagagaaaactctatcaactatgcttccggaggacagaatactgactcaacagtatcgcgcttacaatttccagaaacattctctgcttatacatacattgactcaggcaaaaagacaccatgagctttctttaaagaatgcccaatagcgcccaccgggctctgctccactgcctgcacttcaatgtacagaataatgctgagaataagaaaggattcaaaggaaattcttcgaataatcctaagaatctgactggaaagcacaaacgcaacaacaacaggcgcaaattcaagggtcggaagaaaggaaaagggaagggtaaggcaccacaacctcgtagcaatggcaacaagcattgcaacaggtgtggatctgacactcatgtcgctaaaggctgccgcatcccgaaacatcttgttctcttgtaccaaaaatccctcaaggacaaaaaaatcttctgagaacccaagatttgaagcccacttcaatcttacacatgaagagtgccctgaggttgcaagttctcaccaggctcctgctgacccagagagcaacctcaatgttctcccagaagatgtcgctccactctctgcgatggatgatatgttcatcgaatactgctcaacggacccacttgttgatgcattccacacttggcatgatcgacttgggcaccccggtatcgagatgatgagaaaaattattggcaactctattggtcatcatttgatcactgataaattttccaaaccctctgatttcgtatgcactgcatgtgctacttggaaacttgatttgagaccatctttatctcaaattagagcagaaccacttaaatcncttgacgcatttcaggagatatctgtggccctattgtgcaaantcttgacccgtcaagtacttnatggntnttgattgacgcatctactagatggnctcatgtgtgcttctatcgcacaaaaccatgcttnngcaantatgtctcaatatanggtgaggcaanntaccctgactangatcaatcatctgttgcatgctgcga

SEQ ID NO: 78318 - DNA, 8091 bp, Oryza sativa
  unsure (1)..(8091): unsure at all n locations
tcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatccccgggatcccctctatcttttctcttatggaatcgtcgccaattcggtttggaaatccgtggattcgagttcaattcagatcgatctctctcctccgaaccctaaaccttccatcgcgtcaccggtcgccgtgggccttcgccgtcgcctccttgcccctataaaaggacccccaagcccgccgctacccgccggcaccctcgccttcgcctctcgtcgccggtagagccctagcaccctgtagcctagcgccaccgtcgctgccgttcgtccagccgtgcgccgccgccgctccggtcatcgtcgtcgtcgctcgggaaggccgccatcgtgatcaccaagtcgtcgccgacctcgtccgcccctccgccgtcgctgtcgaccgccggaacaccgccgtcgtcatcaagccgaaggtcgccgccgcttcttcctcgacgccatcgccgtccattgatcttccgccgttgttttggtcactggtgagttcgccgcgtcgccctctacgtgttggttccctccgttcgcgttgtcgtgccgtcattcgccggcgagcatgcacgcccgagccgccgccggtggtgacgtcaccgctgacgtcatcgttgccatccgtcgtaggcctgtcgtggaccgatagatctcggccgttcgtttttggatggatcggtctcggtcgttcgtttccgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgagcgtgacaagttctcatctagacagcatcaccacatcactccatgcctcattcttaccattccctgttctagccatggactgtaatcgtcatgcaccaagctctaatcatcttataaaccacaaacacaaaggatacggatgaagccgagtgtccccattgtacatagtattcgagtaatccaattgttttggcattaatagttacaaattctgaaattgaagcagtgacaaataagatggatattcctcatccaaatatgaagacacgaatgagatagcattttcttgggaagaaatgtttgaatcaaaacaagagcggaagctggcgaacaatgagcatgattatgaatgcattaaaacaacagcgaaatttcttcgtcttcatctactagtttacaagaagacatgcatcacattcaccagaaaatatataccccccacaatttccgtaatgagcaactatagggttggcgcacagtatagtagtatagtagtaaactacggtcaagtccgcaatgagcaaaatgtggatgccaaaacttaatttttgcacttgcgaaagggttccgtagagaagtgctctgtaggcaccagcagcgcccaccccatcttgccattcgcacgggagtgccactattgcgaaattcttattggtgttggttgggaacaactataggtgttggtttaacagtaagaatcaacttggaaataccaatgcctaatagtatagatgtcgatttaataactggtacctatataattgataataggtactggttttgtctagtatccagtacttataattgataataggtgatgattttctctaaaccgacacctttaacctattatttagggttttgtagtagtgtgccgacggcattcaggtgccgttgcgtctgccagtttggttttgtattatactagcaagactttaaattgaattatttgagcactattttacgtattatgtattttgttcttttttgccgtgtacggtggcagaacaacatacatacgacaaatgttgggttgtttaatttcatttcttgctctcacttagtgccagacacattgcctagtaaatttcttcactacaagtaaattaaagcagaataaattgctctaccaaacatccatccctcttctagttatatacttcgtcccagggctgaatcagctggagggcttcctgagaaacggcgacagaaatagcatgggaaggttcttcgtcactcaaacaaataccccaaatttaggccttattagttttgaaggattcctaaaggaaatctcaattcctttggaataagcaatattcatgcattcggtttgtaggattcattggaaaattttccataggaacactatgccaatcctccaaaaatcctccaaaatatactaattccataggaatgaaaacattcactctatcctcttttgtttagctcggtggaggaaaaattcctgtgttccaatcctttgttttacacatggattcctatattattcctacgttttttctatttctgtgatttggaaatcctgtgaaccgaataagccctacttaggaagcggcaatgaaaaagaacgcgtaccatggcaataagagaaccttgtaaaagaagaaaaagctcctggaaatccaaatgttaccgacaactttagaacatataaaaataaaaacaagatctttttactaccaatagagaacaccataaaatggatttttttgtacggtggcgctaatacgcgcgctgcgcgtggaatattagtttgagcaccgcacaaccctctctccttccggttttctcttttttattatcactccaccttccatgtttcttttttctcttttccatctcatccgtgcttcatcaaaaggcccggaaaaatattaaccatccatattttttcctctttcattccttctctgcattttctttagcattttagttttctttatctttttagtaaaatatttatcgtgtagtttttctttccgggttttctgtttttctagtgtctatccacgtttcaaaagcaatgaatttactccatagaatttttcatttactcccagcctaccacatctgctcattcaaaagtaacaaatttactcgcatgaatgcccgtcatcatacaacaccattcctagatgtccgtaaaagaattactaccagcttgcaatgctagtaattcttttaccacagttatcaatattgtttagacttcgtgatctacgagtaaaacaacaccttcctctcgttatagcctatgatctcgtagccactatgcagtaatatgttactgatgtgttcaatacacagtataagagtaaaaactaatataggagtattgttaatatccgtatcacaaaatggttgtacgaatgaaaaacattacaggctcaatcacacacgactgttaatataactcacagatgaattaaactaaaaaagaaaaaaataattcagccaaaaattcatgatgacgttgggatcctggtggctttgctggatctttctataaggatagagaggttggtttgtgtcatgtgactggtagtggagagggcaaccaggtgacgagcagtagtcgatgatggaatcatggaaagatgtagcggcgtggtacatagatgagctcacatttgcgcagtagcaaccttccatcatctagcgagcatgaaataaatgcaaaaacattcttgttcatgtcattgagacgacgagcaaaaacattcttgtagcggccccgctcgcttctccgccccgtgcgcgcgcgcgagctgcgccgcgggcccgccatcgcttccccctcccttcgacttcccccactcgcttccccttccatctccttctgccacgcttgcttctccccccatgcacgcgtgcgcgagctgcgtcctggacctgccgcggatgcagccgcttcccctccccgcgtcgcactgcctcccccatcccccacgcgccagccacgccggagctgggaaccctagcgccatgccggcctcaaccgccccctccctcatcctgttcggcgttacatgcggtattcacttcatcccttaatcacgcgtatttacaatagaaaccgccaaatcaattgggtgaggaggcgcactggttaatataattcatgtgcctattctgatttgtctttcataagtctcttgcaaacttgataggcctcttgcaatccccgctgcaacccggcctctcctctgatctatacctccctcacatcaaccgttctgtgtgcaagcctcaaccctgcaccccttcatcctacaggtgcacatcattgcaatcgagtcatgtaaggttagttgtcaaccaacttaatcggttcattgcatgtaaacttatttactgattttatatgtctgaattggttatttgccatgggtactgattttaattcctgaaaaaaagtgtcaatttattctatttggtaaacctgaacttggcatgaattttgaccagattctattggagtatacattatgatttgaaccaagctgaagcattatgaaaggtctatcgattggtttctcccgcccgtccgcgagcgacctgaagcggatgtgggtgcggttcaagaaagcgccgcgcggcggcggtgaccgacattctccctgtgagaagattgagagagaagagaagagagataggagagctgccatgtgggcccaagggcatttttgacattttacacgatnttctctctcctcttcaactgaaattatatttctaatcggcgcggtgtccattggtaaattagcacgtntatggaatgttttccccaaaaatgagttcggacagtatcctacggctaaaagcacgaagtcgnaagtgttctgtagcaaaatttgccataaatatataatagatgtcggttttttcaaaaaaaaattatcttaatcttaatcttaaatatttaaaaaatccataactttctgatcatcacctctctttttttccgtattttcggtcgtaagtccgagagtccgtacattgtcctcccccgcttaagcaaaatcaaacaaaaacagggagggcggatctgcgtgagagagaggcggagagacaacgggaaacaggcgccgacggcggatccacacaagcagcaacgatggcttagagccggtggtcgatctggtcggcgacaactcgggtggaggagggagacagacgaagaaagacggagattggatcagggagagtaggggagaaaggggatttcatcggctagcgatttcgtcggacatcaaggttttcgtatgcccccctctggccggttatttcatcggtgcaggaccgatccgaactgcgccaccaccgctgttgggccacggaagacaactgggccacgcagagttctccccgcattgggccgtcgccgttagatgggccgttcgccgcgcgatcagctcgtgcgcatgtgctaaacgggtcgggccaattttttgggccggttatggaagtaatgggccaaaataaagttttatttaatttcgccgaattaattcatttgattatgtacataattttatttggcattattttgatccatttaaaattgctggaaaattatgatcaattactcagaaaatatatatttatatgtatatatatacctaataaaaaaacacaaaggttccgatttattttggtctgttggtttttttggtttcgtccggttttttgtcgttgttttttcccgaatgcgaactgatctattgcaccgtgcgccttctgtagccgnccaagccgaatctgaccgattggtgatctttctggactttttattccgaattttaagctctaatatggggaaaacagaaagggcatactagcgtagggctaaataagaaggaagaaatgggctttcggtgcaaaatcaagaaaaaaatttcatcaacttttaaattatagtgtatagcaatcccaatattaaaattctcattaaccttttcaatcgacaatcgcaatgtgtagcgagagggataagcctatctaaccaggccactgatatttttttaaaaaaactacaattatagtagacttgtta

SEQ ID NO: 78319 - DNA, 2034 bp, Oryza sativa
gaaaagaggagatatctagatgaaatcatttgataatgttagtttgcattagcacgctggtatccttctgtttatctaaaaaaacagccatccttcttttcaaagtgctataattgagtgtatagatatccatgttttgttcatcatttcaaaccaattgtgcaatgtcaatgattcaattaatggttagatcagcgaggtctattgggtgccggatctttgtgtcaaatccatgccagctaaatatctttcacattgcataatggttactagttcaatactcaatactaacacaatatataggtgcttcccaatacatcataggaaaaaggttaggaattaggactttggccaggggaagttgacaacttgattcattagaatagttttttacttcatcaaacattggttaaaaatcacattgctcatgaaaagatcaattgaaaattccaagtttcaagcataactacagaaggcacatacgctttcccgtttgtttagctcagcctcctttgcctgcagttctttctcctttttcttcatgtcctgaattacatacgaacatactcaatgcataagcaaccaaccacaaatacagcaacaaaagaatatatggtatcaaacatccaaaccaaggaatagtgaaaccatcattactagattaattgtgttcttcagccttttaaagagataagataacaaaaaatgaagcatgcaactgttgttacacactaacagagtaataatatcagagtgaaagagctaagtacagtatgattttctcacgctgaggtacagaacataacttgtaaatatagtagcacgtagtattaccgctcaatggaaatacaagtaccttggttgaatcaagaggtatgtccactgtggcaccacgatcattatagaacccaggttcgtgaggaagaggtggcatccgagagttggaagctggaggtacacttccaccctgcagaacagggtacatttaaaaatgaaacaaacagatagttgaaggaggctgctaaaattagaatattcagccaactctgttatccctttttacgcctattggccgaaagctcaaaatttgacagtttagaaatcctagatggagcatgtgcacgcatacgcacaattcacatgattatggactcgctgacacgtgcatatccagcaaactgagagtaaactgactgcaggcttacgacactaaatgtttatactggcagagacaatcttcaatctcctaatgttatagacgatctgaaccaaacaagtgtgaactgccccattttacggatattttccaataattctaagagtagaccgaccattttcacaagttatacatatcgattgcaccacatattccctcgtaaaaccagaaacataacgtcccaacacaacctaagagccaattttcaatccgagcatcatttctcctatgaaaatgtataacaatacaaggggaaaagttgccacgcctcgcgatcagctagcaaatagacaagcaaaaaaggccgtattcgcgccatccaagtccaaccccctaacagcggatcctaaatcactaaccctagcgccaacaactcaggctgatccaaagcaccccacatggcgtgccgcgtgcaggaccagacgaagcggccacggccagaaaaccagcacaacacatgccaatccgggacgcagctcgactaccccatccacacaggcgcgaggacaagcttctccatgcctagatgaagcaaggaggaggcgcgattgcgacgcggagggggggtttagccccccgacccagctacagcctaacccagcagctcaccgcgaaggggttgacgtcgtcctcgtcgaaggggttccggtcgtacctccccgccatagctcccctccaccccaactcctcctcctcctccggaagcggccgcgtcggtggtttctctctccggcgagggaaggggaacgcgcgtgacggtggcgaccaactgctccggcctccgggcttccgcttttacgtaacctagtgggtttgga

SEQ ID NO: 78320 - DNA, 1016 bp, Oryza sativa
acatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtttggcgttccattttcaatccttaccttttttttttcgttttgcagaaatccgtgagaaacacaaattggaactggagaatttgacactaacaaagcatccattcaggacattacgttttttcatgttagctatgttgcaatacttgaaaagattagcaacatatatcctgagtaagggtgctttgtttgttgtcctcattgtgttggtgctagctcctggaattttacttgcggttacagatggtctgcataaaaaggtgtgttacttcctgtaatttgattacgatcgcagtgcttgtgctgataagagtaga

SEQ ID NO: 78321 - DNA, 42045 bp, Oryza sativa
aaacgactccccccaagtcccaactccacttgatattcgccgtttgcgaaatttagtggtcgtctgatcagccggtcaattcttcgattctcctatgtgcaagggaagagaatactacccgcccgtagcttcaaatgtactaggctgcttgttatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggaatcgtggaaaacttgctgtaaattactagattattagtactattagttaatgattacacgagtaggccagccatttgaacacctgtaatgcagagtgtccgagtagtgaggcgatcacctaatccgagttccagttcaaagttttcgtctgattttctttttgacagttaggttttgctgcctgctgaacccaaaggaccagggtttgaaccttggacaagtttggtcgatctgtgcgtgtttatcttacatcttatcatcaaagtactaccactattttgtttgtggctgtggtcttctgttctggttcagtatctattactgctaatttacatatgtgaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataacaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggcatataaggaatcagactaattttcaatagtatataagaaattctctcttttcgattccttggttgatacaaggccacgaccgcgaaacaatcagacacaatagaatgcaaaatggatgtaagaaaaaaaatgaacttgtggtagtggttctcctataccaagtagaaacataaatgagagcaacaagacgtgtactgtatgatagaacgagagaaagtgaccctattggaatgttactggaggtctggagcacggacgaaaacgatcgtggcaatcaaagttaccttacgggaattttccaaggcataagccacagaggtagtagtaaatactactcccccgtagaaggaatgattcaacgggggtggcgagccatgaaatcagttagcgagcactcccccttctctttagttttaactatctatattagttaatatacttaacattaatgatagtaattagacaagattctgacgatttttttgggagatttttttactaatagattaaaaaaaatttaagttagatttgaaaactttcgatttaagttttaaattttaaagtcaaatttaaaaaactttcaactcagatttgaaaactttcaacccagatttaaaaactttcaactcagatttgaaaactttcaacccgagatttgaaaactttcaacttagaatcgaaactttcaactcgagaatcgagattcgaaaactttcaagtccagatttgaaaaatttgaaaactttcaatttgagattcgaaaactttcaaatcaagattcgaaaactttcaaatcgagattcgaaaactttcaaatcaagatttgaaaaaaaataaaaaattttaaatctgaacttaaaagtttttaaatcgtcaagttcaaatttgaaaattttcaactcaaaatttaaaaactttcaaactcaaaatatgctaaaagattaaaaaaataatcagaaaaaagtgtgaaaaaaaacgaaaaaatcggaaaaaaaagaaaaaaaaaaggtaagaggacgcgcgcgcgcattagcttttccgaataggggggtggctagcacgcgcgtgcgcgccaggaaagcagttggcgagcacttccccttctctttagtcttaactacttatattagttaatatacttaacactaatggtagtaattagaaaagattctgtctatttttttgggagatttttttacttacagaataaaaaaaattaagttagatttgaaaactttcgatttaagttttaaaatttaaaaactttcaactcagatttgaaaactttcaacccagatttgaaaactttcaacttaagatttgaaaactttcaactcagaatcgaaattttcaactcaagaatcgagattcaaaaactttcaagtccatatttgaaaattttgaaaactttcaatatgagatttgaaaactttcaactcaagattcgaaaactttcaaatcgagattcgaaaacttttaaatcaagatttgaaaaaaataaaaattttcaaatctgaacttaaaagtttttaaatcaagaatttaaaaactttcaaactcaaaatatgataaaagattaaaaaaataaacagaaaaaagtgtgaacaaaaacgaaaaaattggaaaaaaaaggaaaaaaaaagtcagaggacgcgcgcgccggggctgggccctctgggccgaaacgcgcgcgcattatcttttctgtgattcaacgggcaatactgacaagaaggtagtcatgtgcaggtgctgtcagtctatcagcatcgacatctatgcctgattacgagaacaacgtgctgctaatcccgggccttggtataagattctgaaaagtccatcttgatttagctttgttcgaatagtaatatttctcaaaatactctaaaaacgagctactactatgtacgagcggcacccttcgaatctcaaaaataatactatacagtacgacattacggctcatcctactcgggtttcgacgtattagcgtcatcacgccgtaacatcgatcttttgaaattgggcatagaccatcaaccaccgtcgtctgaccacgaattccacgaaacatgtgaagcacacgctctcgcttgatcatactgcaaaaacgtgaaacgatgtatatggcgtcgcggccagggcactcgcgtaagcccgagagcgatatggatcgatggtggcgagctgatagctccactgagcgcgccggagaagaactctctcgtctcgtcccgaccgcccggccgcccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaactcatggataaaattgccatccctaagcccaagattccagcgttcaggccaaaattaaacggtgggggcgcctccatccacactccagagagagtgctaactaattgcatatgcgcactgcaaaacaaagatatggtcctgagccacgcctaaaacgacagatccgtgtgtagtgatgagtgtgtgaactgtgtgtaacatgcaatggagaaaagaggaggggaaggaattgtttttttgaccttaaactaatctggcatgaaattgacgtagtaccgttttgcttgagcatgaaagaggacatgcagtgtgtactagccctactggcttttgtcttaaaaaatgcgaaacaaatttcttgttacatagattttgtagtaggggctcatacgacgaacttagcatgtatttagtttagaaacaaagtgagatgggttggactcatccctatttttaggatggaatgatcctatctatctatttggcataagggatgggatgatctacttttgaaggaatgtccacaagttagtgagagaaaaaagtaggttcgattggtccgctagttttttaagggccactaacccgtatcctaggggatatattccttgtcggggaccatcatatcccacatgtgcctaaacaaaacactgaaaaatgggttcaacccaatctaatccatcccaaccctttaaccaaacaaattcttaggctgcatttgtttgagcatttcaggtgaaacagttcgtgacttataaatttagaaaataaatttgtttttggttttttctaaacaacttctatatgatttatttccacaaaatataatattaaaagttcagggagcattgctaatgaaaaacaagaaaataccatttcaagttggcgaaaagaacttagccttggtgatattttgtagaatcactaacagaaacagaggacattaccattcaaaaagttttgtgcttttttgcgaggattaagtaattttttttagatgaaaaatccatttagagaccttgaaatgccgttccatatctttcatcccttggcataaaatttttattctacctagccatataagttaaaaccaacaacaaaacaatgttaggatccctttgatttgtaggggaaacattggagtttgggaggatttcaatcctatagggaaaaaatcctatgaaaacatttgaaacaaaagattaaatcttattttattctttaaagttcctatggaatagataatcatataaaaattttggagaaaacttagcaagaatatatctctcatccgtttcctatgttttttttccgtggtcgaattaaatgagcttttttgtgtttgtagtccattgttttatatctgcattttcctggcataatcatgtgtttttttattccttcggattttttcatacaattaaaaagggcctttactagtatagcaagtttactgtgacgaaattggagacaatatgaattctttccatgtgaaagaataaacttttacgaagtattttaatttcaaagaagaaactcaatttcttctttttgccaagatgagctccctccaaaatcgatctaccggcatgaaccatccaaaccctccagtaggattacgcaccaaacagggagcctaccccaaccacatcctagagcagccactgtacagccgtcctggctcactgttcaaccgcctcgagattcgtgcactcttcccgtgaggcgacggacgatgattgcccaatcatggcccctccctccctcgggcagctccatcaatgctcgcgtgcgtggtcctcccccggagcttattactcccgaccgaccggcgggcccggcccggcgatgtgaggcgctggaccgatccgggccgtccgatgcaccaacggacggccgagatgctgaccagtccgatcccccgcttcgtccctttcccgtttgactccacccaccttacggcccggcccaccttggaaaactggacacacacacacgcaccccctctctctcgcggatttttttttctcgtctttgaccgggctgtcagcgtcggcggtgggccccactgccaccacaatgccatatctatgaccacgcttgcttgcttgcgcttggaatttgtggatattctcccttgcttggccattctctttgactaattttaagatcaagagagccttctagttctaacaaatcttgcacatttttgcatcccacaccctctaaaaatacttttattttctctggtcgtgtttgtacttgttcctcagggactttgttctgaaatttcttctccatgagctcagggagaagaagtgaagaactcgtgctggcgtgctgcataagtttctacgggaaatcttccactattcaacatgacttgtactaaccaaatttaactctggatttgcttctgctaactctttaatatagttcagttgcaatgtatttaggttaacttctctatggctgtgtttagttcagcgcaaagtttggattttgattaaaatttaagatgatgtgactgaaaagttgtgtgtgtatgacatgttgatgtgatagaaaaggactgaagtttggatccaaactttgaatctaaacacagcctatgtttggactcccaggaagccaatccataagggcaagctgcagaattgtcatctgctagtcgtctgaatctctttcagtctcagttgttcttttcatctaagcagtctacctctacggttagttgtcataatttagcaatgcagtatgtactactagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatttcttgttcaattcaacaatgagcaaaaagccaacacagtgacttcaaaacaagagatgccacatccttttcgcagatggcgaattaatctcttgcgttccatcgtcaatacttcaaactttcttactctcttcttcgattagaacaagaattaaaaacactgaaccgcagacggcaaggcaaataaactatgatccttcattgatgttttcgtttcgtccgggatcttcagacggcaggatagcgaataagcaagcagtggcaacttgtcaaacattcgaagccatcgcggtcgcattttattcgatctttctccctctgaaaagcaaaacaagaatggtagcgagagagaaaaacaactggagaacgatatgcccttttatcatgttagaattttgcacacgcagttcgtcatccttcttttcctgtcaagttgtattggtgaacaacctcgaccacgcatgcatcaaatcaatatgagcatcagaccataatcactcgaattgccttccagtttcccaattacacttttgcttatagtgatgatcaaagctgtagaacccaggctacatggttaaagttgatttcttcccaatggacgcttccacaaaactcttcgtgcttaactttgaacagaataattttgtgggcgagaaagggttacacaataaacatttttaaaagaaaaaccataaccagtggctataattaaccgtacaagcaatgtgttacccctatcaacacacagttgcgtcatcttgacacacgcactattcagaagaaaaaggaaaacctgaaacctgtttctgaaaatactggagcactgcagctgaatgttcatgagcaaaccacctttgtcggcttgtgaaggcaaaaaaaaaaaaaacaccatttgattttcaccgctttagaaaatcaccctgtgatgggtggtaccattaccaacacactctcatgtgcatcctgccccaccctcccattaccctacctttgcaaacgcatcgttagagcaagtttattagtatagccaactgtcgacttcaaattaactatagttaattttagagccaattcatataataagttacctataaacatatactatataattaatatattggctcgaaagctagcttatactagcctgctattgtacctgctcctaaaagtagttaattactgctaattacatggattagttgggtaaaagcggggttagcggggggcggaatataaaaatgccgcctgcctcggagcccctccaccggctttgaccagtgccgcgccctctcctctctgtcgcctcgccaccaccatagctaatcctcctcctccgtttattttacttttctcccctcttcgcctctcctcgctgctgttatatccgctttcctctcctcctcctcctatcccccctctcctcctgctcctcggcctcctcccctagatgccagccgcggcctgaccctcaccgctggggagcccccctcccattcttcgcttcccccgcggttgcgctcccggagcggcgttccagcggccacaggtgcggtctctttgcttcccctctgctgctgttgttgtgtgcggtttgcttggttataggtggattttttggggttatttcatgggtggttactgatgtttttttttccgttgctgcctggatctttctcatttggattatcatctgctgctttcccaaagcgcgctgctgtttttttttgtttttttaaatatttttgtttgtgtttgcgctcttgcatttataaattttcgccgaatggcaggctaggactttggatataaggtcgggggtttgaaaaccctcgaatttcataatttcccccaccaccgtttcagaagttcgtttggattctgtgaatgctcacaatgctgtatattagtaagaggtgagataatgccgtgaaggttttggaattctgctttcacggccatggaagctgcaaccgcgggttcatttatgatcgcggagcggtgaaaatttccagtaaatgttttgggggtggtgcagtgcttggttgttggggtcaatgacttagctgcaatagattgcttatttaagttggacttttgacccggaattgttaatttggtttggtttggtgagaattcgactactagattccgtctttggatatggaagtagttgcagacgcgcgcaatttctgtgaagttgcattggaaaccaaactaaatggagtggtgtgtttgaacgtccattgttgcgtctgcggaccaatgcatcacaccacctggctcctataagccttcgtctcagcttgtctcttgatagatcagtgaactgattgtgggaatgaggcagttttagtagtttagctgtctcttcttctccagtaatggtttggaagttcagaatacattgagaggtgttgtacttaaggagagatatcatagttatttttttttttttttttttttttgctgatgcaaggttcgacgccttttgcaccttctgttgtactgcatttagctttagcagatgcaatacatgacaactttttattgttgccgacgactaactgctatattgtgatggggcagctacttttgtgctatgtgctaactcaggatcctatttgaaattctgtagcagctttccctcattgtacacatgatgggttgcttcactgtcctgagatccaagaagaagaagcctcttgctctcaccaagaaatcggttgatgcaagggaaagcacgtcctcaagactcccagagccagaagcgcatgtgccatcgttacaatctgctcctcctagttttaggaacaaggctaaaatccaccaatcggaaaagaaagcttcttacagcagagcgcgcgtgctgtctgctccttccagcctaattgtggttgatcaggatggtcttccatatgccgaattcgatgatcaagatgactccaggggcaagggaggttctataaagggccaccgtttctctaatccactgccccttcctctcccatcaccagaaggaaaatcattgaggaactttggcagcttcaaagccatcaatgcaagtggaccactcgatgcttcaggccctctgccacttcctccaaagaagtgtgatgggcttaagaatttctcctatgaggaactttcatcagcttgccaatggttttctggtgaccagtgtgtttccgaaagtttgacatcaacatcatacaaggcgtcctttagggatgattttaccgacccaaagaccattgaagcaatagtatctcggttgctctcctccactcaggtactgttctccgtaatattgaattatgtgtttcatcttctttgttttcccctggaaggaagttgtattggatgtaaagcggtagctttgccattttgctttgttggtcagcttgtcaaacagatggttggcatgttatggcttacttttatttctctcttgctagtgagtagtgacttggcaaaatgcttgtacactgtaaggattatactcttttagggctttaaccattttgcagcatttcttctattaagaagctgaccttaggctagaggcacggactggttttgtaggcatgtgatctatgctcttaatgttacagctatgctgtctccagcagaaataactctttctatttttgtgaatgcaaaccaggaccacaccattggtggggttaggtaacatgctctggactttgaaggcagaccatgtgtttgatcttctttcttcactttactcctagatgctttctccactccttcctaatcatatccagtgactagcgagattttcttttgacgtttgtttgatactttgatatatgatatctcatgctttccactttatgtggtttattggcatggttctgatcttccctcacttgtattcagtattgaaggaatctaaaaaatcactgtagtgttattgtgtagttctgggaattcagtggttcactagactttgtattgtgtgtgtgtgtctaaatctgataccccctttggtgttacctaatgttgcagcaccgtttattggaccatcctgatctattatttacaatttaactggttatggtactgatgcaacacacattttattaatatgcagagtttgaaagagtttaaaacacaagtgaataccttggcatcacttcagcatcccaacttatgtaaactaatcggctttcacgcaagagaagaatctaatgaaaggatgttggtctatgagcgactccatcatggcagcttagataaactactctttggaagatcggatggtcgtttcatggactggtcagcacgtttgaaggttgctcttggtgctgctagaggcctggctttcctacatgatgaagggccttttcaggttactgcttctaaactttttctttttgacattaccaataagtgaatatttattttacctagttatatagtacattggttgatggtttttgaccttgtggtttaaactcttattcatatgttattttttttacaggccatgtacaatgacttctcaacctcaaacatccaaattgacaaagatttcactgcaaagctatcaggatatggatgtgttggattcaataccgaggaggaaatatcaaatgcatctgtggtaagttatgttttgaaaatattttagaagatatagttatcagagcccaactcatttgcctgatctctttctgtaaattcaagtagtgtgttttggcatggttaatactctgttcgtttgtatggattctgtgttgcacgccattgatattatttagtcccaaacatcctaatattttgatgtgtttttactttacttgtttgcattatatccatagtggtcaatgccattgtttaccgtggatgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaagaagaacgcaatattgtcaagtggagtaggcctttcctcaccgatgatagtcgcctatcgttaatcatggactcccgtataaaaggacgcttccctaccaaggctgctcggattgtagcagatatcatattgagatgccttaataaagatccatcagagaggcctaccatgagggccgttgtggagtccctagcaagcgtccaggacataaaggttccatgtcgatatcctttgcaagagccatctgctgccccaagaaaggtgatgttaaaatctacaagtctcaatggcatcattcatcaccatcctgtcgtaaccttctcaccgtcacctccttcgcgaaaccaacatttgctctcgccaaggtcatccacgtctgcactgcttcctccaaggaccagctgtgctctggatgaccctagagtaagctctatcaagaaatcgccttcccctattttacggagatctggtgttgagggtttttgattgtccatatttttttttctcttctcttcacttcgatttgtttgttgtttttgctagcctagtggttttagtgtaatctcatatattgcaagacaaatggccttatgaactcccttcagtagtactaagaagggaagggtgaactgtagatagaaccaggttgtagatacttttcgttttctaattggatggaagcagcgtgttgagtgcgccttgtaaactccattatgcaataataaacgtgtgtcactcagttcttttttggggagtcaaacatttcagctatttcggttgggtgccaactgccaaagtgccaagtggtgttgttgcttgtcggcacatagattgtccaatgttctaatccacgtgatgagatcatgtcgctgaagttgcaaggatccattgatgtaatatttgctgctgcctgtggcagttagagatgttgaatgactttgaatccctgcctgtggaaagttcatcccatcgttgcagttgttgactgcgacccagcctgcttttgcttctttgaccaaagtttgtcgatcgccggtcaaacttatctcaagcttaattagagtacgtaacaaacgttttataaacatgtgttttcaattggaacgtcagtgacgtctagttatgatgatgtaatggttggtggcatgaaactctactgcaacagtgcaacagcaaaagaaaattttgttgcatcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctgcacagtttgttttgtccttggacactgtcacttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcctcctccttggcacgtcggccggcagcgcccggcggggcttcctgcttgtcctgcggcgcgacgacggcgagacgggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtatatgttgtataaatcaatcttgcagtataaattgaagttcacacgctatttcgcacactgcttgtttggcaacgcagggaagaggattgggagtttagaattgatggtgagattaaaataggattgggagtttacacgagggaattgatggtgagattaaaatgagaatttgatttttaatcccagtatcttgtttggtagaggtagtggaaattgatagagagtttagttggagattagttcattaatgaaaatgaatggctgagatttgtttaggcaaagtaaaggaggaattccgtcccaattaccaccactacccaggtattgaaaaggagggagttcctccctcaattctctatccctatcccacaaaaattctcatgtatcccaactaaacaaaacaattaatagatgggactctaccaagaccatgacgatgacattgggctacattactagtccatgagaaagcccatgtaaagtaatgcatcctttcggaccaaattatgaagtccgggcctaacaagtgttacccaaagaaatttccccaaacacaaagaaatacggccccatcgtttcacatatgtgtgaataagccaaacggtatatttacaaataaaaaataatttgtgaataaaactttttatacatgttcatgttcttaatgatctaaaagcaaagtctgaaaaataaacctcaatgaaaaaaccccaaaaccaactccaaattaagagttgaaaattcaaaatttgtttgataagtaaaagcataaacgaaaagatgaggccaaataatcccaatccaaataacgccgccatcatctaaactttggggcctcatcttttcccttatgcttatgcttatacttatcagctaaaatttaaattttcaactttaaatttagaactgatttaatggttttttcatcgaagtttatttttcagccttacttttagatcactaagaacacatatacaaaattttattcataaattatttttcgtttgcaaatacgtcctttcatttattccggggcttttctctcccaatttccccgccgcccgaatcggccgatcggcaaggagttgagcgattctctacgcccccaacgattttctctcccccaaatcgatggcttctcgcaagtcgctacgacgatcggcgctgctccaactcccttgcggctgcttcgcggagacgagggttgtgctcgatgagaagacggagcacctccagctccctcccacgaggttggtccggatcacgtttttcgcagtctcgattggattcggcttgtctctgtcactagggtttaagggaagctttagggttttgatttttagtttcgatctcttcaggaaactgtattccgaaatacggcggagggcatggggaggagtggaggacacggctctccgccgccgtggcggccgtcgtccgcctatgcagctgaggcctgagggagatccccggctctgacatatcggtgcaggtgcgcgacaagccgcggggaagagttgttcgcctgatcgcctacggctaaccagaacgacggtaattgttcggaaaatcctaattgtctatgcaattgcttagttttgagtcgaatttgttaaggattgtgatgcagtcatagtatcagttatctgactctgttaccaaaattgccccggtttttaatttgtttttgctatacatttatcacacgcctgatttttttttctttcatatatactgatgctggccacactatgtattgaaaagaacagtggtccagaggtttatattttatagggagcgacaaatatattgactgataatctggatttatgctggtaacgaattggtttcatgagtctggaaaggtttgttttgctgttgagctacagttggatgagctttttttttccttccgtgcagaactaggtgccatgatgaaaattcggtttatgccaacttattatctaacataggcttcaacacaggactagaagtttgcaaggctgtaagaaggcatgcaaattagatcttactgagtttttttttcctgtcatttattcccttcttggagtgatgatgagaattttatcatgcccataaatctactcaagcaccatcattccatctatttcctcggtgtcttgtactcttgttacacacaagagctatactgtgagtttagcttatggaggtgcattgaagtcagactttgccatctgtggtatctggtttttgaaaatcaaatgtaagcttgaataaaatgatagtaccatggacaataggacctgtgttcgtaaaaaaaatgcacaataggattttgtcatatattggtgttagagggctatatctttcaaacagaacacgcaaccgaaattcactagtttgttcaatttgttaatccttttttgtgggtttgggcttgggctgtgaagcatgatccgattccaatgtctctgatcactgaatccaatatatgcatcacacatctttgttttcgtcatggttttgatgggaaatgtgcaagcctgtttcagtttttagagaagggatgatgcggtagtccaatatgcagctagagatgggagctcatgaccatatcgatggactgctaagatggcttggagggcataccggaacaggacaatatgtggtgataacagtgtgctgatcatcagacgtaacctgcccagggttttttagcaaatattctttctacatcgaactggctattactacatttcattttaggttggccagtcctacaattcactccagaattctgtacctatgtccaacaaggtctcttgcgaaatcctttaacattgatggtattataccagtcattatagcattgagctcattattgttatagttggtgttatatacatgttccccgagtcctatgtgctagataaggcttgagtctgcacatgatactgtcacttgagacttgagaggtgccgccctgctggccctcccactctataggtcaccacaggtccacatattccttttccctttttcttcctttatgtccttttcccctttgcatgattcctctcctcttgcttttggcctttttgttcacttaatgatataagcttgttagcatgacaaagatttatgcgatgccaaggttatttttaccttcaccaccttatgtccttgctttttgcacaagtcacaattttttttgatgcattatatgtatgtactcctaatattttctgagagagactttcacactttttgtcaaattttctgttttctgttgaatatttaagaactaagaactatttattgtcgctgagttctttcgtgtactattttgaagttttcctgtttgcattttcctagccatgctgccatttggaacactgtattaggcatgatcattgcgtgggtcggggacaaacaacaactgtaccgcaataatattttgggcatcaatttctccaggacgagctatatgcataatgcatctctgttgttatatttcccatgggcattttcgcatcgtcagtggtactgttgttgtgtcatttatggacaacttgagcatgcagagaatttgagagatgatttgattacgggcatatgatcccctttgtattgcatatagtgggtagtcttcttgttgttagcatgttcttctccagttaaagaaaagtgagttgtacggttatcaatgctctacatgctcatatggttgcctggcttgtagttcctgcattggcctgcttggtgttgattcacgacagcgaaaaatactccctagtccctacattagttcttcacagtgtgacttggaaaggtgataggatgtactccctccgtttcatattgtaagactttctagcatttcccatattcatatagatgctaatgaatctagacacatatatatacctagattcattaacatctatatgaatgtgggcaacgctagaaagtcttacattgtgaaacggagggagtatcaaacatttcagacgtttctgttacatgttttctgcaggacaagtacgagacctcttggcagaggcttggttaaaattcttgctttgctgaaggaagaagatgccaatggtccaacctgtgactgtcacgatgacaaaacgcattgccaggtggacttatactgtgatttgcttttattccttatctaatcatggtaacattggcaggaatggataatttttctatctaagctaccagaaatcattgtgttctacttttgtgtgtcatgtggaggaactttggggcaggtaaaccatgtgaccagaaagggaattcaacacttagttctagtggtaggaatgcagtcatatgttgatatttgccctggaactggaagcaaaatcataattaaatattttctgaggaacatcagatctttttttatttaattcatcctgattccttttctttgcagaactgccttcagatatatgcaattatccatatactttttgtttctattgcttctgctctcttctgcttactctctcttatactgtatagaaacatatactagctgaattccgcaacacaatacctttattttgtagcaaagcgcaaccttttcagagctttgcatagctgtggttgaattctttgtgaaaagaaagcaaaagatgataactgttccctttagaaacacatttcctgaaacatttgttgactgggtctaccacattcgagcagacgctatcagttcaatcaacaaactgcccaaacatatttgtatacaacatctcatatcctcacagaaagcagctacagtgagtgatctgtaaagtcaattggtagaaaatctgctgggtggcattaagaataacattcattgtttatgcaagggtgcagattatactaatgcaaaatatgattgtttggagcaaagctacaggcatctgcatgtggacgtggatctcagaaggtaacttgtgcagaaagactaattgagattgcattatgaaagacagcagtaacactagcagcctgtgggggacaccatcagcaagacagcaaaagcctgcatgattcatttcttcccccaccacaaagcattgaggtttgctctcctgcctcacttattaaatctcacttttccgcttaaactgttatagcgcagcaccctcgtcgctgtgtctgggatccacggcagtaaaataacattggcacatgcttactatacactggctgtctgttaattaagtgtcattggcttaagcaacactgcatttagaaaatgtttactactgggaattcacaatgacagtgacgtgaatgagctgacaaggaatctggggtggtctgatctcacttgcgtatttttaaaccgcgattaaaaaaagtcaatttgattggatctttaggttttgtacattctctcgcctaactctatctgtccttttatctttaacttccctcttattgttcacaatgtaatcttgtactgaatatacaaaatagtagagctggctctacatttttccgtaaaaaagagaagaaaaactttaggtgcttaatgaggtagataacgagccaaaccttggtaattaaccttaatgagttataaaagtcaggctcggcttgactcttgaaatggctcgttagaacatgtacaataacaaactataaatcagctataagcacatgtgaatagtgagtagagaaaagagaagcggacaatagtttgtagccagctgcagcacggactttaagatgatatgtgtatgataggtaagacgctgtgtgtatgataggtatgaccaaatattaatgatgtactgtatatttgtagttgattattatataaattagctattagattgactatgtatgatttggagctagtagttggctatactattaaacttgctcttaagatatattctatttaacgagcttcatcttatttatatcacctttataatatcaaaacattctatcacatattaatataataacaaacgctaactaataaagagttcatcaaatataaagagactagtcactacttcctccgtttcacattgtaagactttctagcattgcttacattcatatagatgctaatgaatctaaacattatctaaacattatatatatatatgagcaatgctagaaaatcttacattatgaaatggagggagtactatagatgagaaagaagtcttattctaagtttgttttaagtcggaacattttaatctgtgatcattaattcttataaattcatatagtttatcattataggttttatattttcaatccatcatgaaacatactttcctactaacatataattaacattgttgtcaaacctcacatattgtaaataaaatctatagtaaaaaaatagttatgtttaacttaggataaacttagaacaacaaactaattcaaaacagagtagagtagagtgctagagagctaaaaacttataagctcggtttgactcattatgactataaggctcagttcctttgtctgggttcccaacccctccttctcgttttccgcgcgtacgcttttgaaactgctaaacggtgtgtgtttttgcaaaaagtttatatacaaaagttgtttaaaaaaatcatattgtttcatttttgaaaaaaaatagctaatacttattaatcacacgttaatgaactgctctgtttttcgtgccgagggaaccgttcccaaccactagtgttgaacacagccttaagtcagagttgatccaacccatataagtttggagttttttttaaccccagtgattgctacttcctccgtcgcaccatataattattcttaagatagccacgagtattaagaaaatatgtgtaaatgattagagaaagattatgattggttgaaaagagaaagtatgtgaaaaattaattaaaaataattataattgcttaagaagaggtgatatatgaagaaatgattttattttagaacaatacactgcacattttactttgtagtactacgaacaagtttaatagtatagtcaactactagctcaaaatcatatataatcaatttaatagctaattcatataatagttacctataaacatatactacactattaatatatggttccacctgtcatacacaaattgtgtattagagttccgtgttacagctgggcgctggctacaaatctgtagcacactgctattttctctcattttttttcttgatatgtaggccgagtttagatccaaattttttcttcaaacttccaacttttccatcacatcaaaattttcatacacacacaaatttccaacttttccatcacatcgtttcaatttcaaccaaacttctaattttaatgtgaactaaacacacacgtatttagttgtttatagttctattattgtacgtgctctactagcaaaaactgtataggattctactttaccagcattgtcctcggtgcctcctgactcctgagcaagcaaggcggtaaattttaaattttcaaataagttgcactgaacaatgctcaccaaccggaccgtgagggtgtcccagttgctgtgctgcggcgctactcttgccctggttgctccggatcgcaataagttcccccataaatgctgccattcggagtggccgctgtaaatgaaggttgttgcgacgcattgaatacaagcaaccttcagacactgcagacagccgtaggccaggaaccaggagcttttaaaacctctgaccctcttttcctttgtggtgaatttccagagggtttggaaaattgggggtataaaacaaactccgttttgttacactagaacgaaacttctaaaaaattgtgctctactcctactcatcaaaatacttctactagtaagctcaactcctttaaaattcctgcaaaattcctcgaaactaaataggccctaattaaagaggaagatatatacttactatatcatatcatatcttcaatagcgaagccaatgatgtcgtttagtttaaggaaacaaatagcatttttggacgattaactagtttctgtgaacgtcaaaggtagtaattcattgtggagtaatcaacaacagagcctgaagtcgtcctgcagccccgccaccgcataatgctataggaatacgtaacggtgacagtgatatcggaggcgatataaattgtgggactccatgcttatcaaacgatgtttggaggaaaatgttgcaagtccataatggtaacctatttaattccatttcaacaaatgaagctgtggaagataatttatcttcgaacaagcaattaaaattcacttaatatcaatcatatgtaagattaattatatagtttccacctatgaatacccaaaaaaaggagtcgacaacatgagctaagccaagattaaagctgtaccaccattttttctctgcaagataaaaccatagaaatccagaaagccaagagaaatcattttgtcgattcctatttgttctactcgtagcacattaatagcagcacaaggccccccatctcctctcctctgtgcttccctcactgcgccaccactccaccacctccacctcctctccaaaaacttgccttgccgccgcaaatggacaaggcgccgctgtgatccctcctccccattgcgttctcccgcttcctcctcctccgcgcgcgagatggccgccgcctcgccgctcgcgcggctcctcgcggcgctgctcgccgtggcggccgcggcgacggccgccaccgcgctcaccgacgacgtgctcgcgctggtggtcttcaagacgggggtcgccgacccgatgggcaggctcgccgcgtggacggaggacgacgaccgcccttgctcctggcccggggtcgggtgcgacgcgcgggcggggcgggtgacgtcgctgtccctcccgggggcgtcgctctccggccgcctcccgcgcgcgctgctccgcctcgacgcgctcgcctccctctccctgccgcggaacaacctctccggcccggtgctcccgggcctcctcgccgcgctcccccgcctccgctccctcgacctctcctccaaccgcctcgccgcccccgtccccgccgagctcttcgcgcaatgccgctccatccgcgcgctctccctcgcgcgcaacgagctctccggctacatcccgcccgccgtcacgtcgtgcgcgtcgctcgtgtccctcaacctctcctccaaccgcctcgctggccccatccctgatggcctctggtcgttgccttcgctccggtcgcttgacctctcgggcaacgagctctccgggagtgtccccggaggcttccccgggagcagctcgttgcgggcggtggacttgagccggaaccttctcgccggggagataccggcggacgtcggggaggcggcgctcctcaagtcgctggatgtcgggcacaatctcttcaccggcgggttgccggagtcgctgcgtcggctgtccgcgctgcggttcctcggcgtcggcggcaatgcgctcgccggggaggtgccgtcgtggatcggggagatgtgggcgctggagcggctggacttgtccgggaaccgcttctcgggcgccatccctgacgccatcgcgaaatgcaagaagatggtggaggcggacctcagccggaacgcgctcgccggcgagctcccctggtgggtgttcggcctgccgctgcagcgcgtctcggtcgctgggaacaagttgtacgggtgggtcaaggtgccggcggatgccgcgctggcgctgcgcgcgctggacctgtcgagcaacgggttctccggcgggatcccgccgcagatcaccgcttttgcgggtttgcagtatctcaacatgtcctcgaattccttcgcgaggcagctgcccgccggcattggcgggatgaggctgctcgaggtgctcgatgtgagcgccaaccgtctcgacggcggcgtgcccccggagattggcggcgcagtggcgctccgggagctgcggctggggcggaattcattcaccggccacatcccgtcgcagattgggaattgcagttcccttgttgcattgtgagttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgggccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccttaccagtggagctatctaatctgcccagcttgcgcatctttgatgtctcccacaacttactatcaggggacctcccaaatagtcgtttcttcgacaacatccctgaaaccttcttgtctgacaatcagggcctctgcagctcgcggaagaacaactcctgcattgctatcatgccaaagcccatagtgctcaatcccaactcctcgacaaacccattgtcgcaggccacaccgactgcccctagcagcatgcaccacaagaagatcatattaagtgtttccaccctcattgccattgcaggtggtggtaccattattatcggggtgatcatcatatctgttctcaaccgtcgtgcccgtgccaccacctctcggtcagctcctgctactgcattatctgatgactatcttagccaatccccagagaatgatgctagctcagggaagcttgttatgtttggaaaaggcagcccagagttcagcgctggtgggcatgccttgttgaataaggattgtgagcttggtcgaggaggttttggtgcagtctacaagacagtgctgagagatggccaaccggtggccatcaagaagctcaccgtttctagcttggtcaagtcgaaggatgactttgagagacaggtgaagttgctcagcaaagtgcgacaccacaatgtcgtcgcactaagaggcttctactggacttcgtcgctgcagctcctcatctatgattacctgcccggaggaaatttgcacaaacacctccatgagtgcacggaggacaactcgctctcttggatggaaaggtttgacattatccttggagttgctaggggtctgacacatctgcaccagcgtgggatcatccattacaatctcaagtccagcaatgttctgctggacagcaatggtgaacccagggtaggtgactatggtcttgccaagctgttgccgatgctggaccggtatgtgctgagcagtaagatccagagtgcactggggtacatggcaccagaatttgcttgcaagactgtgaagattaccgagaagtgcgacgtgtatggctttggagtgctcgtgctggaggtcttgacgggcaggaggccggttgagtacttggaagatgatgtagttgtgctatgtgatttggtgagaagcgcactggaggaaggtaggctggaggactgcatggatcccaggttatgtggtgaattccccatggaagaggccttgccaatcatcaagctgggccttgtttgcacctcgcgggttccatcgaaccggccagacatgggcgaagtggtgaacattcttgagctggtgaggagtcctcaggatagtctagaggacgagctggtttaatgtctcttgccaactctgttctgaacggttctaggcgtttttttttcctttttgttttaatgagatgcatatagtgtaatgctaggtgggaagaaatcagagaaagcaaagagtggtatggatcgtgaaatgcttgtagtttgcttgaagttttagggaggttgcaaggctattttgttgcttctcggcaattctttgatccatttcttggaagagttgttttgccatgtgggcattgcctcggtgccgcatatgacgtctcacaccgtgacacagtcatacaactgaatgaatgatgatgttcttagggtgtgtttaaggataagaggattgaggagattgggaagatacgcaaaacgaggtgagccattaactcgtgattaattgagtattaactattttaaattttaaaaatagattaatatgatttttttaagcaactttcatatagaaaatttttacaaaaaacacaccgtttagtagtttgggaagcgtgtgcgcggaaaacgatgtgcattcttactctctatcacccaaacaaggctgtgtttgctgggggaggttgggaacaaatcttcttcgcacggaaaacggagcggtctattaacgcatgattaattagaaattagctaatttttttcaaaaatgaatcaatatgatttttttaagcaatttttgtatagaaactttttgtaaaaaacacatcgtttagcagtttgaaaagcgtgcacgcggaaaacgatggagaggtgttgggaacccttgggtccgaacacacccttagtagtgttgctctaacatttttgctttcaaatgtgtggtagatttgactccactgtactggtgagtgtcaataccaacagcccaagccacagcagggtgtttgtacttgaattaggggtactgtattttacttcaccagtgactaaagtaaatcacaaaagatgtacagaaaataatcaagagatgctaatgttgtacagtagtactactagtactgaaccatcacttgaagcttggcattgtttcatgattggtagagttttggcagccgttgaccctgtggaatagggaacagtatccctctgccttccctccagcaggggtgcccccatttgcgcgaggatccatggactcacctgtcctttgaagcttccaaaaacatgggcaatgagaccctgtttataatcacatcgaatatttgaacactaattataaatattaaacatagactattaataaaactcatccataatcttggactaattcgcgagacgaatctattgagcctaattaatccatgattagcttatgtgatgctacattaaacattctctaattatggattaattaagcttaaaaaagttatcacacaaattagctttcatttatgtaattagttttgtaagtaatctatatttaatattttaaattagtgtctaaatatagagaataaagttaagtccctggatccaaacaccacctgaatggcccgtgctgccctaccacgtgcccgcgtgttggcatcgtgccagaggctctgaccgcctgtggcggcagcagcagcagccgcagcgacggacggacggatgggatcgtcgtcgaggctcgtttcgtgcagctctcgcgtgaccgtcagttgggagcccggttctcgtcgacgttttttagaaggggtggtggtgtgtgggtgggtgtgagcctgggccctgcctgctgccgcaccactccggcggtcaccaccaccaccaccacaggaattgaatagatggccttaattgcagcacctacccttttgctcctcctccccttcttcttccacctcgtgcaactgtggatggagtgcgtggcaagcgggctgcatttactactcgctctacctttcctcctccctgatctgcaggagtggagtagcttcatagcttcgcagtaaacgtagaagagggcaggggctttcatggcatcggccgcagcaacagtgctgtggtgcggtggtgttggtgtgaggacgccgtttcgatttgtgctaaggcctggtttagttcgcaacattttcgttaaacgtccaatttttccatcacatcgttctaatttcaatcaagctttcatttttagcgtgaactaaaacacaccctaagctaggagctcaggaaatattcaaagattaagctgggagctcgggaaatattcaaagattttgggtttgggaatctttatattcagattctgtaggatacatgtttcaatttgctcctctttttttttcatgctcaggataaaacaggagtaaggttgaaggatgcttgtattgcaggagcaactcaattacacctttgcctggagtggagtgctcgactgctcctactttgtttcgttgccggcaaaaaaaaaaagaatgaaagaaagacagccacgtaaaaagaaaaaggaccgacagaatgaatccatgcaatgaacaaattattgagggtgtgatgatgaagattcaaatcagaacagtgctataatataccgagtgtccgcaccaaaattggaagtttaaagaaaaaagttggaagttgatgtgagtacgaaagttttaggcctagttcctaactttttcttcaaactttcaacttttctatcacatcgaaacttttgtacacacataaacttccaacttttctcttcaaacttccaattttagcgtagaactaaacacatccttgatgtgatggaaaagttgaaagtttaaagaaaaagttgggaactaaacaaggcctcaatagacggtagaaatccatcactctctccgtttcagtttagatatgtaaaaaatgcaacaaatgtcattggcaaacgtcctattctaaaaatactatcgacgaacgcaatttcaacaaatattgttgtacaaaccaacttaccattaaaaataccattatcgttagggtttcactaatttctctccgctaaaatgtgatgaggttaacaaagagatgcaagttgatttgtacaacaaatattgttatccaaaccaacttatcatgaaaaataccattatcgttagggtttcactaattactccatcgttttagtatagcagtactaccatgttcttagagtggattattgcaagtgtgattcattatctggagtaggacttttgcttttgattcactcagaaggaacatccatagcaaaatatgatatcgattgtcgtcaagatgtaatgagcactactcattactcaagagtgcattgcttaaagggccacgtcacgaggcctcgaataaacgattttttttagataatgaaatataacatcccagcctttgctaaaaaaaagctacaaccaattattataaagtagcacttcaaaaaaaagtgtagttcagataaaaagaacacactaaacaaaaacaatggtaaccaagccaaaataaggagaacacatttattgaagtctatttgtgaacctccacccataattggcaaatagttgcataaccatcgactccaacctgcggcatgcagcctttaggaattccccatcatcctcacacctttgtagctgtgccaaaaaccggagccagtgcattgccctaaaaattacctgtatatatgtaatagatagtgatttgtcaaaaccaaatcatttctactcaactgatggaacgagcagtgtcaaagaggctagcctagcctgtgataacggcaatcaactgatggtaaaatcgtcacggccgccgcgggggtcgctggggcgggtttgtcgcgttgctgttgcgaagattcggagaggaaagttctaaaaaaaaaaatcggagatcgatgaaatcggctcgcactcggaccaatgccaattgacgacacatggtttgaccacgacaaaaaaagaaacgctactcatgttgtcctactgtcctacgggcttctcctacgaagaaaaaccgtatcccgagatgttccgtggacgacgcgcgcgcgctgtcccgtgccgtgccgtgaacggtcgtctgccctagtactcctaccgtgctgtgagcccgtgatttttgcccgtttcgcaggagaggcgcccgcgcacctgggcgccgcggtcgcggatgcggatgcggatgcggcgtggtgggacggtgtgtgcgatggcgaacggcgaaggcaggggcttggggcttcgggggcgctcatttatggtgggcggcagggtggtggtgtgtgtgggtgtgagcctgggtcctgtttggtttcatgggccaatgtttagctctcaccttttagtcttaaattagtcctcaaggatctaaacatgtggtctaattttaagctaatgtgaattagcccccctcaaaacattagcccctccaaggggtgctgatggggctaattttatgtggggactatcaaaaagcagctttttctctccttctctctcctctctttctactctctccccaccttttagccttgaattagcccatagatccaaatataccaccataggctaatgtttagcctaacaatttatgactaaatattagctgtcaaaattagctctggactaatcttccaaatagagccctgtgagcgtcgtggccgtggaaacaaaatgtgtcccattagattgtgtgggtgcttcgccccacacagctcgcccattagattgtgtccgcaatcgatcgtgtcagccgtcaaccagacagcaacaacagtgctgtgctgctacggggaggggagggtgtgggggctgcatgtgtcgtccactcttgcatgctgtttgactagtacgtgatgcacatactagtagtctagtgttacgtggtagttgggcacgttgtgggcgtctcggagtcgccacgagcacacgagccgaacaaaatcccagtccattggacccatttggcctcgtatatattcgttataattaaaaaggagaaaaaaacatatccagagattaaaattagaaaatcggctaataagactcggagttttaacctccgatccccttgacctcgatgctttggtagtcatcatgtaattttccctgttctttctgcaacaaaagttggataaaattttagatactcgtggcacgctttttaaatcgttaaacgatgtgtttcgtgtgaaaactttatatatgaaagttgctttagaatatcatattaatctttttttcaagtttataacaattaaaactcaattaatcatacgttaatattacctcgttttgcgtaaaaaacttaatctttatctttaggagaaaagaacaccgcctttattgttggccgatctttgtgctgattcatgcatgcttcatccgctagattgtttctgtcctcggcagtagccatggatgatatatgaatacgctagactccgactcatggtcgagagtctagtcaatctaggtgattagatgatatactgtataatacttctgtcagggttatgggtaccacatacctaatagtagtcgactaaatctcggcatgacccaccatataccatgtcttatacgaaaactgacctcggatatggagggagttccgaataaggaaagagaaccagagttctacatggaaacgacaagaactctcagattgtatccatattggttttcctagttctgcttggacaaggggacacctatgggtataactacaaggccccttaggaggagaggggacacacccaccatagaagacacggaacaatagatcaagacagaagatcaacatacaagccaacatacgccaagacaagacgccagatatcaacttcagagataggcatgactagtcccctacggtgcctatggctaccgtcaggagagacataacgctatctctgatctcgccggatgcggattcgaggaggaagtctaccctggtgtcgactatgagttagaacttcagaccgccaagtcgacaacagttagataggctaccccaagtattgtattggtgtgattatggtgaataagagcaatgaccggcttcggccaacaggatgtagggttattacctgacaattcaggggcccgaacctgtataaaaatcctcgtctctgtctcttttactacaatctcgcgtatatcctagtaccaacgatccccatactatgcaaatactgaaatcgcgacatcaaatgtcgacaacttcctccatccacaaaagttgcacatattacttttgtcaccaagatcaaggagaaattaaatcatcttggatgttacaaaatcaacgagtaaatgtaaacaagcaatcaatgaatatttagattactcattgggttctcacaaacatttaatttatctcttcatttaagtcttagatgtataaagactacaaataagaacaacttatttgaaaaactcaaatgtgaaacatgtctaacttttatggatggagatagagtatatcatcggcttttttagcacgcgtataaattcacttaacatgtttggagtactagtggcacaataatagccaggtgcagccactcacgtacaacccctttagagcaggtacaatagcaggctataagccagctgcaaacatattttaagaagataaataaggagaaagaagagcagcgggctacagatttgtagtcagctgtagcacggactccaagacgcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggttcggaatttttatctccgaacccccttgaccttgctttcactcgtgctttggtataagacagtgaaagagagaggagatttcatctccatgtacatagcgacatgttatgtgaatttgcggtgatcagattctgcggctaaagttgtgtgcttatgttgttcctgcatgtttcggttgctagattgtttccttgggcggaagcggccatggatgatactgtggtactacatgacgattcattctttaagaaacaaagggagcgcagtggaaaatggtgaatgaagattacgagatggctgcgttcgttccatccaacactacagaaatttttagcgcacgataaaactcattagcatgtaattaataaaatattaactattataaatttaaaaaatgattttctttaatttttttaaacaacttctatattttattttaaaaaacgtatcatttaatagttagaaaaatatattgacgaaaaataagtaagatgaagtttggagtttaagaaaagaacttgttctccccctaagccgagctcgataccagccacgagctctcgggcgcaactagcacaggaagtgaagttcgtaaattaatcagaaaagaagcccgtgggctcaaaacgctccaaatattgcctcagtacggcccaattcactccgaaggccagcatccattgggccattggcccattggccgctccaactgcaacttgaccctaaccatctctgccctcttctccacttcccccatctcacccccaagctcggcgcaacctctctcgacgtgctaatggcggcggcggcggcggacttcgcggcgagcaagcgggccatggcctacgcgctctgcaagcacctcagcctcgatccggtgattccccgactctctagccataaaaccgtggatttctgttctggtcgcttcgaagcaaaagctttctcctgctattgttgttgtttagtgctgtcgttgtgcaggctaaaggccgattttcttatatttccgtgttgaggtcttggttgttgaagttcttcggggggattagttcactcgtagtagtagtatttagtatttgatagactcgtgaggtgaatctcataatgcgattgtattgtgctgtcggatttagggtatggttacttcaagcgtatagtacgtagttggggagtcgaaagatatgcagttatctgctgtacaattgttcgatttgtggcaggccgtgaattgatgggagcagtagtggattttttgcatcatatactatatccactatgcaaaccatgagtccaggattgaacaggatcgtccttgctgttgattagcttcgtgcttctctagttctcttaattactctaagcagtgcaattagatgattaatctagttagcttccaatgtttttggctgctgcctgccacatagtactatgtcacagtctataccttgtaaattgtaacagttactctaatactccaatagaatcaatgtgcaaacgcttttaccaaatgcaacatatgcccttgtagtcagctcttaattaagtagcttgctaccttagttcacatagtgcctactctatttctttaactggtgcctggtcatggacttgatactcctgaaatctgacttgaatatttgactggtgtacaaggcacaacgtttgttgtattgctacactgttggcccacttatatgcacttcacagttcaccgttcattactagttcatttggacaaactttgcctggctcactcttataaatctccaattgcacaattgagttctacctgggctggaagcttctactaatttctgcgctgaatattacagaatacaatatccagtacaagtattgaagagagtgatattgccaccctgttctcacatattgtgaaatcgagtgaagatgaggtaactgtttttccacgcatgtacactaataacacgtagtactacttatatattgacagatttcttcactgataggtactgaaatgggttgaattttccagcaattttgttggaaaatgtggagaacagcatgcattgcttggtaatctgaatcaagacttgtcccagaaatcagttctgttgggtaatggttttaaaccatcagttgctgatattgttgtgtttgcaaccatacaagtttttgtggtaagtatgatgtgattactcatttgtatgaccaccatcaatggtcattcataaaagcagaagttctgagattttaaccttttactgcttgtttcagagtcatcttggtgaaaacgagttgcagaaatatccacatgtattgcggtggatggactatatccaggttcgaaataaaactttatttattttgtactatcatactttgttagtatcttttttcatactacctccgtgccataatataagcacatctagcatttgaaatttgttccaaaatataagcacgtctagagtactaattcactcaccaaccaccctaatttatgaggggcatcatagtcttttctgcttaaccttagtctttgctagaaaacctagatttgcttatattttggaatggaagtagtagtttgttgctatatgttgtcaacatgaagtacatgtgcccttcattctggataaaataaccaaacgcatatagtttttttaccgtttctcttgacagtcccctatgttgctttctgtggtataccagcactgaggtgaatgcacataccatgttttttttccttgtttgttgcctggtcttattaccagtttgttcatactttataccttaataatcagacccatattaccattttatttttacatcttatgtgagtacttactgattgacgcagaacatcgttgattttggcacaacagtacaaaaggttaacttgaccaaatctgtcttcgatccaccttctgtaagtaaagatcctttcccaatgtgggctagaagtattacattttgggggtacacatattcttgaattcctttgttgtatactttcagatgttataagagacagagttgaagaaaattaactctgtcaacttaatgcaacctactgtgtttaaatacaattttgtgcttggtctgaaaatacctgtacatgttcatatcagtttatgtttaggatctggttgatataaaacctttgtaagaactactgacataatctgtggaagtgccatagtgctgggaagaaatataaatatcaacaatttttgtaaaataatcatacagtatttcctgttcagtatgctatttgaataaacaaatttgttgaggagtaattgtacaatttcctatttctgtgtgacagcatccaaagaaggcagataaaggtgacactgatccaagttcaaagaaagttgtttcaggacagaagaatgtgggcaaatcggatgcaaatgttgattccaagaaagctgcaccagaggtagttcattatgcaattatgccaattatcactagtactttgcagttctggattagtatgatattatctcagagaggtattggtaattcatgttactttgaagatttggctggaattgatattattgcattttcaactcttctctagctgcaattcatgtagggtctcatgtgcaaatgcagaacaaaactctgtggactttatgtccaataaagctctttaatcagcacataaagtattaaaatgctttatgatgtacagatatctgttgtggaagctatttttttcccctttcaagttagttgattagttcctttgttggttgaatcagaataaagctcctgagaataaggcaaatcctactccagcaaaaaataacaaaccttctggggataaaaagaaagcccaggagaaatctgcaggaaaaccaaatgagggagttgcggataaagctccacagaaaactgcagaaaaggactcagaatgcaatgtcagtatcctgaatatacaggttggccttattcgcaaagcatggaagcacccatctgctgacaggtacccataacttttctgcttatgcaacaattcaaaatggttcaacagttgtattgtgctctttgaacaaatattctaactggtctctcttttcagcctcttggttgaggagatagatttgggagatggcaatgtgcatcaagttgttagtgggcttgccaagttcttcagcccagaggaacttgttgtgagtatttaacagcaacaatggacttgaattattcctgttcatttttcttgccatgaaattgtttcatccaagattctgttttctgtaataaacaactgccttttccttcacagaatcggcatgttgtattaatcacgaatgtgaagcctgggaagctgcgagacgtaatgtctgccggattggtatgttctattccataaattatatttatgctcgtgtacaggcaaagcatcttgatatgtgtcaagcagttgatttataaactacatccaacatgtgacaaaagatccatgagcctatgatggaatactagctttaaataggcattgctgtagaccccaaatcattaggtcatgtgtatgctcttgaagtctactgtagtacatctaaaataggcaatgtaacacttctcactgatgaaacaatgaactattttagaagtgaagcctcaccatgtgcttggtatcacttatttagtcatttgtgttctttctccagtcttagaaatggtaggaatataaactttaagttaggaagtcctaatttccaaatgttgttttcacattgaacatattgccaggtcttgtgtgcttcaaatcaagatcatacagttgtagagccattgattcctccagaaggagctaagcctggagagcgtatttcatttgcagggtaagaattatgttgtatagatgtgatatctgcattaaaattttaaaaaacgtgtttgtgcagttctggggagcatgttctgttcaatttgacctatttgcattcatggctttaaagtcagcttgcacaagcttatatgcaattactgtcttttagattgttatacaagttgtcccctaatatgttggtcgtaagggaagtccaaacaggatggacccatgttgtgtgatgatctttctgtcgtctttcaaggaaaataatattttagcgtagttagcatttcggttgttattagtagtgtcttgtgctgtagaaattatttgattgtgtttggtgtcctgcaccgtttgtgaagaaaaaaaatgtttataactgtccacctttcagttcagttaaattacttatccttcacatataggtttgatgggaagccagaagatgttcttaatccgaagaagaaacagctcgacaagatcacaccggtatgcttttaccaatgcgctatttttgcatgatgctctaagttatttttcccttttagcaatcacatgattagtctgcccttccagcacaatctgggtgaattaaatcagttgtcatttcttttgcacatctgggtgtcattttttacattgccttaacaaattcaataattaaatacagacaattcacaaatcgtgtttgctatgcgctgagtgctcttgaaggctgttgtgtatccatttgtatatatactgcatgaatcaaccaataattaaattttatcatgcacccaggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtcaatttctctttaccatttagacatttaattcaaattaatcaatgcaattctaatcggcaaaatcaaagtaattgctggtagctgttctcaggagcaataccttgcttctttcgagggttagcatgaggccatgagtatcgatttctttcttgtggagttctttttgcctgccttccgtcttatgtctcacatgcaacagcttggcataagcaatgtatgtcatttgagtctttttctttgtatccatcgtgctgacattgctccatgaggagggcaaatgcccctcctggagaagctttgattgcggtaatcaataaaggaatcgattgaaatctgtgtggttgaaatgaaactgggtatgtatctgaaaaagaaagttcaggctgggctcatagttgagattcaatcggttaggtattctagtgtttcagattcagggaaaaaaaacagctataacatccacagggcttcttacggttttgttttggtctgcccccacacgtcagtgcctgccactgcatcagcagtacacagtcgacaatctctactgtaggagacgtgtgctagcttatgcttatgtgatcttttaacttgttgaagcaatcagcattgggcatggtcaccttaaagtatacctttgtcctttgagcaaagagatggagtgcatataattatgagcaaaagagatacatctaattgtgatctttgggtgttttcaagcaaccatccatttgcccccacgttaattctcgctttggccctcgtgccctgcgcttatatgcatatcacctggactatttactgatataaattgaacggccaaaaaaaaatatactgtagcttcactgcatttttcttgctcgatgtagaggatccgattcgagagtgaaatactgttactacaccaatggacggcgcatattttcttgccgcgagcacaaggccaaaggtttgattgacagaacgtccactttaaaaaacctggttgaaacagctgaaaacgaaacgaattccagcccaccaaacacaattacacaaacacctccgagagctccgaaaccgaaagccccctcacacgaaaaccccaccaaactcttcttcttcttcttcccccattttcctcgcgttcccctcgtgccgcccgcctccgccg

SEQ ID NO: 78322 - DNA, 2643 bp, Oryza sativa
cctccaccttggatgacggcggtttcgtcatggcgaaatcgaagttgagttgacgttgaacggatctccccagcgaagtcgccaaaatcgtgttggcaactttttgtgataagttgacaacaacgattgcaacaccttatgccttgcggtgatcctattgtcacgaaccacctcgatctagcaaagagccaaacctagatgggttttgacaaataaaccggctagcggagccaatttaagataattacccgtctcgtgggcaaaacggaaggttttcaggacaaacctacaaagagatgttgcactctcgcagcggcggcggacggtttacggcgcaaaccgacaaagatggacaaactaagagaaaactaaaagcaatatgaaaaacgattgaattgattgattgtagattggtttcttacaatagaactggccatgtaccttatataggggttggtcttgccctctacaggccctcctccatgtccaacttgggatagaaactaaaggaaacctgaaacatgccttcccgagcaaggaaacctcgagacctgacgaaacacagtcggactcggacctgccggtcagaccggccacacaccgccagtctgaccggccctcaactggcggtctgaccgcccaacacacggctgtcagaccggccgactcgaaggaaaccgatagacttctaaattttggcaatctttcttattttgatcctaggtgccaaatttgggtgtaaacacgtacttagtaccattgaaaaaaattgatgatctttaaatatgagtttctattatttaaagataaaacatacgattctataaatttacgtaaatatcattcatgaaacgtcctataaatgatctcaaaccatcatgtgttacttgtacaaacactactagaccaccacgtgacactgtcattgtataaatttacgtaaatatcatccattaaattttctatgaaagctctcaaatcgccatgtgacacttatacgaacgctcctaagctgccacgtggaactgtcaaatctcaccgatgattttcactttagcagtggatccgatattttaaaccattatattattatattagatgtattttattttaaaaactaattccttaatccatatatgtatatgggagaattatataactgtactagaaaaaaaatacttgtccattgctacggatgaaggctattttaatcttattcttattatacggtttaactaggatgaaatttactctggaaattcgcttttttttttttgaaaatcattagctgcaattaggagtctgactttcatctcaagttagcatgcgagtttgtttaaagatattttttatataactatttttgtacttccaaaaatgaacgaacataaaaagtgactcaaacaagaatcaatattttcaaaaacgaacgaaattaataaccgactcaaacaagaatgacgtaccaaaatatcggcaaaaaacttctttaatttttataatagtggagaagtatccatacatacgtacgactgaaaaaaacaatgaagctttacctactgttcatctaaagaaacaaataaacttacgcacagacttactataaagatcaataaagcataaaaaaaacatacgtacttagtaccattggagaaaaatgacgatatttaaaatatgattttctattatttaaagataaaacgtatcactctataaatttccataaatatcactgttgatttcatttaaattgataggcccgatcgattctttagaacattggataatgtatacattatatactaaaagtccattaaacttcctaaaagtgctcctatgttgtcatgtgttgttctacaaatgatactatgttcatcacgtgtcagtctaataaattactgaaatacttaagaaatctagaaaaaaacaaagcaaattttcattaaatttgatggacccattatttataactattggattatttttttttagaaaatcatctccttaacccgggcctacctaaaccagtacgtataagtttcattttttttaaggaaaaaacaaacgaatatatgtatgtatgccccctcttccctcaattcttttctctacatttttacccattccttcttctatttgcatgctttattagttagaaaagcaacaattatgtgtaaaacaataaagcatctacatcatataaataatttttgatccgttatgtaaaatcaaaggtgtttttgattattattctgtgatgaaaaattggcattgaagattattggttttgttatttagaatttattcacgaagtggatttcagaggtgattacaggttcattatttcatgtgaccgatcagaccgggcaggtgttgccggtcagaccggcgtgtaatgcgcggtcagatcggcgcagcccgcggtctgaccggccgactctgtgtcggtttcggtttcgagttgttccgtgattatgtcatgattatgggcttctagatggatactatacgtatgtaatactgttgttcgctactaatgagtcaagtttgagataacttggtctcggaatatggtttctttgtttatttcatgtgtaggtatctacttagaagcccatgaagccatcagtttgtcaacaatct

SEQ ID NO: 78323 - DNA, 675 bp, Oryza sativa
gacttatcttacaataaacacaagaattagcatcagctacacgaaaaaaaatgcaatcccagttattgtactcaaggaaacttggacatctatgaacatatccagttagccacacatagttaacagcctatgatggcatatgctggaactaaatgtagagttttactggttactgaccacaaaccatatgacaaattccgagcataacaagtactacctccgtcccaaaatacttgtcgttttgagtttttgtttgtaatgcttgaccattcatctattcaaaagaatatggaattattatttattttgtttgtgacttgctttgttatcaaaagtactttaaatatatgacttatcctttcctatatttgcactaatgttttaaataagacgaaatggtcaaaagttgcaagcaaaaagtcaaaacgacatctaatttggaacggagggagtacattactacccaaggttggtaaatacaagacctagcaaccaacaacttgaaaatacaattaaaagacaaaacctcccaaaaaaacacttcctcaaacaaagcacaaaaaatgaagattcaatttcacttggtatggtatcagccaatcattttgccacagaactgaacgcggcaagaaattctatatttccccagcactcacccaaagtattcaaggtcac

SEQ ID NO: 78324 - DNA, 1645 bp, Oryza sativa
  unsure (1)..(1645): unsure at all n locations
cagagtantagcccttgtgtgatggatgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctagagctggagttcaatcaaacagtttcaactatacgtaaaatcttagttattaagaccggactggaccagcggttggaccggggaaaaaccggaaccaatgccccaaccggtccggtccaggtaaaaagaccggcatgcaatcggcccagcaataaaccggttagaccgcctggttttagagaaaaaacgccattaaaccggggaataaaaccgcttccaaccaggcttggcggctgctgtacgcgcgcatgggtgctgttgggggaaaaatgagagaaaatgtgcatgggtagcattcgaaccggttagactgcctggttttagagaaaaaccgcctggttttaaagaaaaaacgccattaaattggggaataaaaccgctgttgggggaaaatgaaagaaaatatgcatgggtaggattcgaacctagaaccataaacaccccaaccaccaggctatcatgtcctttgtgtttagatagaatgcttaatgtatttaatagttattgaactggattaaaccaacggttcaaccagttgaaccagtgaaccattgaatcgagagcctcaccggttcgattaccagtccggtcttaataactatgcgtaaaatgggagtgagaggagctggatggagttctctttactaaatgaactatagaggtagagctgggcttaggcaactctaaaactccactccagacctaatttctagagttaaatttaggagttagaaatctactaaataggcccataaatttgcaattcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatcnccgggatcccctctacatcatcta

SEQ ID NO: 78325 - DNA, 17752 bp, Oryza sativa
  unsure (1)..(17752): unsure at all n locations
aatgaagtagtagaattttttttcaagaacacatactttttttaagtgtgaaataaataattcgttttaactatcaataacctggtgaataagcttaaaagtgggccttaagaattgcaatcataagcaaacaaaagttttcgagtgcacttgtcatgtgtcaccaaaaaatattaaacgttgtgttcttttagtttttccatttaacgcagcacatatattcatttcacatagcctttgtggctttgtaacaagccgaaccatctctaatacttcatccgtttcacaatgtaagactttctagcattgctcatattcatatagatgttaatgaatctaggcatatattgacggtcgttatcgatcagtttcgagcgtcaatattaccgaaagagagaagaactagttatgcttgcaatgcatatttgtgttagaaaaataatattccactagtattagatttactaaccttttcaagaataacaataaattggagaagaatcgacatcaaaacagacgatcaatcaatcagacgatgtcgaggatcagacttatacatgaatgggccaagaacttagaaatgacacgtcgaaacggccaaaattcaaaagtctatatagaggagcagaagaggaggccacctgccgaaattgggccaggaaggcccggcccctggttcggccgaacccgaaccctccctggcatcgttggatgcagggtttcttctggacggtgtggatcactctccaatgatggttggagggcaattccgaccgttccaactgccacaaccgtcattggcagcctattcaaggagttcctcttctcacttcctcggttcctccacacacttcaagcgagagctctctcatattctctcaagtttagtttagtgttcttaagctagtggagtaggaatagaatagaaatcagagtctggaagtcttcgggtatggctctggtagctctcctttcctcttttgtaagctttgtactttatttagaatactcttctttgtacatttttggtattgaaatacgttccgaatatatgaatgccaactttactttatgttcatgttatactgattatactgctagcttatctggaagatgcataggtacgggtataatgtttgctattgcaattactctatgtcatgacgatgatattagagtagtatctggtagtttaggcgtggtgtctagattattattgggtatcattatttggggttatatgttgcggatgagaggtgggccgctgatggtgaaagctcagtacaggtattcctctgcgcgtgtatatagttctaagttaatttcctgggaagggtactcctccgtatttagccccgtatggtcatgacagattgtcgtaaggaactcggcagtggggtggcttctcgaagtactaggagggcatcggaaagagggtattagctagttaatcatataactagaatgtatgtatactatgtatatactagaagtataggaataggttcttttctattttctttccacttaggttagataatttagtatgagaataagtagacttatgcttgtgtgtcatcttaccctttgaattatcttaacccctgcttagactatgattattacaactaacatataaactattagtacggttctctctactatgatcttcccacatgattaaataattacgatacccttggaatactctcgggtgaaatgctacaatggtatatccgtgcgcttacggataaactctataaccataatataccaggagtatttctgcgccattgctgggaattatatttctagtaatatcgttaagaaataccaacagtatatatgtgtgtctagattcattaacatctatacgaatatgggcaattgtcgaggaagtgatcctctctagcaggagatcgtgggatccccctttcgtgagttcggccggggggaaaggcccgcctctggaaatcacgtatccgaccccaaggctgctagctagcgtgtaaacaacaagattatacaagttcgggccgctatgaagcgtaataccctactcctgtgtatggaatttagactgagagttacaaaggttcctaaactccggagagcgctctcgcttcccttctcctagagctcaggttttctgagagccgtccgctttctcggtgggcaaggtcatccttttatacctcaagaggataccacatgcactgcctctaactactcttctatcgggtggggacccaccctaccttgaccggatctcgacctgtgccttcgcctggaagctaagccacagtttgtccttgagtggggcccagcgccgtccctcgcctgacacgggggacagccttgtcattcccttattaatgggtaaagacttgtggtggccgccctctcatggggagaactgcgaatgaccctccgatgggacgggtcatacctacctccactccgccggaggcagatgtgacgtgggggcacggccgtccgtgcagtcagacgtgaccggcgacagaccggtcacagatcggtcattcgtgaccgacgcgagccagtcgggcacgccgcacgtctgcccctactgcatggaatgcggcagggggcagttggggcgctgcacgcattaaaggtcgttcagcctgggcccgctccccgcttgctccccccgccagatggcagctgggcgagggcctcggggcaaagcggcgtgagggcccgaggggtatgacgtggcaccccgaggccccccggccgctcctgtgattcgcggggtgcgggggtagggctaggctgtagggtcacgcgacaggatgggaaggtaaattcccctcacttcgcataccccgggcccatatctccgacagtagcccccggcaccacatcggacgttggcctccagaggtcggtctgacgtggcacctcacgacttctcaatctggggttgtgggcccggcggggaatctaagcggatgccgccgagcggccaggttggcgtattaacaataacggcgatttgaccgtcactaaccgcgctgatgatgggggcgcttaaggcgcgaaaatcgggggggggggtcggttggaccacacctcgactccctcgcccgccacgtatgcgacggtactgatggcggcccgcctagattgcgcccgtgaacgtcgcacgccctactccgagtgtgccgctgacaggcgcactaaatgcggggcgcggattcagtgagcgacgtgatgagtggtagcgggaaacgatcaggcaactgcaggcgcaagaattgtgggggcaaccgtgagggcgtgaaacgaggaggcaagcgcgggcgaggcagggataaaaggatacggtggcggggactttgcctccttcctttcgccaactacaagacacatcttcctcacgtgtaaccacgtgccacataccaccacggtatacgaacgtaagacgtgacatagttttcaacccatcctagccatagacaagagtaccgacccaaccccacctatggccggaacctccgggacaggtaggcaggactgagcccctagcagcaggacaccagccctgtgccatgacatctcgactaccgagtgtcacgccctgtagttcccctcccttgctctaaattcataaaataaatcgtccgaagaaattgtttaatttaacctagagataaatccctaattaataaatgcaaataataatcggaatcgacatgtggaatttttcttggattctacatgtcaaaatatgctaacaggatttttagtggaattttcagaaccttggaaataattttaaccaattaaaataagcaaagtgcaatattaaatccctgggaaaatcctttttcctttttatcttttcttttccctcctttttcctttttcttgggcctggcccattccctcccgcgccggcccgcttcacctcccccgaagtccatccaacctcccctctcctcccgggcgccgacaggtggggcccacctgtcggtcgtccctaacctccggcagccgccaccatccgccgccgaaaccaccgcccacgccgccgcttcctttgcatccgcgccccactccgcgcccacacgttcccacgtcaccgccccacgccctgccctcttccgtccgcgcgcgcgcccgcacggacgggattcgatttgaatcctctccccctctctctcctcctccacctcttcacgtcgtcgccgcggaaccgccgttcccgaccacgtncggnctcttcacctctatataaccgaccaccgcgcctctctccacctttttcctctttcgccgtccactcccgagctccctatcgccctagcaccgggcacggacccgccgncattattttcaccgctccggccgcctctagcagccgctagggtcgccggcgcaccccgccatcggcgccgcgcgtccgccatcccttgagccgtcgcgtccgccgttcgctcggccaaatccgtcgtccgagcccgtttctccctactccggtgagcttccaccattgccgccgccttcggccatggtttccgctcgccgtagactccctctctccctctaatctctctctttccctctcttagggcaacccggagcccgtcgccgtcgtcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggccgctcgcgccaccgcttcggccgccgccgccgtctttgcgccgtccgccgctgcctccgtgcgcgcgccgccgccctcgccataaccggccggccggcttgaagccgagccgagccaggccgccttccccccctttgtgacgctgcccagtgggcccgcctgccagccgccctctctccctctcttagtgccgctgaccagtggggcccgcatgtcggcaccgccccacccccttgctgacgtcagccctgggatgaattattgcgcaataaattgattaagggtttttttttatagtaataaacacagataatcttctaaaaatcataactaattcatccgagctccgtttaagcccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgtttcgcggattctcgaagacgttgctgtggtctcatcagtgcgagagcaaggcaagtcatacattgcaattgatcatattgtacctaatatacaaatgtcccgcatttctattaaatattacatttgttttacaatatcatgtgggatgggtcctattactcagccatatattgcttaccttatgccattgataacgtgggtattaaaatgactagatattggtttaggagatgcttagccatgcttagttcaactagtgcacaaagggggattacattaaagcatagacttgattattggcatagctttgatttagtgccaccgtaatggtgttggttaattaaaatacacgtcatggtgggctgtgggtgcatggtcttgctagtcacacccatggcatttaaggaccggttcgcgggatgccctggaagaacttatcgtacttaccacaagccagcgtgggcaaaggctgggcttgtagtgtagcttttctctagccgacgtacccaggcgagggtgggcgtgatggagttgggtcggccggggtgtccggttgatcggcttccggattcaccgcgacacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttagaactggttagttcaggtggtggtttgggcctgttgcaacgtggtgtaacgttggacagtgattggttaatatagattaattactacagctgttttactgctttcaactactgcttgaaatgccggctttatgcaaaagaaaatttagcctcccttggatatatcttgcatcatacctcctcttccggtgtgacttgctgagtacagtgggtagtactcagtcttgctctcttttcccccacaccagagttgaagtccttctcagttgaggatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccgagccacagctcgtgtagccttcatttgccctagagatgtccatcgacccccgacttcgtccatctccatccgtgtacttttgtttataaccagactgagccacaaacaaagccttacccactagacatgtggaagtacggtagtgctttgcaatagaggcccgaagaccggtacttatatggccgaggtgctactatcaaaaccatgcaccccgagcccagcctaaaaccattttgaggattttgaatagaggggaaggtgtgagtccaattccacaataatccaactattccatagtgtccaggtgatgagaatattcccaaagtctagagttataaaaccacctaatgttgcctaattaaccagcgaagcatctacctaaattcatactagtggtaccatgagtagagtgtccactagttggggttttgtttattctagggtgaacaaggtaataataacaatagcaataataataaggtcataacaaaggtaaataggcatggctaaataaaatagtgataacgcgagaatttaaataaagcgataacgcattaatttaaatcaaaataattttataaactgggattcaatatgttcaaggatgatgtgacttgccttgctcgctttcccaaacgtcggcttcaacctccacgaagagtggatcttccgaagctgcagcgtctacacgaccaacggaaacgaaaaaggcttttactctaataaactccatataacaagcaggaacaaagcacaaaaatgggttcttgacttcttaaggaaaaattagagacttgaacggtccaattccgagttcaaatggccaagttatgaccatttgaagtttatatgctctttaaatgaatatttgtgaatttctttatttaaattttaatttaaaaatggtttattgtcagccgagggggaggggcgcgcggaccgggtccacgggagtggggcccacgcggcagcctcacggtccacggtggaccgggtgctcccgggctcacaccgccggcgccgtgggccccacgcgtcagccgcacccgagggcgcgggcggctgacggccgggccccacacggcagccactcggcgtacccgaaggcggccatgccggcgcggtcggcaggaggcggcgcgcctgcgcccctatggtcgccggcggcggccataggcacggcggagcggcggccgaaagaggggagggaaacggggaaacgaggcggcggtctacggctcaccctaggtcgacggcgacgacgaaaaaggcggccgtagcggaggaaggcggtggcgtggctcgggtcgacggggtcggcggcgttccggcggtcggcgagctcgacgagggggtggacggggacggcggcggtgcggcgaagccggaggaggcgacgccggggcgggaaacggtcccggcgagcggggagagccggccgaaggtcatcggcgacggaggagagagagggcgacggcgcgagctcgattccggcgaggagacggtgcggcaaggggcggaaacgggcgagggaggcgcggggagggtttaaatggggttggaagggggagagggcggccggggaaggaaggaaaccggccgggaggtccggccgccatcaatggcgccggcgagatttgcgggagcaaatccgcccgtttgaatgcgagagagagagggaaaaatggggggaaagggggaggggatcacggggaatatttccccccacattattgcacgcggggacgacgggaggcggcgggattcgcgatggcggcggcgctaggcgcgggcgaggcggcgggaggaaggggatgacgggtgggccccacccgtcagcgagggtggcgtgcgggcccgcccgtcagcggcacgcgcgaggggaggggccgagtgggccgcggggaagaggagagagggggagggaaatgggccgagccggcccaagagagggaagggggatttttagggtttttctttttataaaacctttttaactttgtttatttcttaacaattattatttgtgctctgaaaattccactaaaatttatttacacattttaggcttttaggaaatatacaaaaatcctctaagccttatttgacttttactttgcacattttaagttttggacgctttcacatagattttaattattctagacataatttaaaggatatattttagggtcgttttgggacgcgacaggtgtggccgacgatgtggctgttccagtccttcttcgtcccgcagctgctgcatggtgcggtggtggggggatgctacttccagccccgacgaggcacggcgggccatacatcgagagtcatctctggaagaagtgagaggactagaagaaggactggttctacaccgcattgccagaccacctgcgacttcggttctccgccgccccccccccccccgaacgatcagccgcatggctggcggtttcggagctgggcgaggagtacgatgtagtgcagactcgccttaggggcctgcgaagccagggcctcacgggggcaatggtctttggcgattacttccgccgccgcatcgtacctctccaagagcggtcccgcggcacgtgggagtacactggacccaacgatcccatgcgcacccatgtgggtgagcgctgggactggggcgaggacgacgcgaagacggtgattcgtcgggtgctgggtctggacaccgccgagcaaacactgatcccagacaggatccttcccatctgcagcgaccgcgaccgggaaagtatcctggctgtgatgtcggccgtcggcgccggcaggggtcggtcccgccggggcagcgccgtcggcatgggtagcagcggcgcgaccgtaggtgggagtcgaaccagtggctccggcgggggtggtagctccagggcacccggcccgagccgcgggcccgggggagattcggccaacgacccgaaaggaaagcggaaaatgtccaaatctcgaccgccctctcctccgtgcatagggggcgccgagcgcgtggcggaccgaccgaagttggacggaagaagaagcggctccggaagaaaggtcagacggagccgtgccgggggagctttatcgagcccccaaattggaccttcaaccgccctccccacaggtacgactgccggcatccgcttcggtgctctttactcatctcggcctcttgttccttcctcttctttttctttgttaacgcgatcagggttcttttgtagcgagattccttcccagggggtctcggcgtctgaccctttgttggggtcaaaatccgagcgaccggagcggcccgggctcggctgatccagcgccgcggggccttcacagccttacggcggggcccacgggccgcacgccgggtctggccccgagtccaccacagtcgggacaagacctgccgcgagcgacagcggccgcggcgtccctcccgagggcgacaccgaggcccagacccgcgtgtagtgccacccgggagcgggggccgaggggggtcgcggcccgaaagctgaggctgggggcagccctgagcccgaggctgaggccgaaactagggcgggcccgagcccgaggccgaggccgagtctgcccgagggcccaaaacgggggggcgagaggaacagccgctcccccttgcatttggggtgccctcggggctggccgcgcgggaggggggttgagagcagccccctgtctcgcgggggatccagcagcactccgtcgttacaggggcggaccgcaactttctcttctccgacgccggcaagtatggagcctctcctgcaggtgctcgccaccgccgattccaccgtccgggaggggctcaacgcccaagtacaagccccggcggaggagcgggcggccctggaggcagagtgggcacagcttgtggcggaccgcgcgcgggttgacgaggggcgccgcgccgtggacgacatggtggaggtggggcgcaaaatgcgccaagcccaactggcagagatccagacgcgtgaggaggcggcactgatcacctcaagcatcctagatgaagcgctgggtgacatccgcttgcagtacgaggcctatgcgaaggacctgacgaagagggtcgaaaatgcctgcggtgtcattgatgcggctgccgcccaagagcggcgggcctcggaggccgacgcctcgctgcgggctcggacggcggcgctcgaggccgaacgcaaggccttggacgagcgcgctcgctccgcgcaggagtttgaggccacggttcgtcggcgaatcgaggtcctcgaccggaaccagcgcgagcaagacgcgcgcagccgggagcaggcgcagcgagcccaggagttggaggagcaggctcaggcgctagaggagcaagcacgtttgctagaccagcgggagtccaccttggccgcccacgagagaacggcgacggaagcggaggcctcccttcgtcttcgtgaggaggccgcagccgagcgtgaccagacgacccttgctgcgaaggcttcggcggcccgtcgtgtagaggagctacggctccgggaagaggcgtgccgggaacgggacgccgcgctcgccgagcgcaaggccgaggtgaaccgccatgaggtggcgacgcgccggctgcgtgtcacgcccagaaattcccgaatagaattccaagtagaatgtgcattaaaatccccgtccaggaccggccggggtacacaagcgacaaagttgacatatagatccacgtcttacaaacattataaaagtcttacataaatgcagcggaaacttaaaagataactagagctaagccttgacttggactgcagcgggaacaccactccacaggcatcctcaacggcacggacgaagcctactcctcggaaaagccaccatctgacgcatactcaaactctggggtttggggaaaatagagcaagactgagtactacccactgtacttagcaagtcataccggaataggggtatgatgcagggaatcatcaagggatagctataatggttcatttgcataaagcgagcatttataaaccgaagatggaagaagaaaaacagttgtaataattaatcaatattaatcatccactgtccaacactataccacgttgcaacaggcccaaccaaccacctgaactaaccagttccatcagactatactagggtgagactaatcacggtgaatctggttgaccgcccataactgcgggcacggctattcgaatagttttactctgattagaggtgtacaactgtacccacaagacatagccccacgacacgtttccgtgtgccgacatgccaccacgacataccagaaagaggccgtgacaggacccttcgcataaccccctctaaccaagcacaccacacctcaggtttcacccccactcctcgcaaggcagtgggcagtcccctctcgtgcctaggtgaatccgaaagccgcataggccgtcgcagggcccatccaaactccatcacgcccacccttgcctagatgcgtcggctagaggaaagctacgcttcaagcccagccgttgcccacgctggcttgtggtaagtacgaggaaggggagggcggcgccgacatgcgggccccacatggcagtgactcggggagggcggttcacggtggaccgagtccacggaccggggaaggggtggcgcgccacgtggtgcacacgtggcgctgacgcggcgcacacatggcagccacgcggcagccccgcgggtggctgaaccgacggccccgatctacctcgggtagatcggacggcggcgaggagcacgcggccggcgcgcacgggcggctcgagccggcccggcggccatggcgcacggtggcgctaccgcggggcggcggcgcggcaaacggcggtgtccgacggcaagcggcggcagcggcgcgacggcgcggcgacgctggcggcggctaagcggctaggcggtggcgcggtgactagacggcgcgggagagagagagaaagaggaggaggtgcctcaccaacgacaagcgacgacggcgagcgacggagggcgatggtgacggcgggacgatctccgggaccacctagcgaacacgatggaaggggttagagagggagagggatttggaacagggcgaggacgccggccgaaggcggcggccatggcagtgctcaccggcgcacggcgcggagtgggttccagcggtagaatccgacgggagaggggtggacgggctggcccgcacgatggcgaacgcgacggcgtcgtcggcgcggctcggcacggcgtctagcggcggctagcggcgaccggagcagcggcggcggtggcggagaggagggcgacggcgctagggcgttagagagcacgggagagctcggcgagattgggaaaaagagagagggagtggcggtggagcttaaatagaggagggggagcccggacgtggccggtagaggcgggaatcgccggccgaagtgggggagtggggaaggagagagaggcaggattcgaaaatcgaatcccggctatctcgagcgcgggcgtaggcgggagagagggggaagtgggcgcggggaacgcgggtgcgagggcgacgtgggcgacatggcccgagagacgcgggagcggggcgcggcggcgccggctggaggaatgggacgggcccgacaggtgggtcccacctgtcggcgaccccgggagagagaagcgggcggccggctcagctcggctgggcctcggccttcggccggcccagcgggaagaggaggcagagggaattgggccggcggaccaatcgaaagaaaaaaagggggaaaagaaaaagaaaaggaaggaaaaggactttcctgggattaaatattgcttgtgctcaattttaattggttaaaattatttctagagctctgaaaattccactaaaaatctggttagcgtattccgacatgtagaactccagaaaaatttcacatgccaaatccgattattgtttgcattaatttattagggtttactcttgctttacaccggtattttcttgagaccatttataacttcaatttaggcttgggaaagaacttcagggtgtgacactgggcgagcaactcgcggaacgcgaggaggccgtcaccgggcgcgaggctcggcatctggagagcgctcgtgccgagcgcgcggcgatggcggcgagggcttctaagctggaaggccgggagaaggacctggcggcgggcgggtagcccggcggcgcgaagttggtgagccagcttaccgtggctcagagcactcttgccgacctagggcgcctggtgcaagaccaagctggggagatcgcggccctccgccttaccaacgagatcggacccgggcaactctccgatgccgtcgatcagctggagcgacttggagtggtccggtttgcccacagcacagcgggcaactcttcaagccacgaatccccgtgcttcttcaagacgttgtacgtcttagtcttgaggcccttgaggatttctacgttggctcgctcgacttcgccgttgctcttggggtgggcaggcgaggcgaagcatagcttgatgcccatgtcgtcgcaatagtcgccgaacagctcactggtgaactgggtaccattatccgtaatgatacggttgggcaccccgaaccgggacatgatgcccctgatgaacttgagggcggaatgcttgtcaattttgacgaccgggtaagcctcaggccacttggtgaacttgtcgatagcgacatacaggtgttgatacctgcctcgagtcgctttgtacggtccaaggatgtctagcccccagactacgaaaggccaagagagcgggatgacctgtaaggcttgagccggctggtgcgtttgcttggcgtggaactggcacgccttgcatcaccggacccattcctgggcgtcttgcaatgcggtcggctagtaaaaaccttgtcggaaggctttaccgactaatgtgcgtgaggccgaatgtgccccacactcaccttcatgagcgtcggcaatgagctcgacgccctgttctcgagaaatacacttcaagagtatcccgttggcggcccgtcggtagagggtcccttctacgagcacgtactgcttagagatacgcgaaagcttctcagcttctgcgcgaccctcaggaagagtattattgtcgagatatgcccagatgtcagtcatccaggcgacgtgacgaggggtgtcggggtcgaccccctcgggccctgaggcccgtgggtcgtcggggcttggggcggaggtcgtggcaccggggtccctcgggggggccaattataccgacggctgcgcgagcctttcctcgaaggtcccaggagggagtggggctcgtgccgacgcgatacgcaacaactcatcagcgattgcgttgtcacgtcggggcacgtgccgtagctcgagtccgttgaaatggcgttccatacgtcgcacttcacggacgtatgcatccatttccgggtcggtgcatcggtactccttggagacctgattcacgactaactgggaatcgcctaggaccaggaggcggcggatgcccaatccggtcgccgccctcagccccgcgaggagtccttcgtattccgccatattgttcgtgtctcggaagtcgagccgaacgacgtacttgaggacgtccccgcttggcgaagtcagcgtgactccggcccctgcactttgaaggttgagggagccgtcaaaatgcataacccagtgcccgacgcgaatgtcggcgtttgggtcctctgcatctccggggagggagggaacgttggacggaatagggtcgtccactggggtccactccgcgatgaagtcagccaggacctggcttttgatcatgtgccatggttcgaagtgcaggtcgaactcagcaagctcgatggcccactttacgacccgaccagtgccctctcggttgtgcaagatttggccgagagggtaggacgtcactatggaaacccgatgcgcttggaagtagtggcgtaatttccttgaggccattaagactgcataaagcatcttctaggcctgtgggtatcgggtcttcgcgtctcggagcgcctcgctcacaaagtagacgggccgctgcacctttcggtggggccggtccttgttgtcaggggcagatgatctggggcgcccttgctcaagggccccaggggggggtctcgagccatgtcaggaccataggcctcgggaccactcgccaaagcctcccctcctcccacggaggcctcggggtcctctcgggggttgggggcttcgggcactgggctttcggggaacgaagtgccattgccaatcaagggggcctccggtccgctctcgtcacgctcgactactagggcggcactcatcgcatggggggtcacggccaagtagagcaccaatggttcctccggccccgaggctaccaagatggggggaggtgaggtaagctttcaactgactgagagcttgctccgtccacacaaacggcccggggcgctagaggagtttgaataggggcagcgccctctctcccagcctcgatataaatcgacttacggcggccatgcatccagtgacacactgcacatccctaagcttgcgggggggggggggcgcatcctctctattgcacgtattttgtcgggattagcttctgtgcctcaggaggagactagaaaaccgaggagtttgcccgccggcacaccgaacacacacttgtcggggttcagtttcatgcgcgtagacctaagattgtcaaaagtctcggccaaatcctgcaacaaagtgtcctggtggcgcgtctttaccaccaggtcatcgacatacgcctctatattgcgccctacctgattactcaaagtaatacgagtcatatgctgaaaagtagggcctgcattctttaaaccaaaaggcatagttgtataacagatagtgcccataggagtaataaagacagttttttcctcatctaccctagccatgcggatctggtgatacccagagtaggcatctagaaaacacaaaaggtcacaccccgcagtggagtcgactatctgatctatgcgtggttaagggaagggatccttagggcatgccttgttgaggtccgtgtagtcgatgcacttccggagcttgccgttggcctttgggatgaccaccgggtttgccagccactctagatggataacctcgcggatgaagccagcctccaggagcagcgccacctcctctcggatgaaggcctaccgctccggggcttgacgccgtactttctgccggacgggtcgcgcgtctggccgcacggcgaggcggtgctcgatcacctccctgggaccccgggcatgtccgacggcttccatgtgaagacgtcggagtttgcccgcaggaaggagacgagcgcgctttcctatttggcgtccagggtcccgtcaattttggcggtcttcgacggatcattgccaagggggatctccttgacgggcacctcgtcagccgaggtgaggcacttcttggaggcgcaggacgcggaggcctccggggcctgcggctccgtggccaccgccaggatgtcgacgcgctgctccgtgcaggcgagggcgaccttgacattaccaaagacggtgatggggccactagggcccggcatcttcatctggaggtaggcgtagtgggtggcggccatgaacttcaccaacgcaggcctgcccaggaccgtgttgtagggcagattgagatccgccacatcgaagtcgatccgctcggtgcgaaagttggtggagtcgccgaaggttaccgggagctcaacgtggccgagaggccacgtgtgtcccggagtcacaccgatgatcggcagtgacggctggagcttcatccccggagccttgagcgcgtcgaaggcagccggggagatgatgctcaggctgccccccctcaatcaaccaggacgcgcttcatcctgacgttgtgaatggtcagggagaccacaagggccaacttccctccacgagcgagcactgttggatggtcgctctggtcgaaggtgaggttcacctccgaccagcgcgccttccgagctgcctcgtg

SEQ ID NO: 78326 - DNA, 998 bp, Oryza sativa
  unsure (1)..(998): unsure at all n locations
tatcgagtatgcagcattgttcgaggaaacgcatattttttggagacacttcaaggggagtgttttcagcgagcaatcaacgggaagtacttgaagaaatacttcccgagcgtttggcaacacgcttaaggaggtactatgacaagtacttggattatcgtcctaagaccaaaacatgttctacgcttttagattcacgttgttcatcaaaaaggcaggggggcatgtgttaacacccaaatttggcacctaggattaaaatagggaaaattgccaaaatttggaagtctatcggtttccttcgagtgggccggtctgaccgccggttgagggccggtcagacaggcggtgtgtggccggtctgaccggcaggtccgagtccgactgtgtttcatcgtgtctcgaggtttacttgctcgggaaggcatgtttcgggtttcctttagtttctaccccgagttggacgtggaggagggcttgtagagggcaagactaacctctatataagggacatggccggttctattgtaagaaaccaatctacaatcaatcaatcgaatcattttttcatattgcttttagttttctcttagtttgtccatctttatcggtttgcgccgtaaaccgtctgccgccgctgcgagagtgtgatatctctttgtaggtttgtcctgaaaaccttccgttttgcccacgagatgggtagttatcttaaatcggcttcgctagcctgtttatttgtcaaaacccatctagatttagctctttgctagatcaaggtggttggtgactctaggatcactgcaaaaataaggtgctacaatcgttgttgtcaacttatctcaaaaagttgccaacagtacgtatgatcgtgcgctctgaagggttcaaagnggacatggggggggnaaaatatgaaaccgtatagagagttgagggggatgcggcataccgctaaaagagagattacggctctaaatctgaatcagcgaaggggg

SEQ ID NO: 78327 - DNA, 3718 bp, Oryza sativa
  unsure (1)..(3718): unsure at all n locations
attacagcccctctaaatgtatgcatatgnacgttagaaattatattgttccctcggcatgcaacatgtcgtcgctatatataaacgagcacatctcgtcgtccctcgccattcgatctcctcaagcgttggcattcccaagttgttatcattcacaagcgtggtatatatagggatcgaccgaaacagccatggcgaactgccgcaggaggatgacctcccctctctcgagtttggtcgccgtcctcctcatcgtcgtcgccgtgcagtcccgaggtattctaagctcaatctggtttcttctatgaacttgtactgtattttctgacggatcggatgacatttaactgactatgttgtgtgtatgcatgtatatcgatcaattaactagcatgggcgttggatcagctggatgacatggtgccgatgaagacggcgaagccggtggtggtggccatcgccggcggcggcggcagcggcgtagtagggacgttggcggcgccgttgtgcctgcagtgccggtgctgctcgaaggcgaacccgagcaactgccagctcactagctgcagctccaccttcaactgcgaccctgccggcaagtgcaccctcgtccagcagcgctgcggctgctagctgcattcctagctagccggcgagccgagcgtgagctaatgcattggatgccaaagatagttcttgctgaaagtataagcatgtatatagagatttaatttatgtcatcaataaatcttggcgttaaacaaagacaaactgattaaaaaaatgtggaacttaatataataaatgcgtactggtggttctgttctggatgatctctggactccattaaggacgtgtttggttcgtggtgaaggttggataggatatagacatcagatatggtggggtctaattttttatttggttgggtggatatcacaatccagttttttttgttaggtacatgagaatgagaatggattgaatgaaaaacaataacatattaattaatagtaaaatatgttaattatcatgactatagccattctttatactaattaacaacaaaataaactaattatatctaatcaacactaattttgataagttaattactaattaacaacacaatacattaattattgttaatcaattactaatgatcaagattagcaaaggtggatatcctcatccagccgatacacttatctagcatcttcgtggaatatttccttttcaggtcgccctatccacccttgtccaccaaccaaacacactcaaaaactgaatcgtcatctcccatctagggatattcctccaacaaaatacaccctaataggcgcaccaggtatcacgtggacagctcactgtataggatgttggacgatacgccacgggtgagcaacatgggccgtggtgaatggacagtgagaaatcatgcgtagtgcttcccaaaaatctcattcaccattcacccttctaggactttaaaagcgatagttaggtagacctgatctcctgattaccagtgcacgccgacgagtgaaatagactataaatgatgatgaaatacagagatatcggggtatgtgatcagaacaccgtcacggtctccacaactcgtatctgaaccagataagtcgcacataaccataccaaattttataccactctaatgcatgcactgggcaatccgatgcactcgctagacatgtcattcgtttctactacaaaacgaagccacgtatgtgtgagcacaaagagtcaattattttttatgaggcaaagctatcgagcgctcgtgccttcctcaacaatgtatattccccatgtgttagtgtgtatgtgcaatgggaagcagatcctttgacttaactgcacatgcagttgagtcactggcatatgggtcccactttgctatggcccacatgtcagtgactcaactgcacagcagttaagtcagaggatccctttccatgtgcaatgatatagcaaaatacaccaaactagtacgctaaccgcctttattatttacaagcaaagtgtcagtgcattccaataaaaaatacgaaaaaaggtaggaaaagaaatagagcgtggttagaaaacggtcgagacgaggtgattgttgggaaaattgactctcagtatggaaaccgggagacaatcacacacgttgcttttccacccattacccatgcgagattaacgcgattaattcatagttatttccataataacgcattaacgtgattggtcatgcatgaacattccttttgggattacccccgatacccacagcgccatataaaaagggaacgccagcgtcgtgtcatggtgacgatcgctacacgatcatctcgttctcgataaacactaactaatctcgatcctttactaagtgctgaagggtcatcaaacggcggtaccatgccagtgcaggtggcaccccgaaggacgtcgccatcttgcaattgatcgccggcaatccctacagatcaagccggtgaccttacctaccccgctgctacgactactttctctacaccgaacaccggagcggttcgaggaactgctatctctacatccactccggccatcggcaacctcaggacaactacggcatccatggcttccaataatggtcagtcaccctaagtttctgtattatggtgatcatgttaggctaagcacttatgatttagcctcatgatcccatcatcccatttagaagccataagatgcatctaagcctctatctattgagtgtcggtttgatgcaaaatttggtttcgatttatgttagttagtccttaattatcatcagattatgattagttaggttcgattaggttttaatttcttgatgcccatgactaattaaatttgtgtctgcattttaagatcgattactgcttgggtagaaattaggaggagaattgcagcggataaccaaaatctctaattttcacaaatgctaattcaagaaaatccccaaattagaacccaaaaattccccacaatccctgcaaatccctaagaggataagattgatgtcttaccgattcctcgaatcataacgcgagcaccgctgtgcacgcaaccccgccgtgtcatggatcggccttgcgcctactctcatggcccatgcagggtgagactcaccgtcatgttttgccgcacgtgaggacaatcgagattgcactgttgcactagcattagccttgctacgcactcaccgtcacgatatttgactagggctcctacggcaccagtgtgttgcacgagcaccgggtaactcggtcggccacgaccccttcgttgcacgctgctgggcaccacaaccaccgcctcgcacatcgccggcactccgatgcctcacccgattcgccgctgttgtcgccattaggagtagaagaaaggggattggaagaaaggaaatgggttttagggctagggttttggccaatcggccatttttctcaatccaatattatctttcattttgctctatgatgaagttttactccttgtctggaaataataatgttttaatttatttacatagataatatgcatagcttaaagtgaagagaaacattgtggatagaagcaccacaaagtataatctcaagagacacacgacaaagtccagtcgatacaaagacttcacagtcgcacacaatgattatgaaggatgtagcttacaaagagtcta

SEQ ID NO: 78328 - DNA, 11800 bp, Oryza sativa
tttgaaaaggctatattgaagaaatttcttattttgttttggttctttctatatgcaaaaattaagggcccctttgatttggaggaaaaacataggaatttttggaggatttcaatcatataggaaattttatatgtttttctattcctataggaaatcaattcaatagttgaatagcaagcaatgttcagaaaggttgaatgtgcacttgatatgttaataaattacctttcaaagtatgtgtactttctaatttttaaatgtgattttatatttccttgatatatattatgaaaaaaatgccttgcacgtgcataattactagtctttcaattaagtaggagtaaaaacacagacaagttacagaaaaaaacaaaaaacaacttctcagcgagaagaactcgccaagcccctcaactgcgaccggtacaaccacacagcacacggagcaccacaccactctatccaaactaccaatgagaaacaacgacagaacccaacgacaaagatcgatgttgagatgctgaaaaagcggtacaaagctttgactttgacttcgcgaggcacgtgtcattgttgccgagcttgccgcccaacatccaacagctccgactccacggcggtcccgtcatcgttggcaaaggcactgccaaaacaatcaagacaacgccaaattcacatgttcaacatcagccaaagcccatgcatcggcaaccaccaacacccctagacagaaattgcaagtgttatcgttgccaagcttcatcgcacccaacaacatagcagctccgactccatccgacagaaacaaacgaagagagttggatgccaccaacaaacaagaaaggagccaagaaggcaaaggcctcgccaaacacctaggcatctagtgcttcgagccttcgagttgacacagtagtctaccaacgatgatcgatgcatgggtaaggttctccaaaacggcgccccatggacgacacgacgtgaaagcgccaccaccgcttgtccggaaaccggatcaaggttttcacctagagattggtagcgacgaaggaaaacaccataacgacgccaaaggtgccgccttcgtcagccacccaaaggctaggcaaggctttcgctagcgagttccattcagtaccaccaccagcccacaacaactgtcgccgaaccaccaccttgaccctccagacaccaagctagcccggtcgaccaccccacggctcaggtaggctcacagcaggatgtcgcaaagccaccgtgttcaccctctcccggaactccccatggccagaatagggttctagccataggaggggaggagttccacggagaggaggttactcgaccagcaaacgagaagatggaccgccgtcgccgccagccgcttccccgctcgcaccaccaatccttgagaagtcgctacctccttgcaccgccacctcacgtcgttggccaccccgtagtagaccatcgccatctccatttgcaccacacacggtaaaggacatcgaccggagagaggacgacccctcccgccatccatggccaacgacgatagggctgccgactcccacgtcgccgatttggctgctctccctgtctgccacccgagccaagccaagggaaccctagatctaggagtgtttgggaatggcaacgaagctcggggtgggagctcctccgccacgcaccctgacgcacttggtgccaagctcagggcggccgctcctcccctcgccgccatgtagccttcgcgccatcgccgccgcacggcctcgtcgtcactggccgccccttcctagcaagccacacggtttccgacggctagcactggcggcggcgaggtaaggaagaggggaggagggtggcggcactagggtttagcgcgtcgccctcgggccaccggtctgaacccgcggtccacctgggcgcccaacgcgcgcgcgccgtcctcttcgcacgtcaccacatccgccgccccttccacgctcctcgttggtgttggtggctgttaaatgccaattctataccgccaacatctacataaggatcagataataaaacatccaacatagtaataggtgtttaatctcacatattccacaagtgttggtgaatatctatatgcagatgataaatcccagtgctgggaggaaaatcagactaaagtggggagaattatatatccatgcaaggaggggttgtgaacttcatcgaaacatcggtgaatcagcccaaaactccgagaattggacagaggaggaccagaggagaaggcaggccgaaggccaggccggggggcccagcccaagttcggccgaaccccctggtgagcaccgttggatccaggttttggcgtggacggtcctgatcatctcctgatgacggttgcgggcatttccgacaattcgcatagtacaaccgtcatacctacctctatataaagacctcacttcactcacttcaacacacacttccaagcttgagctgaattataagaggctctatttcactatattgtatactagaataggaagagagtagagtagaagaagtcggaagaattccgaagctgtcggtaatcttctcctatttcttttattctgtttattactctgaattcaatataatattcttcctgagtaatttagatttatcttgtgagaattatctcttggttagttcctaaatagcatatgagattattgttcactataatcaactaaaatatagtgattgctttggtgagttagaaacactaaagtagatattaattacttagacgtggtgtttaggtaattgttatccagtaattgttgcgtatcccacagtacgtttgaggtaggtgtagaggtggtgacagccctcgagatcacttaagtcctccctgtccgggtacgaagtagagcgacatccaggaacagcgggttgccagtgcctgaagtattgtgttaggattaaagttaagctttcctaaacattgtttctcactagtaaatcctctctatcctggcctattttttgcttggtgtccttggatgaaccggaggaagctctgatcacacacgttcccttggatttgatacccttggaatactccgtaggggaagtgctacatcggtgtatccgtgcgcttgcggattttatctgtaaacgtaagaaataccaacaagcatttctggcgccgttgccggggaacggttgctgatcatttccgaacattgtttatcctcgtatcctttttcacttttttttattctaccttcacccctactatcctagagaagtattcctgttaaactcttctcgaccatggagcaacctctttttgagctgtttgctcctcggggcgaattctatgagacacctccttcatcggagcccatttatacagctggctatgaaattcgtcccgaactaattagtatggttaacaaaaatcctttttctggctttgatctagaaaatccctaccatcatctacgagactttgaacaagtctgctcatgccttaagattcgtggcatgagacaagaaactgtgcggtggaaattgttcccgttctctcttcaagagagagcaaaacaatggtacacttctaccgttggatgtgtaagcggtagctgggaaaagttgcgagacagattctgtcttgccttctttctagttactcgtattactgcccttcgagtagaaattctcagtttcaagcagatcaaaaacgaatcaatcggtgcagcctggtctagattcactaatttagtgtagtccggaccaaccctgtccttactcgagtatgtgctacttcaacatttccatacggctttggataaggagtctgcattctatctagacataaccgctggaggatcgttcatgcacaaaacgccgtcagaaggaagaacaattttggatcgtattctagaaaatacttccttcatgacgcaatccgatgaaccccagtcgaaggcatccgtgtccaagatagaggaacctctaacgatcgagccactcgatgaaccatccacttctgctagctcgattgatgagaaggttcctgagcagccgtctgtcgagaatgaagaaattcagactacagagcgtgccgcaattttgtttagggacggttttgatgaagactatggcaataccccgaactatttcagcaagaagaaaccactcgttcctttgccacctcccgatcctatggaattgggcttcctacgagaaactgtctgggagttaacatccataatgcgcgatgaatggctaagggagccagaactttcatccgaagtaattcggataaatactgctccccgaatcattccttgccatctggaagggaacgacgtcagtattctctatagtccaactgtcggggacaatctcatttccgagtcttttgcattcgcttatttaagcgataaggcagtgactccgacaaacaaattcttcaagcatccaaacggaaatatcatcgaaggatttgggattgtacaagatgttcctgtctgctttgaagacagggaggcgatcatggatttccacgtctttgaaatccaagattttgacatcctaatcaggctgcccattgagcaacttctcatcaacacacctcaattagatagcctcagaataacgctggaagggaatgaattctcaattctattctcacgggcgaggatcgccttgactgaccccctcccagaaattgagtcagcagaagaggttactgtagttcctcctcatgagtcttccaaggcccttctagaagatgaggtctcagattttatcaaggaagaagcagaccccggtgagactctcgacctaccaatcatggaaccaccacctcgacctccgcttgagcttaaacctctacctccaggcctacaatatgccttcctgcataatcacagagaggcccctgtcataatcagtgacaaactctctgaagacaagactcaatgtcttctcaccgtgttagaaaagcatcgttctgttcttggctactcgctccaagatcttatggggattaatcccgcgctttccacccatcgtattcctattgaccccgagagtactccctctagggaacctcaacgacggctcagtaatgcaatgcgagaggttgtaaagaaagaggtcttgaaactcctgcatgccgggattatttatcccgtaccatacagtgagtaggttagcccagtccaggtagtgccaaagaagggaggaatgacggtcgttgcaaatgctcaaaatgaactaattctgcaataaaccgtaaccggatggaggatgagcatcgattacaggaaacttaacaaggctacaaaaaaggatcatttcccgctacccttcattgatgaaatgttggaacggctggcaaatcattcctttttctgtttccttgatgggtattccggatatcatcaaattcctatccatccggaggaccagaggaagactacgttcacatgtccatatggcacctatgtatatcgtagaacgtctttcggactgtgcaacgctcctgcatctttccaaagatgtatgatgtctattttctcggacatggtcaaagatatcatggaagtcttcatgaatgacttctcagtatatggaaagactttcggtcattgtctgcagaatctagacaaagtcttacaacgatgccaagaaaaggacctggtgcttaattgggaaaagtgccgtttcatggtccatgaagggatagttcttgggcatcgagtgtccgatcgaggaatcgaagttgatcgtgctaaaatcgacgttattgatcagcttcctcctcctatgaacatcaaaggaatccgcagtttcttgggacatgctggcttttatagaaggttcatcaagaacttttctacaatcgccagacccctgacaaatctgctagccaaggatgcgccctttgagttcgatgacgagtgcctaaaatcttttgaaattctcaaaaaggcactcgtctctgctccaatcattcaacctcctgattggactctgcccttcgagatcatgtgtgatgcaagtgactttgctgctggtgcggtcttgggccaaaccaaagataaaaagcatcatgcaatcttctacgctaacaaaactctaaccggagcctagttgaattatgcaactactgaaaaagagctgctcgcggttgtttttgctatcgataagtttagatcttacttagtgggagccaaggtgataatttttactgatcatgctgctttgaaatacctgctcactaagaaagatgctaaacctcgcctcttaagatggattttgctgctccaagaatttgacttagaaattaaagataaaaagggagtatgtttagttccgcacccaggccaagatctggcaaattggtttcttctggcccacaatgtaggaagactcaaaagaattcgtcagaagatgcataagctgccagaggcaaggaggaatcactgctcgcgatgcaatgcccctcacatacaatttgcaagtcgagatattcgatgtttggggtatagacttcatgggacctttccctaagtcttgcaactgcgagtacattctggtggcagtcgactatgtctccaagtgggttgaggctatgccgtgcagtgctgcggatgcgaggcatgccaagaagatgttcacagaaatcatcttcccaagatttggtacccccaggatggtcataagtgacggaggttctcatttcattgacaaaaccttccgagacctcctacgagaaatgggagccaaacacaatgtggccacaccttaccatccacagaccagtggtcaagcagaaacatcaaacaaacatatcaaaaacattatgcagaagacggtcaacaaaatgggaataggatggaaggatatattgccggacgcactgtgggcataccggacagcgtacaagacaccgttggtatttcttaacgacattgctagaaatataattcccagcaatggcgcagaaatacttctggtatattatggttacagagttcatccgcaagcgcacggatataccattgtagcatttcacccgagagtattccaagggtatcgtatttattttatcccgtaggaagatcatgtagagagaacttaactaattacttatatattacttgtgataatcatattctaagtaggggttaagataagtccaagggtagagtgacaaacaagcattaactactcattctcataataattaatctaagctaggtggaaagaaaagagaaagagaatctattcctatacctctaatataaatagtatacatacattctagttaactggtatactagctaataccctctatctgatgccctcctggtacttcgagaagccacccctgactgccgagttccttacgatagcccgtcatgaccatccaaccggggctaaatatggaggaataccctccctaggaaattaacttaggattatttataggtgcggaggaatacccgtactgagctgtcaccatcagcggcccacctctcatccggaatatataatcctaaataatgatatcccgtaatctagacaccatgtctaaactaccagatactactctaatatcatcgtcatgacatagagtaattgcataagcaaacactatacccgcaccaaagcatctcccagataagctagcaatatactcactataacatgaacataatgtaaagtaggtactcatatactcggaaagtattccaataccagaaatgtacaaagaagagtattctaataaaagtacaaggcttacaaaagaggaaaggaaagctactagagccatacccgaactcttccgaagactttcggactcctgattcctattctaattctattccaccagctagatactactaactaaacttgagaggaatgagagagctcttgcttgatgtgtgtgttgaagtgaagagagtgagcttcttaaataggtaggtaatgacggttatggtggttggaaagttcggtaattgtcacaccctaaaaatcctaaatatataaattgttgcttaaatggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatgaaattgcatttaatgaataatttaaattgaaaaaggtttttaaaagtctcttttggctttgggccgaaagacggcccaaaaacctctctccctctctccctcggcccagtcggcccagtccagcagcagccgccgctcgcgcgcgcgtccgcccgctgacaggtggggcccacctgtcggagtcatcgtcttcctcgcgtcggccgccgcccgaaaccctagcgccgcgccgccgtcgccgtccgctgctcctccgccgcttctttggtcaccggtgagttcgccgcaacgttctctacgtcctggtgccctccgttcgtgccgaagcgccgtcgttcgccggcgagcttgcgcgcccgagccgccgagccgccgccggagatgacgtcaccgctgacgtcatcagggtctgtctgctgtgagccgccgtggaccgctcgatctcggccgtccgttttggatggatcgatctcggccgttcgttcccgtgaaccgctgccgtgcgcccggtccaccgcaaaccctagccgctgacgcaataaaccctttttccttttcaaaaataattcattattgcgtcataattcaattaaaatccatataagtgttttaaatcgatttaatctttgaaaattcataactaattcatcttagctcggatttagttggttcaagtctctaaatttttctaaaattgagatctacatgttaaaaatatccacatgtattgttcaagcttgtttatgtgctgtttgggtgtttttgctcttttctgtttagattccgacgtttccggagagtccgttttcgcaggagaagaatttgaagagttccaaggccagcaaggcaagtcacacagatcccaaacaatcctttgagcatgttgatcccgtttaaagctattgtttctattcaactatcgcatttattttcgaatgtcattgggtggaattaacctattgtttgttatagcccttttgttcttgaatactttattccttgataccttgggttattataacttgactagttgggctatatatattggttcgactacatattagatgtgattgcttagccatgcttagaaacattagcacactattgggataacttatgactcactattatttaatgatggcttaatgatagttcacgatggtcaatcgtgattggttaattaattacttgccaattaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataaacccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgttcagaaaggttgggcctatacaacagggtatgttgtatagcgttgaattaatattgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttatctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttagtatcagagcccccttgaccctaggttatgccaaatggttatccatagaagccctctaaaaatattggaaaagtagaattgttctcctccccttctcttttaattaaaccaaactaatggcacatgcatttcataatctcttttagtggttctcattcaaaatttattccagtgttattagtaccgtacatctattactgtactaatggctcatctaccagcaaaagttttacaatattgttttatttagtcttgctgcaatgaaataaatttagcatgttgattttataactttattccttttgaaaccggttgttcaaaagtacaaaatttgtgacctcgtttccagctgtttcaacttatcttgcaagcttggtttattttatttacttaccttttactttgattttctaactttattcaaattaatccaaaaacttgtgctattaattggataaatgtcttaactccctcctttcacttgtctttagatgccgcgctataagcctgagtacttgtttggtgttgagggatttgtccaagagttgcgtacgatgtcctttgtcataggatttgggactgcctctttttatgcccagattcctcatgatcgtcctgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatcgctaccatcctcgccaaccacagggaagtgaccgtggcagttaccttgacactgaaggaattgagaatgatgctaccacaaggcatttggttgagatgctgtgggctatggatgaaacccgtgcggagactgtgttagcggctcaagatcatgaagatcggaatcgtggtaagatttgcaagctagaggacaaggtggatcgtttggagaaggaactagccgcattgaagggagaagcaccaccgcagaaggccaggattcgtcttaccgcaaggaagagagctctatttgtccctcgttaccaattggcgccaaaggtccgtgtggtggaaaaagaagttaccccagccctagcggatcctccggtcgtcaatataagtgatgatgaaggagaagaatcgaagcgcacccattccaagatcgagtggggagcaactcaagatgatggagacgagccgaacgagccttcaatcaactccgatgctcggaagaat

SEQ ID NO: 78329 - DNA, 6720 bp, Oryza sativa
tccaacaatatcttcatggtaccatcctgcccttcagtagcagcaagatgtaatggtgtcccacagtcagataacgggtcaacataagctccttttgcaagcaatagttttaccattttacaatcacctgaataatgaaaaatccatcgagtatttaatacaaaagaggacaattgtaaattctaacaatctctttctattgcaaagttattgaaacccctttttttccagaagatgtgctacaaaaaccaataaaagaaagtatggcaaaagaccaagatctacacagatctacactttcagcaaaatgacaagccgataaacagggaaaattgaaaatgcgtaggaccaatggcatattttttatgagaatatgtattcctagaaattacaagaaaaccacctcataggaaaaaaaacataaatgtttattgtatccactgaacaaaaaagaaatttacgtaaaaataacttttagaggatgcgtacacagcagtattaggttatttaatgacaattagcagtatttagttattgtgttggaacaaagttttgcttcattattaacataaaggaagaagaatatcattatgtaacaacagaagattgcttatagtaaggaaataacaccacacactgtctattacaacagaaatacagaacttcataaaaaagtgcaacaaacatatgcataacagtgatactcgtttatagtgggggacctaatccagcagcagaatgcagaggagttaggccaccctcgcttgctttgtctttatttgcaccgtgatcaagaagatacttgaccgtgcctatgcgtccactgtgtacagcagaaaccagaggtgtcctccctgtcaagcaaacaggtgaacacctatcaaaacagtatcttcatctcaaaaatatagagccagaaagagcttttccaagagaatggcattcagaagttgctactctagagatataatgcaggtatgtgaaatttaggtgatgtgaggaataaaacagtaaattccataagacaaaattgggctaattggaatggcataaaacattgatcgcacaagacaaatttggacagatcctaatggcaagtgtaaaccttcaattaaattgtatagtcagtgcagaacttatgcagaatcaagtacatattcttggagaatgtgaatatgtgcaaataagtgaattaaaaaactaacatggatattatcttggtaatattttataattggaatggccacgatcatgaataagcagaggataataaattggggttaactggatccatgccattataaatttaccagttttaaacaatgtcattataactctgtctaattggatatgccaccacgtaccctttggatgcagtgaaattttattttagactaaattgccctttatcttctacctccgtactctccactcttcctcccatccctaagcagggatagcggcagacccacctcctccccaagccccgttgccggagccaaactcccacaccttgcgtccacccaacaaaaccaaaactcgaagcatatcggcttcatcaatcaatgatgaacccaacaaaattttctatctcaagaaatttctgcatgtcttttgtttttcccccggtttggttgatggtcaaaagcttggatttcagagtgcaaacttgctcgcatctgggcaaacattggatattttgaatgattttagcgccttgtcttgattttggtgtttgtttgcttgggcatctttggagctaaaggtttaattttgggaggatatttagcggttcgcagacatttggtgggagcggaggacatgaagttcttcagcaccgctacgtgcccgcaaagccaacctactcgcccagatcctcgagcccgacggatgagtttgtcaatgagcggcggatctgggagagagatagagataagggtagtttggtccaaaaaggaatttcagtgcaaacaaatggtaagcagttgcatatttctaattttaatatatttgcaatggaatcttccaattagatgaattgtaatggcatttttcaaaaggggcaaatttataatggcatgaatccaattaaccccaacaaatgggtatggatgctgaaccatgctttctttattataaattcacgaggtaaatcaaaatgacatccagaagctttttatggcatgcacaattctagaaggaataaaactattgattcaaaaaatattaattgagatgtatatattaaaacaaaaaatttgataatttgacacttttttcgatgcccaattactttaactgacatttgtgatgatgacatgtggggccatctgagtgaatgaaagtgggccaggatatcaaataatcgaaacccatttaaaagagtgttaaattatcatatctcttagtctatgcatgaaaaccaggacaccccacaagcccccaatgcaaagtgaaagttgcatattgtgacaaccaaaaccaccctacaccgctcactgggaacaatcagaactatgcaaactagggtttgtatccagagaagcagaccttctttgtcgaggtcatccacatcgaaccgcatcgtctcaaccaggtacctgaccacattcatgctcccgttgatggcagcgaggtgcagcacgccggcaccttccatgccttgcacgcctgcctgcctcgcctctcccacggtctcccggaggcatcccctccccgtatccagcatgttcgccaggtctggatcaaacgaaatcgaacaacaccaccacagcacccacaaagaaaacaaaaaaaaacggaagggaaagaaaagatcagcaccgggagaggagtcgaaatgacgaaatccaagccggtaggtagaatccacccctgcatactcttgaagccgcgcaggttgtcgttgtacgccgcctcgaggagcatgtgatgcgcgccggcggcggctcctgcggcgggaaggggtagaggagttagcggcgggttcgttgcgttgcggcctgaggggctagtaggattagctagcggaggggggctcttacctgggctcaaaccggaaacatgacgcggcgacgccatgggtgggggtgatgggcgaggtgctccggtggagaaaagtagagatcgctagggtttgagagttggcactgggagagaaatataggggggaagtaggagctgttgcgtggttttgaaagggaggggaggaggagaaaggggaagaattggcggaaggaaggtggaagcgtatgcgggaagctcgttggatactgcgccactgcgccgtgaaaagagcgctggttgcccagcaacaacactagaggctgacatgtgggacaagtttgcactagggcccatgtgtctttcattactattgcaagtacacgtatcacaaaatggagtatacttttttttttttactaaaccggcacaggaactgccaattatctagactaatataaaaggtacgagttgtttagtgcaattaacaccgtaattgtaattagcgtcggattaacgctcccacgccttttccccatcgcaaaatccctgcccacgtcatcaaatcccgcgccgccccttgcctctccctccaaaccgtcactgggcggcacccaggatcgcgtgccccaccctcccgacgcccctacccgccgcccccgccgccgccgccagcggcgcctcccgctcggccccgaccggcgagtcgcgtaggagggaagcgccacacttacacaacgagaggaagcgctgctccgggggcacgagaggaagcgaccacgtgccccaccctcccgacgcccctccccgccgccgcccgccaccgccgccagcggcgcctcccgctcggcctcgaccggcgaatcgcgtaggagggaagcgtcacacttacgcaacgagaggaagcgctgctccgggggcacgagaggaagcgctgctccgggggcggcgtccggcgcggcttgactcggacgcgacggcgacggcacggtctctcctccggtggccaccttctcctcggtgagttcatcccctacccctcttccctcctcttctagggttagggtttctcgcacacgtgctgctgctgcggcagtgacggcgcacgacgatggtaggcgtggcgggggacgccggagagtcacaccctctcgccatggccgttgaagctccgttgctgcggcaaggagaagcagcttcaagagttctttcttccactgtttcttgattaagctcgtcaatggaagcaggcagggccagtgttagtgtaggcatgtagctcactgaattgtatagagtaaatttttgttcagatgttcaacaaagagacaaaaggcacatgcattgtacaccagaaataatctaggcaaaggtgatcatttaatggcacagtgttctaacttctaagatattattttcagacaagttgggtttgttctgacatataatggggttttcttcttctcagcttattggttgacatgagcttatgctgaaagacaaaacagtcaaaaacactgctgaatgcagtacaaagttttaccttactgaaattaattagtttttgataaataaactgtattcagataaataaattagttcaatgtcatgggcatgggggtgcttcaattagtagctgaatagaagggacattttttggaatgtagacttcactctaaacattttttgtgacttgcagatcttttacacggagacttcaaatctactggtttcttattttttaatttttcaaattcaagccttacaattcaattgtagactaatttagtttcaaatgaacaccaatggacaatcatgattcattttagaattagaaatcttattaccactgttactagggcagctgtggcacatatcgaaagtagacattttgaaaagcagaacatgtgaagtgactgacttgttgtagagacatgcatctgcatatgatgggaagtagagatagagcttagggcttcttgtgtactgcaatcctgaatttacagcattcactgcaatcaccattgcttatcatctccctggttccatgccctctcttttttttcgtgtcttagtgttattctatttcctacatgtgaacttttcaatagtatagtattgatttcatatatgcatcgatttcatatatgcatcaatgttcttgaccatcagcaattaagttagtatatttttgttctgattcttgatcatcaatcacacacacctgtcatattttgctgaaagattcttttggttgagatgtgcaagcagcaagcagcaagcaacaacctacagatagcagtccattattttaaatgtcgtttttggtagttaaaactatgaaaaatgcacataaaaatttctcttttctacatcatagattgagatcacagccgccaatccgaaacaattggtcactgcatagaagtgttccttaaattattgcagtttcagacagaaactaaagggagctttttccctgcaggctttgggaagaaggaagtctgcaaggatactggttttgtgcggcatcggcaaatgttaatcctgaacctttgaatatgtatattgttgatgcaacctttgaatagagcaaatgttgatactgaacctttgaatatgtataagttagaaggtctgctgcttcataatagtagatcatatgtgtatttctgaatatatcttctttgtttggttttttccagtacggcactctgctactattctaggtacatgtccgcaacctgtaatattattttgcggtgtactgattgggcggttagatttcgaaagcaatctcaaattatctgtcctatccaatctattgccagattacccaggtgccatgtgcaatactattttttttttaaaaatgtggcaatcaggaagtttgagaaccagtatgtactcctaccaatgaagtttggaaagaaaatttacatagtttgtggcaaataatgttcaggtttgcagattaacatgctaccacggtcaaaactgtatgtaatacttgcaagtgtcagattttgtttgttcccctactttactaaaactgtaaattaggttaataacttgtttctgatatataacaataaaagaaaccatgatattaaaaagtatctgttaatgctattaggcatctgaatatattggcttacttctattgtttataatacaggttgacactgtcgacaaatgaagattttggtaaaatcctatcatgtttgaccatggtgtttcactgttaggtacacggtatttaggagctattcgtatagtaaatactggaatattgaagtaaattatatgttcagcttattaactgcattgcaatatctttgatctggagacggttttaattttcatttgtgtggtcgcatcctttaatttatataacttcataagaatatactccaaagtacatgctggtttatgtatttttatgccttcctattctaattgtctaatggctcttgaacaatagatgtaaactacgatgtctgaagttttccatgttttcttccttatgaaaatgagatggagctatggcaagctgctttggcaatccaagtttttcatgtggcttgagctgaagggaagatgcctcatggctgacaatctacagaaaagaggtggcctcatcaagcgaattgctccctatgcaacctgacgtttcaagatgacacccaaccttttctcaatgtgcttttcacaaac

SEQ ID NO: 78330 - DNA, 102082 bp, Oryza sativa
actcggacactctgcattacaggtgttcaaatggctggcctactcgtgtaatcattaactaatagtactaataatctagtaatttacagcaagttttccacgatccatctgtccgtggcgaggcaattaccagatggttcacaccgattgtgcggtgtgaaactgagactgcaattaggcaatgtaatgctattgtggtatcttttgtttctggttttctggatcaggagagacttgtgaaaagttcagattagtcacctggaagaagttggaatgctccgagtcgatctgcgattctgcataatagaccaggacagcaggactgatccagaaggatataatcatattacaagcagcctagtacatttgaagctacgggcgggtagtattctcttcccttgcacataggagaatcgaagaattgaccggctgatcagacgaccactaaatttcgcaaacggcgaattcaagtggagttgggacttgggagggagtcgtttggggaaggggaaggggaggggggggggggggggggggacgatgaacaaattcagaagttttggctcgattacgactttgattttgggagtgcgtcgccaaaaggaataagttcacttgtggtcctttaacttgtcaacgaatctgattttcatccttcaaccagaaaaacagatacaacacgtccctcaactatcaaaaccggtgcagataaggtccctcggcggtttggacggtggttttggctgacgtgacgtctacgtggctaatttgactcggtcttcatctgacgtggcacttgtgtggcaattcgtttaaaaaaaataaaaatcgtaggacccacctgtcagttacactaaaggtaaataaaaaattatggggcccacgtgtcaaccctttgccgctccactgcgccccgaggactctccacctgcatcgcgcggcgacgcgggagctggagggcggcatcggcggagaagacgttggagctggagggcgtcggcagtgggaggaggacgtcggcggagcagaagcaggtcggggcgtcggcgtccgagtccatcttcagcgccgggcgtcggccttgagagttgagcaggagagcttccaggggcagccgaggaggcagaggacggcagggaacccaatgaggttgaggaggtggcagagcagtcgacgatgtcgggagcggaacaaatatattcaacttttaatacatccagacagatgcagcaacaaaaaagaaaatcccactttctgaatcaaatcaaatcaaaaacatttcctcaatgaacagctgcaaatcgagcatccagatttttctcccgcggaaagaaaaaaaaatcatctccagctgcacaaggatgaacgagcaaagtccctcaaaaagtgacccagatcaagacgggcggtgaaatgataggataggtcgggcggtgcctcacctgcttaagcgatgaggggaacatggtccgctcgcactcaagcggcggctgcacgatggagaccgcggcgtcccgccaccggctgcaggcgcaggcgtagaccaccacgtccagccgcggcggccaccaccgccgatgacgtcgcagtagacaggcagcgacacgagtgttggatagtatagggagaggaatattgcgtaacgtggatcacttgtattgagcctcaggggccggtatatataggagtacttgggaggagataaggaaggattacagatatggaaggagtccacacaaatcaatcctatcctaatatgactctaactaccatatactctaacatccctccgcagtccaagcgtgagcagcgcggacacttggactgaagaagaaaccaacaagagtactcaatacggatgataaccctttgtgccgtagtcgatgtagccaaagcgaagggtgcgagggagctgtggtcgatgaagctgtgcgtagagtagctgtggtcgatgtagtcgaagtcaggaagctgatgtcgaggtagccgagccgcagggagcgcatgaggcgccgtagagtggtcgtggacgcacgggaggggcgtcgtggaccaaggtgcacgaggatgcactggagacgaagatggtgacacaatcgcggcagtcgtgaggaagatgacgccgaagagccgatgtagtcgaaccgtgaaggacgagacgtcacatagggtttgccagaccccgggacaactcgggacgaatccgcgcgccggtgttgccaataccgcgcgggcgacaggggaccaccatgaatcatatgccaatgttgcaggagactagcagagaaggcctccaagacggtcgcgacgcgagaacagcgtagagggagaattgccggagcagcgcgcagttgccggagaagagcgaaatgtagtcgagggagatacggcgacactggcgatgaatcatgctggacgaagacgaaggcctagtagtgagaccaacggcctggatggcgatgttggtagccatgtagaggtagctgcaccaccggcctagagtggcgacagtggcagcttggagatgcggtggcaatgctcgaagtcgaggaagaagaccctgagcggctgacgatgaccagtgcggacgacgaggttgttgatgtgcgaacggcgatgaagacgacgaaagcggcgaagctgcggtccgagaggacagcacagctgcagctccatgtcgatgcagcggcaagaagtccaccggtgatgtagaaatgctgaggagggtgcctcttagcactgcaacaaccagtggaggtgtggaccacaggcagcggcactgcggcccgaggggagcgaacgcagcggcaccccaaagcttgatggtgtagacgcatgctcgatgatgatcggttgcataagtcgttgtagccgggcgcttgaacgggtgatcaagctgaatatgcgcgaggcggaacgatgaagttgaagcagagtcaacaccgatgtcggagacacgtggatgttgacgaggcggtgggcgacgcaaacccgttttttgaaaaggggaaaaaaacaaggatacatgtagcagcagaacagcatcagtagcaagctcacacgtgcagctcatcctctcacacatggtccataggccaagtccacaccaccttgtgcaccacagcagggaccaaagtcatcaagtagcaatcctttgaccggtccatccaatgcctttccctgtccccaatcctatccatccacacacgcgtagacagatagaaaagtgagacatgaagcaacagattgatggcgaggcagacagaaaaggtcgacgatgactcagccggcgaggagacggcgagagccgcgaccctccaggaggggacggggtggcgccgggtggaggggacctagtggccggcgagcgccggcgccggcactggcggcctcagatcctagtggtcccgagcggcggacgtccggtgagccggtggaggatggtctcagcaggacatgcgaggtggtaggcgaggaccggcggcggagaagcagcgccgggagctcgtccccccagtcgacggtggtgctggagacagaggagtcgggggttgcagggggagaccggtgccggaggtggagcagccgagctgcgtcgtccgtctgtccatcggggctcgatcgttggccagtggaggcgacgacgacggcagggcccgtcggtgaggccggcggagcagaacggacgctaaagatgaagccgacgacgggcggcctgacggcgatacaagagtgccgcgcacggaggtcggcagaggagatgcaatctgttgctgctgcttgacgacgactagactcgacgaagaacaatcgtgaagatcgatctctccaagacgacgacgacgacagcgacaaggaagaaaaaagaaaaaaacgggtggccgcccccgggagcggcgtcggcggaagcgtgagagcggcgctagatcgcccgctctgataccatgttggatagtatagggaaagaggatactgcgaatattggacacattgtattgagcctcagggggccggtatatataggagtacatgggaggagataaggaaggattacatatatggaaggagtccacacaaatcaatcctatcctaatatgactctaactaccatatactctaacaacgaggatgacgaagaaggacaggaacgggaggctagcagcgtgcatcggcaccaggaagcgaggttagcagcgtcgggttggctcgcgcaggcggaggcgtggatcggcaccaggaagcgaggttgatggcgtccggcgaagggaagagcaggaggacggggctccccgtctcgagatgagggggccagaggaagggaggaggcggaggttggagagggaatgggcgaggagggggaggatggagaacgggttgcggcggagggcgtgcgggtgctggaggatgacaacggtggttgaggcgggttatggcggagggcgtgcgccgctccgctccctcctctcccgccggcgccgcctagtgccgctccctctccgtcgcgcctgagagaggagaggggagagagacgaagacatgggagatgtgaagaaaggaggaaaaagaggtgagaatgacatgtgggggcccacgtgggccccatcattatttatttatttgtgtgttaaactgacatgtggatcccatggggtttattatttttctggatcgaattgccacgtaagcgccactcaatgccatgtcagatgtagactgagtcgaattagctatgtaggcgccacgtcagccaaaaccgccatccaaaccgctgagggaccttatttgcactggttttaatagttgagggacgtgttgtatctggttttctggttgaaggacgaaaatcgaattcgttgacaagttaagggaccacaagtgtacttattcctcgccaaaaccagcgccggttattaaaatgtagctcgaatcttgtggctcggccagcttttgtgttgtggttttcttactgcgatacgtttccatgggccatcaagtttgtgctggactgctggatccaagttacgtaaggcctcgctgttaagctcatcataagtagagaaatcgatcttctctgggccaaaagagtacggagtaatctgtttcagtttttacagggcacgcaagacattgacgggccaagcccatatgtattccctcgttgctttgcttcgtgataattcttgggtggaaaagtctattttgcttttcctcaagtctgacttggcccctcccgacaaaatcatttcgttttatctccctgaacgatatgaacgttggttttgtcctatgtgacgtgtaaataacgcctacatgacacggagacttgatcatctgatgtgatgcttacataacacttcaatcaaagaaaaataaataaacaaaaaaaatcaaaatcatataggccctatatggctctcagaaaataaaaatgatgtaggtggcatcatctctctttccctcttctttcccaatgacgctagaagctcaaggttggatgcgtagttggccatcggacccctgcacgggctccctcaacaatggctcgttcgatgtcttctccatgcttttcccaccaagcagatcgcttctgggatcctcccggacattggtttaggatggcagcgacgacggcctcaaggtgtggagtccatgcgacgcacttggtaagtagaggacaacagggatatggcgcgaatgacatcctccatgccgagaggctagagctcacctacacctgctacattggttagcgtagtggatcgattttttgagggaggcattgtcacgctcaaaaatttaacccaaattttcagactattttgcgtattaaatccctgtccagaaccagccagggtacacaaaacgacaagtaatatacagttccaaacgtaaaataagcgtaaaatacttacagaagaggcacttagtcctcacaccgaaacaaaagcagtagcagcggaaaaaaaaaatgatcctagcggggcttcagctccactccacaggcaaaactcaactggggtctaagtcttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccattgatcaacgctacaccacgttgaacaggcccaaccaacccacctaaactacagtgtattgggtcgatttattaagatgagactaatcacggtgaatctgatcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccaacaaaaccatgcacccacagcccaccattcagttgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgagaaaaaactctaataaaaaccaagaaaacagtacataaaaactaaacaaacatgtagagctcaattttagatgaattttgcaagtggaatggctcaattcggagttcgaatgaattaggtatgaattttagaagttttaagccatttaaatgaatttctagaattaaactcgatttattgcgcaattattatttatttttacaaaggaaatggtcatcgctgacgtcagcaaggggtgaggcgcggaccacgtccacaaagggggcaggccccacacgtcagcggcacggcccaccgtggaccgagtccacggtggcgatcggccacgcggccgcgcacccgacggtctagatcggccaaggccgatcggacggctggggacggccgggcggcgcggcctggccagcgcgcacacaaggctggcggcggcggcggccgggaccaaagcgacggcggcacacaggccgggcgtcgcagggagcggcggcgcgcagcgcgggaagcggcgagaggaaacgggggcagtgagggagagggaggtggtggagctcaccgaggggcacggcgacggcgagagcagccggcggagggaggcggcggcgctccacaggtcgacaaggaggaggggctcccagcggcgaaaggcggcgaccgggcggcggatggggaagagcgggacgcggcgaagccggcgatgcagccgatgcgtcgcagcggcagccggggtgaaggcgaacggcgatcggaggcggaaaaaggcggccggtagggtggtatggcggggaggtggttcaggtggtggaggggaaaaagggatcggtggccgggcttgcccgcgcggcggcgaagccggctgcggtggtggcagggcgcgggatcggctcaggcggcgacgacatgcgactcgggtgcatggtggaaggggagtttcggcggaggtttgtgcaaatggagcggtggcggatgtgcggcgaggcatggcgaagccggtggtgtaagcggcgcagcgcggcggtggctacggcaacggcggcgtgcagccggagctcgccggaaagcagcggagcgcgggctcgcgcgaggaacacgggagaggtaacgaggagctcggggaggagagggaaacggaagaggagagcacgagggtgctttttataggctcggggaggagaaatcgtggccggacgtggcggatttgaagcggcaacggccggcgacgtgggcgacatcgtgggcgaagtggggctcgatttggcgccaaaaattggggaaaagtgggggatttggtggaggaggtggaggggaaccgattttatgcggtttgggcgcgagggcgcgagcgggaggagccggaatcggcggcgacgtgggtggcaatggcggcaatggcggtttcggctctagaggccgaaggtagaggaaggacctgacaggtggggtcgtcgggcccacctgtcggggagggagagagggaggagagccagggggttatttagactttgcgcgaggggaagttgatcggaccaaaaagggaggggtcggcccgagagggagaagggaaagagagaggggcgagcgggccaaggaggggaaaggatcttgggccgaaagcggcccaaagacaaagaggggaaaattttatttgttttctttttattttaattgattaaatgaaatttgtgctattaaaattatttctcgagctccgaaaattcacggaaaattccggagagtattttagggcacaaagaatattacaaaatattcccggccaatgatttttaagggaaaattttaattctcccatcaattcattcgaataaattgctttaacttttaatataatttctagaaatgcattattaattgatttttaatcccgaacgaaaatcggggcgttacaggcatggcgcctggcgatgctaattgggccttctttcctcctcttatctacattgagctcgctaacaagatgagaatggcgaggacggctgctgagccatgggcgtcgccgttcttcatgttctcgacacgacatgtcgagcccttaggaggtcctgtatccaccatgccaatggctagttcctcatgccaccaagaacggtcaagtgagcacgacaacggtttttcaaaggtcttcggttgagaacatgaactcgttcatttgcattgaagtcgggtgttactgtcatggttatgtataccacatacataatagtagttgactaagctcgatagggcccaccaagtaccaagtcttatacggaattatatctcgtatatagaaggagattcggataagcaagaacgaatagagttctatatggaaactataaggactactcggattgtatccatattagtctctctagttctacttagataaggggacacctatgactataaatagaccccctaggaggagggggggaggaacaaaaaaaatcaagacacgacatacaacagatcgagccaacacacgccaagacaagctgccggatatcgatatcagagataagcctagacaaactcaatatggtgtctacggaggccaacaaaagagatttagcactatctctgatctcgccgagtgcgaattcgaggaggaagactactgcgttgtcgactacgtgatggtattttaagccgccaaatcgacaacggttacataggttattccaaatattgtactggtgcgattatgatgaataagagcagcaataggagtagggctattacttatcagataagaggcccgaacctgtataaaaatccctgtctccatctcttttaccttaatctcgcatccaccctggtaccaacgatccccataccatgcaaatattgtagtcgtgacttcagacgtcgacaagggcccgacgagctccacctccacattgccaccatggctccatcgagctcatcgcaatatggtcacactgctctgcaccctatgcaggatgcttaccatgtgctttcaatcaccggttgttgaggactaggcagccatactaggtagttgcataaggaagagttggcagggatgcatggttgccactgcttcctccaccataccaccatagctgccttggtgtagcaaagaggaggggaaatatattaaagcggggggagagggggaaaagagggaaaattaaatgaggattagagcaattgacaccgtaatagactaatcggacctgaaagagaaaatatgatctagagattatgaagtactaccaagttttttttttctctaaatgtaaagcggtaaacaaaaaatccaagtaaacataagaggaatgtgtatcatgtttatacaactctctacacgtgtagtactgatatgtacatccaagaatctatggggtccacatatcgtgagaatactgcactcaccccagtcttggggcctgttcactttgataaaaaaaaaaaccttaccaaaatttggcatacttgccaaaattttggcaggatttcttatatagtcaccaaaatttgacagcaaactaaatgtagccacttttttggtaactttaccaaaatttggtaatgttgaaaatggtatcaaagtgaataggccctttgatgccattttcaaccttaccaaatttttggcattgccaaaattttggtatagttgccaaaattttggtaggatttcttatatagttactaaaatttagcatcaaactaaatgtagtcacttttttggtaaatgtatcaaaatttggtaatgatgaaaatggtagcaaaatgaacaagcccatagtactgcatacaaccttttttttttcaaaatacaatacaagtactcgtatacacatccaaaaagttgagattcacgaatcttgaagttaccatagttaccttgcttttaggtctacatagtataggtgcttatataaatgctcgtacattcacccctcatcctacctgtacaataaacgctagcatactcaccacttaccttatccctattagcacatctaaaaattaaatcttgatattgacagagttatcataggcgtctagttgttgatggaaacatcattctagtaccatttaaaaaataaattatcgtaaacatgttaaatctattacttaaattcggatggacaaacacattccatcaccagcaagtttgcaaccccatgttcccaactcctcttcctcgttttccacgcgcacgcttttcaaactactaaacggtgtatttttttaaaaaaagtttatatacgaaagttgcttaaaaaatcaaattaatccatttttttaaaaaaatactaatacttacttaataacgtgctaatggatcgctatgttttttgtgcgggagggattagttcccatcccttctatccgaacacagcctaatacgcttctaactgttactagtattttgatatgacaacatcatgtgttaccatcacatcaactctcgaacagatcactgaataactcaaccagcaatggacttgtacacttttcattttgcatataatataacgccgataatgctggatctttcataaaaaggcaatgtgatatgattctagaaaatccaggagcgaagccactgcccgacaaagcctcgtcggttccctgagcgtttatgttattttagctgtttccgtgtatctattagcagttcccgctcggtgcaagcatcaaattaaacttgtgtgcatatgatcccgcttgtaccaacaaatatacggtatttcctcgcaaaatgatactacttatacggtaatattacaagcctgtacgtaactgtaagcgtcctgtacctcctaacctccacaacaactgcccttgctagccaagatcgaaatcgaatggacggtggactactgtgagtaacctacaaactgaacagacgagcgggcccacccgtcatcctctcacagcaccaacgtcggaaaatatctcacggccatgggccatggcctggcccaaggagagatttttttacataggtccaaaacaagaaaggagattttttacatgggtatgttacactgggcccacagcggctgggggaagcgggggcccacctgccccggtcacgcgatgaccaccgtcacggcggcggcggcgggggcgtcgacctcgctccccggccgccggctgcccgcggcggcggcggcggcggttggtttgtgcttggtggtggcgccgtggaggacggagccccggcacgtggggcaggagtcgtgggagacgagccacgtgtcgacgcagcggacgtggaagccatggccgcagcgcggcagcacgcgcaccttctcgccgtccgcgaactcgccgaggcagatggcgcagacctccgccgcggcggcggggctccctccaccacctccgccgtacacctcgatggggatgctcctgagcgcgcgcttcttgagcccgccgccggcgcccgccccctccacgccgccgccggcgccttcccccgtcgccgcccgccgcgcccaccggatgatgagccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaatccgtaacacaaaaggacgtggacgtagtagcgactgccactagctaatacaaaaaggtgaagcttaactgttgctaaactgtaccgatcgatcgattgatggagtgagctagccaagtaccttctgtgatctctttcccacacgatcgagctggattagtatttcgggagatgagatgaggaggaggaggagaatcaacaacagcaagtggagttgagccgtagtagtagtagcagtagacagcgatccgtcgcgagatgccacgagagatttataatgggtgcaacaccaacaccggcacaccgcacggcggcaggtggggccaggcagatgtgggtggggttcggctccgggtcactttacggtgggccatccaaaagcggaggcctctctcctctcgcgtgacaaatatctttgcccccgctttggcgctttgccagttggcagcggctcgcgacggccacgcggttgctggctgtgcgggtgggcggcaggtgcgttgccacttgcaaatggatggatggacggcccacgccgccacgcgcgcgcgcgcggatggagatggagatgaaacgagactcggcgtgtgcctaccttggagcaggtaggcttagaggaggcagaaagcagtacacggcatttgcggtgcagctggtaggctgtcacgtttgcaagcttggagatgtatacaggagcccaaggattcattccagtggttatacctctctagtatggggcatgatcttcttgtcggtcggacaggacaagttttagggagagccagatatgattagcttatataaagtacagttcaatttgttacttagtaactctctcttttttggggggttgggagggaagaaggccagcagatgctgcgatgagtgctttgaagctactagaagtgttctccttttccgacaaaagcctcaatatttgttaaaaaggttaaaggttcagttataagcagatcatatcgatatcaagacagcacaaaagaaagagcagtttactagtatttctttttcaaaacaacatcaatatctcaggcaacttacttttgcaactgcgcgagcgtgcattagcctttattcattttgagggtgaaagatatgcaaaaaaaaaaaagaaggaacaggtgagttctagagtcctagcctggtctttcgaccattccacttatcagagaggcaacgtgcatgcttaccaggactccgctcgccgcagttaattagctagcttcgttttggccttttgggaagtaacaatcaatcgctgggttcgttttgtcgaaggttagatgctagctaggtttagatagtagtgcgcatgcatcagtgtatcggatcatgacactaatgagatccgcagccaaattaattcgtctaatctaatatgtttggcccccataaagatccactaataagaaaagttccccctttaaccataaaatcagtatgccggtgacagatcgtgtgtataggctgggcacttttctgcaggcagagatcggacaaggccagctcaaaaccttatctcctaattaaatccgactgtcacagtcccgaattaaagcactaatacagaatgagatgttaactaaggcgttaagcatgcagcttgttgtagacttgtagtgctcatctaatccctggataaacaacacaaaagcacccgtgcaaaaaaacggcagttcttacagcttgattctctgtggtactagctacagatggttatcatagctatgtctaattaggacaacaaatagttggactgaacaacaacacttatatgccccatgaaactaccaattgcaattttgtttttaaacatattttttatttcgcgcgcacaaaagaatagcatgacaatatattagaaggaaaagagtttttgttacacaatgcaatcggccagacaagctcacaaacctatgccaagggaaggaagaaaacgaaaaaacaagaaccgcaactaggtaaaagaaaggtaaactactacggataaaagctactcaaagctacgggagggtggaggcggagccacactacatccccaaaaaatctagaaaagtagcaacactagcggaagaccacatgcgaccctccgagaggatggactctagaaccacggagaccgagaaaagtgccgagtcgaaaactttgaagtcatgctccttccacaactgacaagagactaggagaaccagagagtcgaagccggtacaaaaatgctaaggtaaacaggccctagacgacggccaccagaccgctagcgagttgtatatgtattactttacctgtaatgggttcttttgacttaactattgtacaattgagttataataaagtgggatttacatatcagtgacttaattgcatgttcagttatgtttagtttgaattatgttagaggatctgctccttactttacctacgaagggtttgaattatggtactacagatattacatacatatgcacacttgataatattttagtgaggctagggatttattgccggtctttgtccatttaagtacgtgtagaagtgtgtgtacacgcgcatatatgtgtgctgtgtgttcagtgtaatcgaaaagaaaggaaacagaggttattacttttgttgcgctagcttgaactgggccataaattgaacttcaaagttaccgtttacccccgctatacagaggatccatttcggccgttccagcgtttacctaaaccccaattaaacatcacaaaagcctcatgcagaaacgtgggttcttgtcccagcttaattacaaaatacatatgcaccaagacacgaagtcattaagcaatataatatttaagccagtggcaagatcagcaacctttgtcatatgcagaactacaaatccaactaattcaccaccggctcgtccagatgtacgcgtcgtattgttagggatttaaaatttcaaagttaaaaagtcatccgtgcacggacggttcgacgatccccagctgttgttgctactgtcattgttgcacgaacggttagacatgtccactttgcctcctctgacccaggcatagatcgctttaggatttgcattttttttactcccatatcgcagctggttttacgtggattttgtgacatggcatcagcaatccttaacaactactcctattgaccagatcattgaagagctggaattgctcgtcatcaagaggcaagtaaacaatcccgatgagctaggcactggattatccgggattttatgttaacgttcaagctaatcgggaagctagagcacgcatcagcaatatgagcttttttttcctatccatctatcaactctaatccaaccaccaatttcgtgttaatttcatcaatttgagatgcatcttcccttgatcgcagagtatcaggtcttaagatctgtacgggatcagaacaaatccgagctccttatcctctatagtactcttcaagtggcaaatgtatgggacaaaagattaggatgtatatggacagcgtcattcaccataatcaaattttcttttcacgtaatcataatcaaatcttgccactaacacgctacaaaatgtcggtttctgtagtactagcattgatggaatcatcacagtagctagctttagttgccgcccacgtccatccctgcacaaacattcgcaccacctctctagtgcctatatggattgccggtttggcgacaaatcttcttctcccccatcttcagccgtggcttccttctatagggttgccgttgatgatgttggtcatggcgtctaactttagaactcttatcccaacggctcattggataacaaaagaacgcaccggaggtggataggatcggaggctgagttatgcacgaatctttaagtgaattggaccttaaggcttatattataagtgactccactacatcgtattactggtttaacttcaaagttagcgtagcttaacttgttatgttatttataatggaatatgttcaccagaatttaaatcataaacttaacatgttgatgcttgtatttacgaaagttctaaacttgacacgttatgctcgtaattataaaagtcttagacttgacacttaatatatgctggtcagtctctcgatgatgcttataagagtagggtgtgcatgtgaatagccctgcttgtgtacagtgtttttgaaataaaaaaaattatatgtacaccctcgctctgcttggttgtatttcttcttgtttttttttttaaaaaaaaagagctacctcaagctgttgttatggccgtaagtaaaagaaaatatgtaagtggtttataagatacaaggaaattaaggggagttaattttagaaagttgtaactaatttgtcaaaaatgtagtttgctacaagtttaactcatcatttcagagaaccgcaacaatagtgtaacatgggagttctttaataaagctgcgactttatttgtctcataaatttgagcccacatatcatccaaatatgtaatactcacatcgttttaagttggccttacacgccatacacatagagaatgtagttatagttttctaataaaatcatttgttattgttataattttgtgaaatacccaattaaaattgtagcaaagtgattagtgatagtttgaactaaacaaccatagtttttcaaaatttacttaggccttgtttggccatttcccatgaaaaaaatattagatgggattaattgaacaaaatcgtaaggataaattaacgccaggaacatatgaccatttggctgtgacaactgacaactaacgatgccagcgtggcagtttttccgctgaacatttgccatgaccacaacacttaccgtggacttcttctgtaaactttgcattttcttttggtcagcgcgacagctagacacctgatcagtgatttctgccaaactgatgctcgctggctggctagagtgacggacggtgtgaaagatatttgcggtggaccggggccatcttggctgtttacctccaccgaagggtaaagtgaaaatatccggtgctgacacggtaacactaggaggcctggcagcaagtacgtatccctggcccgttgtgtgcatggctcattgggcgtactccaactcctcgagctatctctcaagtctcactctccgcatcgttcttctatctctgatcaatcgtgtcatctctcggaagctcagtatctttttagcaaaacctcaaaagccacttgacaagactgcattagcattagcattagcgatgcccggctggctgacggaggaaacaaaggcagccgcctgctattcgcctagtcttctttgtcgagtatcctttcgttgcaggcagtagaaggtagtactagtactagtactatagatttactagccggcacacgctgcagaaactttttgtacaacatgggcccttttcttcatcaccatcatcgtcgtgttcgactgttcgtgttgtcatcggcggcattgttgctgtcgggttcgaatttgcaatcaacggcacgcctagcaggtgagaaaaaaattcgtcgggtgatctacaccgttaagcttgttgaaacggacggtggagaattaggcgcgattctctgtggccgcaatcaaccaacggagcaaggacagatcggcgaatctctacgggcgtcggcacacggcgatcgtcggcgccgggccgccggtttggcatcgagcaatgctactgctttaccatcctggccactgctgcaaacctgccaggctgccacacgcacgcgtaggcagtaggcacggagaagtgggccgtttggccccttttttgggccgttctctcaaaattcggcctttcaactgaaacgagacggtccttttgtacggtggatagaaagaggccggaactgggctttcgaattaagcccatatattacctcagcagctcagtgcattgagggtgctataatatttatcggtaatctacaacgattttgctaaacatttattgataaattttctcccaaaaatcaaaattaaatacaatataattatagtgtaattatattgtaacttgtatgtaactttcatataattttgaatagttagatttactcaaaattcatgcaaacggctaagggaaaaaatcacaaggcatgcacgagtgggagtattctaccccccccccccaacctccactttatgagaaaatttattgaaaaatatatagatagttcacctacaaaagccacaaggaaaacgctctcgaatttgttcgccatatctctttaactaacgaaaagtgaaacacgaggattaaccacatcatctgaaaaatattagccgtcggattcactgggagacaaaagagggtcaatcaatcttaaccattgaattagatggatgggaaatttcaagaggattccagaattgcatgaagctatactggaaagaaagacagaaggaaaagaaaagacctagagaataagcaggggaaaagataaggtggtgcatataattttgctatactggaaagaaagacagaaggaaaagaaaagacctagagaataagcaggggaagagataaggtggtgcatataatttttcgatatatgtatatatacatctatagtaaacattgtttataaataatatcctcatccttgggtaagctattcatgatgcactcaaaatgtatggttatgtgtgtatttttttttcatggctatagccttagagctatatatagacttgatatttttcctactatatcaatggaaaacattgcactatattttagttgtttcaaaagaacgtgtttgaggaagaaatcattacaaggatatgtacccacattccttccaaccaggcggccatgatcgcctaggtttttagaataatttcataatggttttcactgtatataggtttaatgattttgcacaaatattataaaatacatatataaaatatatgtgcacaggctataaaacacacaccgatggaaaataataggatctcattaccatagtaggctagttattgatgaacggattatttgttccattttctgaaaatatattttctcgaaggactttattctacttaaattactttaaacaacttgtgttaagctgtttttttaagtttattttttataatattcacccttacaatcaactagataatccgtaacaatgatcgagtgataagagcgtggtattgctaaatgatggcgttcggaatgtcttttcccgtgcatgtgaagagggttcatatgcatgttcagaagttcagcttgatactatcacacacagtacatactgcagatttgcagaacaatggacggttgacacagttcacatggagaacatcaggaccaaagctagcacaggcgttacataataacaccaccttataaagtgcacaatatagctccaccatcgcccaagcgacactatagtaggaactgtggagacatacgatccctaaactgctaaacaccacagaggaagaaagggatcgattttcgtaaagcttaactagctagcttaatttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctctgaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccactaagccgactcccggtccatcaccgcaaatactctcccgaggcatcgagtcacctatacatgaaacaaacaaagaaaccatatttcgagaccaagctatctccaacttaactcattcgtagcaaacaacagtattatatacgtatagtatccatctataagccataaccatgaaacaatcacggatatccaaagaaacaacccgaaaccgaaaccgacacagcgtcggccggtcagaccgcgggcaagccggtctgaccgctcacatagctcctgtctgaccggcaacaaccgcccggtctgaccggtcccgacaaatcagtaaaccctattcatctcctgaaaattgattatctccaaaaccacttcgacgataatctccaaatatcaaaaccgataatcacatatgtcaattgttcatcacagaataagaatcaaaacacacattgatcttacactataatcatgttttgttagatcaatatggttagtgcagatactaattgagatccgacgtgttgcaagagactatgggtgtcgatgtatatcctaatcctatcgtgtgtctagctcggttttttgctacaataatcagatcgacgaacaaattctgcatggaccgacgtatagtcctgcagactccagattgttcggccaataattcgagaccgtccaatatgacgcagaattgcacaggttcgttcaccgacaggcgacagcgagtccgtaacgcgtgactgttgcatggagccatggagtacctctgatttaatgacttgccccggacgtggcctgcctaaagccattgcacctctgcgatcgagcgtaaatggcggagctagatgagctagatgctggtcgatcgggttcatcagatgctgcttccttacagatttagatctgccaacacttctgacgacggggttgctggctctgcttgtgtaggtggcaaggacgaatttatgaagctatacgagcagcggccatgtgagagccatctgattacatttacagccgctgctgccccggtctgtgaggccagcagcaggaggcgtcaatgcgatagccggctagctagctagctctcgccttttatttactgcgtacgtctcgatcgtatgcatgcaacattgcaacatcgcgtctcgtacatgcgctgtatgaagcaagttcttgttgcgatcaacaggggaaagaaaatggccaatagtgtgtgcatgcctgtatggtgcgtgccgactgttgttgattacgtggtagctgttcatggcagtggatagaagaagtttgttggcaggtgaaaattaagtgcacgcgaactactcgctacattttccactgatgtctctgcaccgtcattcatttcagaatagcgcgcggctattcggggacctgctgtaaatttttcctctcctttttttgctcaccagatttctccggtggtcaacagggtttcccaaaccgttggggctagggttaccgtgccccggcggtaagcacggttaccgcgcggtaaccgcaaaaaaccgtacaaaactgtgtaaaatttatcaaaaattcaaattattttttaaatttatttgaatttaaagaggttaccgcggtatttatattaccgtacccccgcggtaagcccgataaccatgataaccgcgcggttaccgacggtaagtcgaaccgactggtcaccacaagatcaatgcagtttaatcagtgcacttccttaccattctcagccattccaaatttcgatgataccaccacgataacacaaccttaccattttttataattctaaaactttatagtctacaaatttttttaacaaattagactttctcaaaacttatttcaaaacttgaccgtgtaaaaaaatttcaaccaaaaaaagaccatcagttcaacgccagggacactggccctaaggttgtacataccaacgccagctacgttggcgttgatcccttgcccacatggagccgaggacaatcccctcgccgacgtggcagggtctcaacgccaacctatcaaaaaaaaaaagggacaaaactagtctcaacatttaataaggtattaaactaaatactacatatcttcaccttaccttatcaaaatttaacattgccaaagtttagtaggtttttatttatagtaaagtgaagaagccctataattcaataaacatgtatgcgaactgccaaacgtagcaacaagcagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaaagaactagacgagcccggagataaaactataaaagggctctgtgagcaatttcgatgtagcacagatccatgccatggactcatgaaagaataagttcactccaggtccttcaacttgacgtcgagtctcttaaaccacaatctacttctacttctacttctacttatatatatatctctacttaaaaagtaaaacttgtttccgtcgtccgtatgaccgtaaagaaaaacacgtagaaaaaaaacagcgagaaaaagacttctgtcgaaaaaaaaattctgactcctattataaaaaaaacttccgactcccttgaaaaaaaggacttctcgtccgtaataaaaaaaattcaaaagaagtccgactcaggcttaagttcgatcggtagttttaaaaacagatttttaaggcaagtaacgataaacctcattagcactcattagcacatacatgagtactacttaaaaaattaaagatttttccatcgttcgtgataaaacatataaaaaggcgaaaaaacatataaaaagaaaaagaaaggaaagtctgagtcatcaatgacgcggagaaaaaaacctccgttcgtgataaaaaaaagggcgaattttttgttcttcacggagaatctaaaataatcatccaatcggacaattacacaaatcgagaaacctaaaaaaaggggaaaaagagaggaaaaaaatcacacagatgagcaagcttgccgtcaaatccggttgttccgagctcgtcgccatcgccgccgaccgcgctcctgtcgtggccttgcccgctgggcatggccacactcggcacatcccaacccgcgctggcaccccctccctctacccggtgccccgccctccgacgctctcctcttgcttggagacagaggagagaaagagaggtggatggccatcgccgaggtctccgcgccgtaggctcgtagccccgccattgaggctgacggggagagaggaaggggaaggatggtcgtcgccgccgtcgtcgtcgctgtcgtacccttgccgtcgctgcactgcgtcgagcactcactgacatgtgccatgccggcgagactggaaggagagggggagaaggaacgtccccgccggtgggggaagggggagtgtcgccaccgatgggggagggggaaggggagtggtgctgccaacgccgtcgtttgagaaagagggggggaggggaaatgatttacgattagggttagggctgccgacgttttatatatgttcggatcaatcgggaccgtcgatcagataggacggctacggcttctcccactcgggctgctaacgccacacaattgggccatatgtacgctccgcatggataagttcagttttggtccctccagttgtcccaaatacttactaaaccaaggccaaaatcagattcaagccatttaaaattgctgggaaattatgatcaattatttaatcagttagtagattatttttagataaatgaaaccaacaaaatgtttatctagaaagtattaattatatgatattgtatttgaccaacgttaatatggttttatgtcaaaataataattatttccttaaatattaaattatttatagaattcaaacatattccactaaagattttatttcgatactataaagtgtgtgtttctttcccattgcagacgctttgtagcactgaaaaaactgaaaacatactatagtagagtgcaacaaagcaacgaaacgtttaacctcttttactaaatcccgttgcaacacacggacatatttactagtaccaaatataatatgtatctaaactcgtaaaaccgatgtaccagagatcccagggcagtataaagctcggctttggttgaacgagttagctacgtatggcccacctaggcacccggctaactcagtgtggccccgcgtgtcagttgccaatatttcttcctcctctctctccgtctcacccatctctcatcaggttgggtcactggaaggcaggagacggccgacaggaacaaggcgagccgccggcgggaggtgagttgcgggaggccgagccaccgatcgaggcagcacagacttcatcggtaggcgatctctgcattgttagcatgcatgtgtatgtcgtggactccaaggtaggaatgtggaatacttccaccgttttaggttataagagcaaagtcaataatagagtaagcagcaagctttaatttttttccaactcatcaaagttatcagtatagcctctgtatacaatagctagctatactgctgggtccatctatttcactttgcattagaataatctacccctctctcgtaatgttctctctttctccgttgattggctagctatccatcatcaatgcttcttatctcgatagatgtgtgcagctcggcgatagatttgtcgtcggctcacgttctctctctcccctctctcctccagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggagagcaacaccagcgtcttgtgccgcgtccaccgcggcgtgccagcgccggcggccggcgaggtcgtgttggcggcgccggacattgctgctgctgctgctgcctcccggaactcgatcgagacacatcaagggatccaccagctgggatttatctacggccatcgcagccattaaatcgggaatcaaagcttgcaattttggcatccagcagaaacatgcaagaaattaatctcgtgctacaaatgccatctcatcatactcatctcttcttatctcatccaactaagaggccatagaaaatcagtgtcattctactggcaaatcacaattaggcaaaaaaaatgcaagaagttaatctagtacaactaccgcagctcgcagaagggcaccggcgaggagctcgccggagcgccactgccgccgctttgcctcagggcccttatcaagggcttggtcgccgaccacggcgaggccgcgccggccgtgcacgcacacgcggccaagctcggcctcgaccaccgcctcgtcgtccgcgatgggctcgtcgagctctacctcgcgcgcgtcgagctcgcctccgcgtgggcgctcttcgacggattccacgccggctggccgagacgtcgtttcttgtacggccatggcggatgatagcggcgtgtgcatcgacaccgtcgccgccgtcgcggcgttctcggcgtgcgtgcaaatcggggaccttgcgctgggtcgggagctttaggaggatgcccgtgaagaagaacgtcctcgtcccggccgccgccgccacgtcgcggccggccgtcggacctcctcgccccggcaacgacctccccaccaccggccggcttgcccaatccagagagaagagtgggagagagagaagggaggaaaggagaggaagggagaggctggttgttgacgtggcatcctgccgtacggggctcacatgtgtcctacgactcagccgccacgtcagataaatcggggtcaaaaccgctgagggacctagtttgcaaagttgagggacgcgttgtatccggttttacggttggaacgattttgtaactcgaggacaagttgagggaccttcggtgtactttttccatcggattctgacgaacggcccatattagttttgtcggaacgggatcgtgagttcgtgacggacatatgggctgaaaagtttggcccggaaggggcgtgtaccgtgagcccatattgttgggctggaacgaacgggctacataggttaggccggaacggtatcgcgacgagcgtgaagcccatataagttgttgggccagagcatgattctcgttcgatctccatcttgacctttcacgtcgctaactccggaaaatttgtcgatgggcggacggtcgctctcgcaccatcacacaggcaccggctgtctcccatagtcccatgttccagtgaattcacaaggtacaccatgacacctactaaaaaacaaactttagcacatgaaggacttgtggctgccgttaatgaagccatcggaagttcacaaaaaagaggccgtcgtcaaatcttgtgccaaacatcctgtttcgttacagagagagggggaggacatttcaacgtgcaggcgttgccggtgatagaatttggttcctcgtgagcaggcgtccttgcggatatccagccgtcggtccaaccagccacaagcgtactaccctgtctgccgaaccggtcgagttgaagatcccgtccaatgtagcgcgcagtacacaaacatcttatcccgtcgatcggcacacatcggcagtacagtcggatcctgttcctccatcgccgtgaacagcgagcggtcgatcgatcgatcgcgacctagcttcctcgccgcacgctcgatcgaatggcctcctgcatgcctctaggccgacggaccacgagaacagcccgcgggcagcgactcctgagccgacggatgacggatcgacgagactcgacggaaatgccgctttgccgtgcgggggcgcaagcacatggcacatggcaggcagcagcaacaggacgcgcaaccgcgacccgcgcgccgctggtgcatcgcgtgcggccatccgtctcatcctccgggatcgcgcgcgtgcgtgcggggtgacgtacgcgcggtgcggtgcgggctccatccaaccacccgccgcgcgacgcagggcaggttttcgccggagagagcgacgcgggatggatggatgagtaggcgggggggcgtgcacggcgccatcggttcggttgggccgggcgctatcgagccaataatgaacggaacggtccgaactgggaagaacgcaagcctctcccaccgtcgttacgcgcgcggcccacaccgcgccatgataggatcccacttgacatgcacttgccgtttcgtgtctaggtaagacaggagtagttagctaccgttaagtactactagctccctttctttggaaatgagagcgaaccgcttgcaaattgcttttttctcgtatgattgagcgtgccctagctaacgcaattgatgagatgtttaagcgagcgaagagcacgattctcctcgacaatcatggacaaccaccgaccggggcaaagaaaaccttccttccaaccgtcattaaccagtgctgtaacaaccacgaaatgcatgatggtgtctctgatgatcgaggcggttggatggatgaagaagattttgcagcgccctactgctacgagagattctcttcagacgagtaggcgtggtgttccattcgtgcatgatgaatctctttttgtttgggtgcgacctgcagatgagttccctgggcttcagtcgccatcacggcaagattttgtggtccgttttggtgtactcaccacatgcttgctcctcgctctctctccatcttccaaacagtcatggcctcttcagcgcatggcgtgaatagttcaatgccttcaatgtgagacctggttctattatactccctctatctacaaataattaaattatttgatgtttaaattttgcctataatataacggatcctacattattacttttccaattcatccaaccattacatttgttgctcaattttatttgcatagttggcgttatctttactaatctggtaaacctataggacaatttcaccccagctcaatactatactactgttaaataacctagaacccctaatatttacggacaaaagaaacacttcgcatgttaataccatcatttatagacgaagggagtactgtacatgctaatgtcggtggtaaaaattttgacgagcaaaaattggatttaaaatttatattatatggtatttttaacttatttatgatggaagtggttcacataatccgcctctaccaaaaaccacacaaccaaggtaaattcgcatattgtatgaaatgcttatgatcaactgtaattagatttagtatgtgtttggttgaaagaacggaatagattgagatgaggcgaatccatttttcaagttgtttgatttaagaataagtgacatcggatcatgggatggttcgtaatcccataagatttgggtcagttttacacctcagaaactaacggactaatcaatcctacccacctcctctctcttattgacaaatgagccacaccctccgtaaagaaaatataacgattctatctgtcatgacaaacatatgactaaaccattccattcataaaaaatatagattatctcacctcattctcaaaccaatcacgcacttagattatactccctccattacataatataagggattttaaatggacatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttgttgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagctaacatggcgtgggggcacgaaatggatggttaattagtcacttgatagactacttctttttgaaagattggcacgcatgttctctttgaaaggaacggattatgacgggaaagctaaccgcgattttgttttcttgtcctccaatacgtgatctttgaaacatcgatggttccgaattcatcacgctatcatttccgcctgctaggagcgatcagctgctgccctgtgctgctagtataaaacttctcctgttgcatggtagtgataatttactaaaattacgatgacatagaagtaatttgtactgttaaactaacaatgacgcatctccgaaagaaaattttcaaaagggctttatgaagttggttgggggaatccattaaaacttcgtgtttgacctctgttgtgtaccagcaaaggaagcaggaatcacgatacgcgacactgtcgaaagaaaaggtgctacactaaaagcaactgaagaaatgcactgcaagttcgcaacgtgcagatcatgaatatactcccaagcaaaccggtggaagagcgcaccaatagtcccattccttgagccactaaccaacatttcctgcaggccgatccttacaggaggcacgaggttacatcgataaaatcaggatcagagtaggtttggagcgagtcagcgagagacgtgttattgcagccacctgtcactctgccacatgtcacaggaaaaagaacagtactatatgcagaggagatgaacgaagaatgcccattcaggtttgtcagagcaaaaaacgtgaacttggacaaacatgcctgcagtttgtctgaagatttcgatttttatacacctttttttgatcgcctacgtacgtggccatgtttatgccatattgccatgtgaaggtgtgaacccttgcaagcacccatgggcgtcaggctatatcctagtcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatgtctatcctggcacgtaaaaaaaacataaacctgcacgccaagtcatgtcatgcatgtacacttcgtgcatgaatcacacgagagacagcccacgacgcgcagccacgaagcatggccatccacgataacgtaccggcgtgtaatcgaattcgtgaagcatatgtctacatgatcacatggtcggtatggtcccttcacacctgcgaaattcgtggcccatatagcttctgcgagccatgtggcaagtatcaaagttcgccgatttctcgtttaaaaaaatgctcggtgatttttattgtttttttttcttttgctgcgattaactggacttgttcctgcagacacacgggcagttggtgtctccttgtgcgtgacgcgcgggtccgacgaggcgatgcgacgagcacttgcatgtgcggggctgatcgccctgatttgtatgtgttaaccgccgtcgtggctcgtggccggttatggtgggctcaccttcctctcgccgccttttgtctccttttccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaatggcctcacgcagtagtgccctgctcctcctcttctcggccttctgcttcctcgcccggcgagccgccgccgactacggctcctggcagagcgcccacgccacgttctacggcggcggcgatgcgtccggcacgatgggtacgtgtgcactgctcctcgtaacactttgtttttttttcttttggacgcattgacaaaaccgggagtaatctgactcgtgtcgtgttgtttgtgtacatgaaaaggcggggcgtgtgggtatgggaacctgtacagcaccgggtacggcaccaacacggcggcgctgagcacggtgctgttcaacgacggcgcggcgtgcgggtcgtgctacgagctgcggtgcgacaacgatgggcagtggtgcctgccgggcagcgtcaccgtcaccgccaccaacctgtgcccgccgaactacgcgctccccaacgacgacggcggctggtgcaacccgccgcgcccccacttcgacatggccgagccggccttcctccagatcggcgtgtaccgcgccggcatcgtgcccgtctcctacagaaggtgagctctacttgggtcaatgggtcacgagtgagtggcaaactgtttgcaacttgaagccatgggccccccgtgcggtgtgtcggcttcgatgggccgatccccaatcggctgatcaggccatgtgtaggtgggccacccggcagatttggtttgtccacgatctgtccgtgtcggctgtaggcaaagccatgcacgcacgacttgacaccgacgtggacttgacttcgctgtcccggaattactttacgcatcccatttcacatccatatgattaatcgttgcaacaaatagtaacaaattacagttaattctactgtttcactgaactttgctttttttttttgctggtgtgttgcagggtgccgtgcgtgaagaagggcgggatcaggttcaccatcaacgggcactcctacttcaacctggttcttgtgaccaacgtggccggcccaggcgacgtgcagtccgtgtcgatcaaggggtccagcaccgggtggcagcccatgtcccgcaactggggccagaactggcagagcaactcctacctcgacggccagagcctctccttccaggtcgccgtcagcgacggccgcaccgtcaccagcaacaacgtcgtgccggccggctggcagttcggccagaccttcgagggcggccagttctgatcgagtactcggctaattccgtttttcagttcacttttctgcagaaatgtcagtgtgagattgagattgaggtggaggaggagggaggcctctttgctatagtaaaagagaagaggctttggctattctgaggctgcttattaattagcacccgcttaggcctttgctttctcccataggtccagtagacataaataagttatcatggagttgggcattttttttttctgcattgttgtagccttggtttaaaatttggcaaggcaatttaaggattatattgtagaacagcagggaggtggtgtcttgtaacttttgttgttacattgtaaccccccgaatcaggccacatgggccggaggagtttgtgggggagcaccggagcactcttgtgcttttgggaccatgaactatgctagtttatgggtctatgtatatgatatgtttgtgatttgattatactttcttttgtcgccttatcaagtaccaatcattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcgacgtacgaaacaaataaaacgggcccatatctattccaccgcagaattccagcttgaactatcaggccattacaaattcggcccactagagcatgtattctcaaaagcaaaagctggccatatctatgctaccgcaaaattccggcctggactttcaacccattaggaatccggaatactaaagtagtagtacgaagtagtattcttcaaaaaaaaaatttctttgatatgaagtttgttttgtattgcaaaatgtggcttgactatccagtataagtgtataactattctgttcacgtatgctgataaaacaccaggtagactgttcaactgattggtctcacacccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatcttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaaaaatcctttaaattcctccattccaagggaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttcgagaacaaagatttagaccccaagacaatcattggatttggaatactaaatggcatatctattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgatccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgcttacattttgggacggagggagtaggtgtttctcaaatttaagtagctgatctgatacacgttgttttttttctctccatttttttgtatcagctataaatatgtggatccaacgtagtatattgatttaacatcatatccttcttctgctatcactatttccttccccatacagcttaaccaattttgctagatgacaaactttatccagaagaaattcaaagtctcttcaactcaactgctctaccaatcttgtccataccaagcgctgactcttttcatcattggtccatttcttgatggttttcttactaaccagaatgtatttgccttcaagtacacgagtgaaatccttgtgagcattccctggctcgatgttccctttcttatttgtcttctatccattatacagtaatatatctgtttgttatctttttgtcaggtattcatcgttctttcctgtctaatatctgtctcggtaaacttcagtacatttcttgtgatcgggaaaacatctcctgtaacataccaagtagtaggccacttaaaaacctgtatcatcctcggttttggatatgttttatttaacgacccatttagttggaggaacatattagggattcttcttgccttgttaggaatgatcctgtattctttcttttgcttgatggagaataaacagaaggccccggaattgtcagctccatttttccacactaaggtatcagatagcacttcttttctgaagccttaatgctacatttgcgacttgcagctatttttttcatatctcgtccttgcaactttagctgacccgttattttctttcactaacttactttttcgtgaatgtgcaaaaggattacacgtcaatatattagaactttcactaacttactataattccttgcttctcacccatcggtaatcacccttgcttatcaacctggcaggtgaaaggaggtgaagcagggactcttctcctagtacagaacgggtcagctaaagttgcagatggtgttgtgactgagggcccaatgtggaggtcaaacagagacttggacgcatgatcatcccgctcctgcagaagggatcaagggactgacatatggtctgaaaccggtgtaattttcatcggcattttgctccagttcactccagctagctagttctgaaggctccttgctctgcgtcttgtacatacatattcggcacctatttttgctacgactgtacataacatgtccacggctggaattaaacaaacatttgcattcatactattatatgaagatttcatgtctgttatttacccgaagagtaaagtgcacaatgcgtttgttggttggggatgggaactaatcccttcgacatgcaaaacagaacgaaatattaacgcacgattaattaaagtacaagttccttttctttttaaaaatggatttatatgatttttaaaaacaactttcgtatagaaagtttcaccaaaagcacaccgtttagtattttggaaagcgtgtaggtcgaaacaaaaatgatgaattcacttgtagacttttaaatggttagactatgatgaagaaatattgcatgcttatatttaggatgaagggagccactttgataatacaaaatccattcaagtatttaccaaacttttgtacaaaagacaaaagtgttcacagatctgctacgcatttgcaaacggaggtagttgtagtagtacgttacgtcggctgttctgttcccttctctgatataaaagcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgccgccgccgccgtcgcctcctccatccgccgccatggtaaggccttgcttccctatgcttaacgcctagattgctttgcgggattcagcgctgaactgacctctcttcttgctgcatcggcgcagaccttcaagcgccgcaatggcggccgcaacaagcacggtcgcggccacgtcaagtacatccgctgctccaactgcgccaagtgctgccccaaggtaaggcgaagcgaatccccttttgccctctctcgttgcgcgcgaggcacccactggatctctgtgttgatttgggaatctttgctttgggtgcgggacaggacaaggcgatcaagaggtttcaggtgaggaacatcgtggagcaggccgccatcagggacgtccaggaggcgtgcgtgcacgatggtgcgtttcctctcccccgcttttggtttcttttgctgaatttgtatgtgatgcgaaatcgtagtagaggttggatttgtgatcgccgataacacactggcgatttgcatactgctggaaatttttattctatcttgatattgttgaattgatggcatacaatacaactatctcgttgcaggatacgttctccccaagctttacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgtagatatctcttatctgcacatatggtctaatatctttcaagcacgctgaaaaattaaaattctttagtgtgctgattctatgaagtttaccatttagcttttagtcaaatgtaccggcatacttaaggaagtatactcattcagccagcttctataatctgaaatccactgttcttttttggaactgcatgtcttccctgatggcaaatactacatgttgcctgtgggataaacaggtccttgagattcacagcatcattttcacaattggctgatggtttatgtgtaacatttatgttgggatatgtatgatatcctacaaaaaagccagctaccaaaattttgttagggcctcaatccaaaatggccctaacatcaagtaatcaattttcatcgaattcagtagattgtaagctagctagtctgttgttctttaagacaaccttaatttgtgttaacctgttctaattatggaatgctgattgttttgtgccaatgcttacagtatctagcttcttgctagtgggtttgtgtccctctttgttgcatccagaattcagatgcgtttgtgatagtatagtagtatcaaagtggctggcctatgtatcaaaaccacattaagatatctgcaaatatgtccactcatcctagaaagtgattaagaggagcgcatggtgtagttgcgattgatgtgtttaggctgctgttattgatgggctctattgtttgttattttgatccatatttttttgttctcaagtctatttattttggagcgatcttaatcgtgagattatatgtttctaaactagttgccgctattttgcaggaggataggccccaaggccctcgtccaggtggtggcgctcccgctcctggtggagctgctgctcctgcccccaacgttgctcgcacctgattgtctccggagtgataaaccttttttcagtcgtttccctaaatctagcatgataccagggtgttgaactttatctaggaccaacctgttctttttcaaatatcggatctgctgttactggtttcatctttactaaatgtggtttaccatttattcgattcgttctgttcctactcacgccgtgtcagacgttatgtgccgtgtgagtttttctgttcctgctcatgcttgtgagagcaacatcgtatgttctcctaaatcccgagtatgttactttttctttatattcagccaagtgaaacacaatggatgctcaatgtacgttcctgaccaaaatccagaactctaaaggccatctttgtgcacgaaactctgctgatcgggccaaaccgcttggcttttggttcaagctttttaaaaaactgtaactgaattttacattttttgtccagatttgtctggcttatgtcagtttatctcgcggaatccgacgatagcgatggattgtgaatctgatccggccgtccaacttgaatcagacaccatataagatgcctttttgtgggtgggaaatcatttccatttccaatttagccaaacattgcctcaggctgtgagcctgtgaccccaccggtcagtcggccaccgccacctttgcgccatactgcctcccatctctcttgtcaagtcgtcagccagccagcctgccccgtcgtgcctccactttcccaccaatttaacacgattccaaaccacggactccatctggaccgtccaccagcgcatcccacggtcacctcccgtccccacgtttttctttacacccacgcaaccaccacccaacctcaagagagcacgtcgcgtcgcgggctcgcagccgagttgatctgccgatcggccggcggcatgacggcgacgtccagggcgccgcggcggccccgcgtccgcgcccccgcgcgcgcgccgccgccgaccccgatccggacggcgcgcggcgcgcgctccgcggcggccgacgagctcgtcctcgccgagttcctcgaggcctccctccgcgtcccggacctcgccctgccgcccaagatgagcagcaggcgctcgttccgctaccccgcgccgcccccgaccccggacgtcctcgcgggggccctcctgtcgggccccgacccggacgccgcgcggacggctgtcggcgccgccgcggagtccggcgcgttccgcgtgggcggcgcggtcgatgccggcgaggtgcgcgcggccgtggaggcggcggaggcggtgttccgggcgcccgaggaggtgaagcgggagctcgggaggtggttccggaggagggatcgggtggccggtgaggagttctactggttccggccggcgacggcgagctcggatgacgaccgggtgctcgacgcggcgctgcccggctcgacgtaccaggtgttgaggtatacacgtacgccacattccgcctgcgctttttatgccgctatatgtagtaagttttgtccttttctcgcctcgtccacatcaaacgtaggtgcatacttgaagagagtttcagaatttgagcggttttagaagccgattttgatcggataaaatacgtgcgcacttaaaattatgcaaaaggatcagtttggtcatacttgcgtttttgttagctctattgaactactctccactggactggactgaagaatatctcacttgctaccgttctctcgtcgatgtcaattggaatgagctgtagtctgtagagggtacggaactgtgtacatctgttttgagtaccccagagcctccggtaaccgttgcaacttgcaaggaatggaaggcccatttagatgtagagagcgagctagagaaaaaggctggcacctgaaatgttgcaggggtacaggcacagcccatgcaagtatgcgacaagaaatgttgtgtggttttcttttgaaggcgtggatgctgtcttgtggagtcattgtcaaactctatacaacatgccgttccatcacttattttgttccaattttgatgtttcggaagaaaatatcagtggaacaataataaccataatattctgtttctttagcctgagtgggatttccgctgattcttagcgcagttgtcaaaaactcaaaatacaccaaataaatatagccatgaatgtcgaaaattcaatggatatgcgaacgggcctgttctacaataaccccattgggactttcataatggaatttttgtgtacttacatcagatccttcacttcctagggaaaagatggagattgttgcatccaaaatggaggatcttgcacaatgcgttatgagagttctatctgataacgccaggaatcctgaagactctgctctgtctacaggggccgcgtcaatactatgtctgacactatataactgtaacaagttgaaaactcattggagtgagtttggcagcaccaatcctccaaactcgtacgctttgagcatccacctctctggacgagaccaggaaatttgtctgcggaatcagagcgggtcaactttcttcagtttgccggcaggctctatgcttgttacaatcggcaagcagattcaggtatcaacagaaccattgcttattaccatattacttattgtaattctaacggaaacttactaagagtcctttttttttctactcagaacttgctaaatgaactcttaaccaatgaattgaaattttcttatacgcactgaacatttgcatcatcctttatatactatcaccgtctcatactttcattgacatggtggtccttgaatccttaccccaggtctgccttgtcagtacattttcgtaagtattcggtgccatatatgggatcaatccaatccatgtagcctttgtaggctaaattctaattttctatccatctttcaagactgtaatatgagcaatgggcagtggtgcttgctgtatgcacagtttgatccttccatgtgtggaatgtgacacagttttgctatgtgcgaactcaggaatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgaggcttgattttgctgttgaggtattgtttggaggtgagatttttattctattacgatggaggagttgtttgtaaaggtgcaaatgtttttatgcttcacaaaaatatattacaatatatgatattattgccatgaccatgtgaaaattgttcattgtatgcccgcaagttgcaactattaccttcatcccaaaatattgctatgtaaaataggatgtgatattatttagtaccactataaatctggatatgacatattcgtattactagatatatcatggatcctgtttagatttgtagtatcacatcttgtcttaggtgactgtaatttgggacggaggaagtatcacaattttcgaatgactattattggccgtacactcgtacttatttatcacctgaaatgatcgttctacgtcctatgctcaactcggttgcttttctctacacagtttcttcgttgtgtcggtccagcatgtggtgaccacccctcccccccaccccaccccaacccacatactcgacctgtggagtttcatggtgatagatctccaaaagtacgtacctgccctgtcatgtcccgcgctattacagtgtactagtgtactactgctctgctcctacttgaccatgctcaatcgatcaaaacctgagctttctttcagtaaaaaaacgaaaacggcgttgcagactcggactagtccgcagcagtaaaacgcggcaccgaaaaaaaggatcacgaagagatccacgagaggggagtaggaacggaacggggcctcgtgacaagaaaacgggggtccaactcgaattgaacggccacccgcagcgcgacgcaactgcaggcacacagtcgtcgccagtcgccgctcgtactctctccgcgaccatacgtgacgccgtgacggccccgtccttttctcgccaaaaggcaaagctctgcacgtaggtatagctcttgcgtttggcagcgacgacgaccaaagaacgcaaagttgcaaacgctgtgctctgcctcttcttctcgtcttcttcttcacgggttggttaccttgggtttctggcaggttgtaggcacctgaaagatggacgtgcgaccaaccaaaacgccgtgctccgtgaccgcctcctcctcctccttcttcgtcgtcgtcgtgttgcccgcgtggtggcggtgtgcgtgagagagtctgggggccttcgctgataataaatgtgggcatctctcggacgattctgctgttgtgctgctaggaccaaggtggtggcaacaaggagaaggagaaagggctgtgggggggactggtgggctacaggccgtgatgccaatctctcaacctccaccgtcctgtgcgcgatcgatgttctagtgtacggtacaggcagtgtcatcctaatcattgcaatcattggcgccatctttgctagagactcccaatccttcgtctcgttgtcggttctattggcttttcccttttgtcacgtccttctgatcatccctgaatttttagtagtaatttttacttacaccatgtcaaaggctcaaagccagcatcttggccttgggcatgacgcatacacgtacaccattttattcggttcagatcgatccttcctgccgtcgatcatggtaaactagaccgtaggtcgtgtcctgcgatgagtgaaacactgctgtctttgtcattctggtacattgggccattgggctgcttcgtgatgccgtgcgcttttgcagtactactagtaagcagcaccggctgcctgcttttgcctggtaaaacgagtgctgtgcacagcataacggcacctcaattctgatgtgtggcggtcactcatgaaggctgctggtagtagtagtaacatttcgaggctgtgccaaaagttacaccattgaattggatctgcaaagggccgtagttacactgcactggaggttgagagacatgaaccattcactctgcactggacgagcactggccatcagccgtctcttcttcagtctctttctctgctgcaggggtgtcacagtcacttgtttgctggagttaattaagctccccatttccattgttactactgcattctccctgctctcgatagtcggatgtgatgtctcaatgttaaagcccttcactgactaatcactgaggcctccgagagagaacgtagtgaatgcccgatgtgtgtggctgcggcttgcagctgcagcgccttttgtcaggcttacatgtacagtagtatatgatgtgtgtgtagagtaggagtaattgtgtacagcatactcctactgtagtagaggaaggaggttctgatctgcagcttgtggggtgcagtaggagtaatactccgtgtactccagtatttgacactggatgcagtgaaactggttcttctgcttcttggcagtcgttcataaacgatctttgcgagaacggtaaacaaaccacgcatacgcagtactcatacatccatgaatttctctctgaatgagtcgaagctgcaaaccgggacacagattgccgtgtgcatgcccaccacaaccgattggcttccaatcctgtcatttctcagacccgatcctggccgaagcttccaacaacagtacgctatgcagtaatcctaatactatctcgcccatgcacagcacagcctgaagcagtgaagcttgtgaaggatcaacgacgacgcagtagttcacgaaagcatctcctgtttcaccaccgccatggcacgcactgtccctgtgcatgcacatacatgttgactcgagaaacacactgaagaatgggacgcgcgagctgcaccatgtcgtgcgtacgcatcgacgatggcgtgcaggttcaccctgctggtactggtacagtaggaccgacggccggacggccggcaagatgggtggacagtggtggacgcgctgttcccgggtattcacaaggtagaaattctacagaaaatcttctatcgcccaacctatctttgaccccaacagccacgcaaattcttgtcgaaattgatgatgtaccactactagttaggtttcagacattcggcaaacacactggcatagtggcatgcagctgaatcatcatccttccctcacatcagatgccaatatgctaagaattcagtggctgttatcatagttgcaagatgtgaacgccacggtggttgtttccaatcattcccgtatggccgtatcgtgctatgctgcaacatttgccaaggaaacgagctattagctagaggccatgcaaatggggacatcgtcatctgtggaaccctatgctgctcggggacaaacggagcggagctacagctcctggaaccatttcaggggtatcccatgtgtcttgtggaatgaagagagcagaaggaattaaattcagaatgatctgatccttaggacatcaaggggagccacatgacgtgccaagtgagctccaagctcaatccaatttatctaagatccgccgatatctggagcttgtgtttattagacatggctatcatgcattcatgcatgacggttttgttcatgtggtccactatataatgcagcccactattgcgacttcttgaccagaagactcaagatgagcaatcattttagtaagactgtcattgttgccttggtattgtcgagtaggtacgatccatatgtcatgatttcatcgaattgttcgtatgctaatactactatttttaacacaacaaagacatttgccttctactcctactgtggaaagcatcatgttttggagaaagaacatactactagcaagttcagacttcagagtatgtagcactgatactttacagaagttggatgaattctttcctcaagctctgcagacacaggctcctcattgatgaggaatggaatctacagactactactcctactacgtatatactacagccactcttgtatatgatgagatgagtagaaacaataggagcagtaggattgcagtgattcaattgctaggttttttgtctgcaactgttgctacttctgtcctctctatctagctgcactacccacaagctgcgagctcaagaagatcgcaattcgcaaggtgcaacaagctgctagtactactagcattcacaactcacaagcagaataactaaaaagtactaacctgctctgaggaaaaagctcttatacaaggacggactgttcatcacttaaagaggatgaggaccaggaactcgcaactgcatcggtactgaatactgatcgataccaggtctccaagaaacagaaaataaaggaagagagacaactgtgaacatttacttgatggtactaatatgttgacctgtactgtgcttgagaagcaaagcttgtccaacattagtacgcgagtcaaggttagtatcctgattcgtatattagtatattacgatactacgattttatcaaaccgaaacgataccgcgatatcctaattttgatagtatctcgatcctactattcattaccacacgatcctacgtaatcttatatagtatcctaattctacaatccaacaaaatattatttaaaatatgatagtttgaaaataatgaaatatgctcaagtttatatataaaaatcaattaaatatatcaaaactaatgtggtttttcttaataaatatctctatttgcatgacatatattattactatattttttatatagaatggctatatgtaattaatataaatattaattaaacttttaaaaaaagaaaatctcttagtatcccgatcctacgatacgatactactttgagcaaaactatattaactaagatcctaatactgacaaccttgtcgcgagtaactcaatttcttgtaaacacacacagagactatcaattaataccaggaatattttttacctgtatttctttagcagtaaaagaagtataagaaaggcacacttgttgcaagtacaattttcacaatatttagatttaaggtaatttttttaaaaaatactagacacaagagcagtttgttctagatcacgcaaatattctagctagatcaaaatcaacttgctatgctaaattattcgtgaaagttgaatagttttgtaagaaatgataagtttgttatttaaattcttagtgaacagtggcaattgcagacgcagcagaccttacgcatttatatagggtgtgttctttttctctattcacctttatgcatgatgcttatctttcattatctaaaaaaaatatgtgcttgatgatctttgtttcagaatgaaatttgtttaataatctattttagaaatgaacttaaagaagaaaatatccacattatactagctacatgactaaaccagttgataaaggcagacagcaatgggagggtctcttcttctctgcctccactagatggcgttggcgggtgaacgctctaggggccaggatctatcaaatgtgatcgttgacaaacgcagggtgatggaggatccgtttggaatgcttctcaagagcgtcttagtgtgaggattccccaagaggttgctaatgttatcaacatcgacagagaagacctcaacctcctatgagaggaggcctctttcggatatggacctcatgtttcctttgtagttcaacttgattcttctgccttctttgtcggtggtttggatcccgccgtttatgtaattattgctgttgtgttgaatttgtgtaaaagatctagctaaaatctttggtggtgtatctgaagcttctcatcgtgtgttagcacctgaacctccacatatgagaggcccctttagggtttgtgagcatgcttttcttttggcaactcgccttgtttcaagctccgtagcagctgagctccaagcctatgccatcggcgtcgtaggcagccaaaggagaataacccaattgccttttcatattgtattatgttattttctgcaaaatgttgattgaaattgtaatttaatcattctaaaagggcttgtttgcaaaactggatgtatcctatactgagtttttttttcttttaaaaaaagaagaatcagggagtggccatttttttctgcgttcctctctgtaggttattttgtgaaaaaaatagaagtggttaaatttgcaaatataacccaagtagcacgtctatgtagcatgtacatgcaccttgcttagttttcttggcaccctactaaggaaaaataacttgtgtgggagcacttgtgagttgtgactcaaatgcacccaccagacaagatgagtgattcgctattcaattacaaaaatagtgaccaacttaaataagaaactcaccgtgcaagttgcaataccaatagtataatttgcactttaaacaaacttaaataagaaattcaaatgcgatatactactgtaatactccatccacgacatactagcttcttagcgatcttcaacattatagtttgatcaatgatttattttaatttataacatattttccataaaaataaaactaacattatacaaaaatattttaatacgaatccaaaaataaggacgcgttatattttagattgatgaaagtaattcaaaaaagttgctactactaagcattagacaaatacaaacaataataactataacttgaaattaaaggctattttaatctaattattgttatacagtttatgttatggttatggaaaccacataccacctccgtcccaaaatataacaacttttgactatgaatctggacacatagttgtccagattcatagctaaaaatgcttatattttggtacggatggagtacctaatagtagttgactaagctcggcaggaccatcatatattaagtcttatacggaattatatctcgtatatagaaggagttctggataaggaatgacgaatacagttctatatgaaaacgagaaggactactcgaattgtatccatattggtctccctagttctacttggacaaaggggtatctatgggtataaatacaagaccccttaataggaggggagacacaacaacagatagacacacaatatacaagccaacatatgccgtcagacatcaacattagggttaagcctagaaagaccaacaagagggatttagcgtcaaatctgatctcaagagctcatactcgaggaggaagactaccatgtcgtcaactatgtgttggttatccatgccgccaagttgacgacagctcgataggttatcccaattattgtacttgtgtgatccagatgaataaagagtaacaccggcttcggccgacaggagtagggctattacctgtcaaataaggggtccgaacctgtataaaaatccttgtttccatctcttttacctcaatctcgcataccctggtaccaactatccctatttcatgcaaatactgtagtcgagacctcaaacgtcgacagtttagttagggtgaaatttactctggaaatccgctcgattttttttagaaaatcatgagctacaattaggagtccgactttcgtctcaagttaacatacaagtttttttaaaagatatttcttatacggctccttttgtattttcaaaagcgaacaaacataaaaactaacttaaacacgaatctatatttctaaaaatgaacgaaattaaaaaccgactcaaacaaggataacgtaccttgtattggcaaaaacattttcaacttttataatagtcgagattaataaacagataggcgtgaacttagaaagggtctcatcttttcgcttatatttatacttatcagccaaaatttgaatttttgacgttaaatttggagttgattttaggggtttttcatcaaagtttatttttcagactttgtttttagatcgctaagaatgcatatataaaatttttattcataaattattcttcaaatgcaaatatgccgtaaaacgatgggtccacaaggtttggattgatgaatactactccctccatcttcttttgatagtcatatttctaaatctaaaaaaattatttttgataggcatatttcaatccaacaacctatcctcttaatgactttctcggatttaatgcgtgactctacattcttccacacaagattggctacatgggcatcgagaaatgtaaatattaatgaatcgcttgtttacaaggaataactggtagcatatttaaatggatgataagtagaattactttggtctgtgtgccaagatgaaatatgactatagtttaagtatgcaatgcggtagtacgtacattgcatcggtaccacactaagcgcgcattcaataagcatcaatcaaactgtcaaaaaaaaagcatcaatcaaagactccaaattaggtgcttgtcaaattacggtttgattaatgattaatccatgcaccacaatgtctcggatgctcaactaacttgacacgtcgtcatatacttgtactgaagtcttcaactctacatcacgtacaacagtagtggtgtagtaccattggacactactacatcctacagataagaggcagagccaatagcgaagaaatactactgtttgactccattagatttgtcattaatattatcatttatcaacaccactatttagtctttaccatagttgatttctacagtactagtagtaccctgttttgcctggattagcctctcacatttcatactagctactgtagtatagtaccataaatgtaaagagacagaagaacagcatagtatcccaggtctggataacactatttatcatacccaattttaggatcattaacaggctagagcaaaccaagattctcaagacgacagctcttggcacgatgggactcattggattcaccatgcaagacaagagttgcattgcattgcactagcacgagtgagcttgagactgagctcttccgctacatcttgatgtccgcgaggttggcccagatatgctcgaacacgtcgacgatgaggtcgtggtactcggcggcgttgagcgacaggtagcacgccaggaggtcctccaggtcggcggcggtgcggatgccgttctcggcgatcatctcctccatggactcccggaagtccctcctcgggtcccgcgacgacttcaccaccgcgaagctctccgccaggggcggcttcgtcgtcggcgccggcgagcgcgccgccgcgggtggtggtggtggtggtggctttgacttcttggccacgatacgcggggtgttggcgcgcgtcttgaggcggcgcgcggatgacaccgaccgcctcggcttgctctgttcgaggagggtagtgggttttttagccgacgcgcgtctcacgacgtcgatgtgtttctcctccagatcgcagccgtcgagctctctcctcgccggcttggtcacgataggcgggagcaccttgtcgggcctcttctcggtccgcaggtcgatgatgatgtccgtggcggaggtgatcaccttgccgtcgagctcgtcacacgcggcgacggcgaccgtcggcttcttgaattccacctcttcctcttcctcgtcatcgtcgtcgtcattgtagccgacgaacttgtcgcggcggcacggtggggtgtcgggcgcctcgaccacgacgagctccggcttgcgcccgcaccggcagccggtggacaccggcgaggacaggacgctgctgccgctgacggacggcgccagcttgacggaccgccgcctgtgcctgcgcctggacttcctcggcggcgacagctgaagaggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccgccgccagcgcccgcacctccccgggcggcgcgcatgtcgcggagcttgaagaaccacgcgttcgggatcatgtcggacagcctgaacttgtgcctccccatggcgccgcgctgcgctctgagctccacagaatgcgcggctgctcgagtataagaagagcaagaagaacaaagctttgtgtgggctgcgtttggttgcttgctgctgctgctgcgcagcttgctctgtacgaggaggagcagaggcgagcagaggaggagatggcgcggagcagaaaagggcgggtaatagagtgggggatcggcgaggcggagaggaggggacgtgaggcgccttttgtcctcgctcctctctatgcggcgtgggcccccacctcgcatggcttcactctctcagctctcatcagtgagacaacgccacggtgaggcctcctcttccattacagattatttcaacagtactgtacttactgctgctgcctgtatttttatctgaaaatccctgtaaatctctcgaagttttggttgacatgagaggctaaaaaatgtttcaagggaggtcggggataggatgataggatggaaagcgcaggtattgttggtcggagaagaatgggcctacgctgcactgcacgtaggatatactactacagtagacaggatatgatatgaaatctgaagaaatttcgcttcgctcgcttgtggattgtggttacgtcctttgcctggctgccttcaattcttttctttctttctcatctcatcaggcctttaattacgcgtcgaaaagcatccttgtccgggacctcttgtttaatccttttatttccatcacccctgggcgagacaagcaacagtactactactggtggtggtcgctggctcggagcttgagcggtcagtctgcgagatttgccttcgccgcttgcgttcacaacaaaaactccgagactccgagagggtgtgtttagttcacacaaaaaattagaattttgattgaaattagaacgatgtgatgaaaaagttaaaagtttatgtgtgtaaaaaaaattttatttgataaaaaagtctaaaagtttgaaaaaaaagttgagaattaaaccacgccagaggctctaaatttaagatgccacgcgcagcttttcgggccaaggccaatggtcaaatcttgcgctgcaatgcaaagcaccgaaacgcaatgcagcgagcctgatcggccgcacgcatggcggcttatcgcgaaagccacacacacgcaaaaccaaaccgtaatcctgtcatgacgcagtactaaacttgtacttgcatgttagattagtgtggttgtgtggcacttgtaaagagtcaactggcaagtggcaacccaaaagagggacgtgggtgaaggtaccggagcttttgatcgtaaaaaccgagtcctcgatcggcatgcttaacacgggagatggatccagcaccggcaccaaacggtgtcgataggattgatggctgcgtgcttagtgctcggcgatctcagaaaggtgctcgttattgtagactagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttagccaacaatggatgggctcagctcaaagaaaaaaaaaactacgaaagggctaacccttcacaagttgtgtctgtatcgtggatggaatgatgatacgttgatcttgtttgaaactgaagcagataaagattttttagagaaaaggccgaaaggcccagcttactatcaagcataagagtgcagatacaagggtaaacgctggggaagccagcttgaaatgatgtgctgaaaactcaacttcacttctattaaggtgctgctggcacagcgctaacaagccaggaaggaactcacaaagaaccacacagcaaaaattaacgcactagtttggtcctgacgcccgaatactggcaagcaatgagtccttcagaccatccacttcgaccttcagcttctccggcagcagccctctccactggatcaaaaacgaaacagctttgtgagggagatgacatatattagaaagcagcttgttattgaaaacccagtcatttctcacaagccaaatcgcccaaatccctgcagaaattacgtgtaaaaagattattgccctatcatcccccatagtcatcaagatattcataaactccctcctggaagaagggacgtgatcccaatgaaacacatctctaaaacaacaccataaaaacctagctggtgcacatttaaacattaggtgatccacatcctcttcagcaccacagaacttgcagaggggatctccattccacttcatctttttaagccgatgagcagcttgaattctccccttaagcatcagccaaacaaagatcttaattttcagaggcacgggtgtcttccaaagttcttgcatctttatgtctctaatccccccaaaggtcatttctctatagagagatttcgtagtaaactgtcctgattttgttaatttccatctcatcctgtccctatccgtagataagtgaacatttgcaagatctgcaagtagttgttcccattcaactagctcctcggcaccaagcgatcttctaagatcaatcctccagccatcagaggaccataattgactcactgttttcccaggatcagccactatactgtaaatgtagggaaatttgattttcagaggtgtatctcctagccagacgtcatcccagaatctagtaccactgccatcccctaaatcatacagctgcccaatttcaaccaatgttttacctcatgcaaacctctccagaattgagagcatccctcagtactagactggaaaaagcctcccccgaagcagataaagattaagttgatatacgtaaaacgagaaaactattagcatagaattaattaatttttaattattacaaacttaataaatgtatatttttctcacgtagtaatggtgttagatattgcaacaattttataatccattgcaacaaatagaaatccttgtagtgaaaacaatttctatatagaaagttttcacaggaaacataacatttattagtttaaaaaacgtgctaacagaatcttaattgatgtaatgtgtatgtgaccaggccgattgatccctgtcgcggatgttactcatcctgcatgcgctgccgatcgatcgacgagcgtaggtacgttctctacgtcgttgcctcgtcgctgtttgttctccatcgatcgggttcagattcccaccggtacttttcgcggatcatcatgaggctaatcttgtgttttgtcacgagattagagcatcctagtcatcaaattcctcagggagccctgtcaaagtacgtacgatacgccggctgcgagagcagctggcgacacacagtacctgcgttgggagtatacgcacatggacatgtgctatacgcaaagcaatggtagcgaagggtcgtactcgtacacgactcgggggcatgtattattagcgtatttcggccgtctccccttaaatcgatcggtcccgtgcccatctgctgataatgatcgaatacctgatggcgatgatcaatacgcaacaaagatacgggtatcctttggtgtgacggaacgggggacggctggtggtgtggtgtcttcaattcagctcaactcgattttttcatacagtcctatactgcatggtcactggtcatgcaagaaacgaataaatatgttcagtgttgcctaattggttggtagcgtacacgcacaaattaagccgaatctttcacatatctcgccccgacaacgtaactccatatcgacctctcttgaatagggcaggatatgaacctatggctccttttatgctgctctcaactctgaatcttgacttgatgaaccagacgtgctacctgtgtatagtatccaagatgtacgtatgtactccgtacatagctagtaagtgtgctgctatagagggtgtttgggagagaggtaacccctctcacaaaaccataagtactcgtttctgccaatcgctagggtgaggataacaactgttggagagtttgacctgacgtgacaacacacgtgtgaagcacatcaaagcaagcgcagggtagggtatcgcctctcgcctcgccgaggccgtagaactagctattcaatgacaaggacgccgcagcgaaagcctctggctctaacctctaagcccctgttaattttttttcatcttatacccgtcttaattggaatccagctcatgatcctaactggcccattgtacatagactagggtcttcttcaaccggtcgatcagtttggtctcaggctgccagccattgcattaatccaacaagatttgcagttgccgtagtaggttcattaagcgaggtccttggaaagaatctcgacctactggccggctcggctctcactggtgcgtactccatttttgcacaaatgcacctatgccctgacgacgatagaaaaggattggacattgttgcatcttgggactttggtttgaaaaaacaggagtcccccctacaaaaggtacgtgtcatggcaccatgatgatgattatctccgcgtcgataccgcaatctgatggggaaataaagctgcatccatggtgatggggaggcaacgttgctaccaggccatcatggagattgcggcacctgaggtccacatggttgttgcattgttgtggatcgatccatccattttgctcggctttttttttttatgtttgtttttcgaaggctttgtatttataatggcaatgtgagagcacgttcagcggtcggcccaatttatttccacacttccaaagcttcaaataatcaatgttctaaaatacggagtactccaacttcgatggctcaatctgaacatcaaagtcaaccgacaatactccagcattgttcatgctactacctctacttgcatagtcgccatacgttcagctacaacgtggaatagtgtcagcgacctaacacagtaggttttcataatctaatgaaacagaccaccttaatgagcatatcattacttagttccgacttggtcgctaataacacccagattctaagcattgtgctattgatgataggctttgatccctagagcttaattcactccagtcagagtaaaatcctggtctgctcggggctctatgtgttgtacttagcggaaatcatgttgttgaacgatagagtactagtaataaagaaccacgtctaattactgtattttgcacacggcttggacgatgggccgagtgtgagccgtgggcaaagctcaacctgtaattcagtttcttgtaccggacaattgagttcctatcagaatcaagtagtacttgggcagctagatagcccaatagcccatataaaaatccctataaaaattcggaggattatgcaaatctgagaggctgggcccaaccaaaaatttctgactagtatttccaactctcacgaggagaacattcatccacaaatatcacctcctgtacacatcatctgaaccagccagcaggcaaccagccacgttgcccaaatcgctcctgaccagacacaagcgtgcaagcgcgcgacgcaacgctcaacgccgtcctctcgcgcctgaaacacaccccggcgtcgcagtcctctcgtttcagcaggctcgccttgcaccacgtagccttgcagccgccacaagactcccatgcatgcgcacaccaaacgcctcctacatatatataataatggtttgatcagtcaccagttcagtttctacctgaggagaatcaatcaccgatctgcagactgcagccatggccatgagggcaatcacgctgtcccactcgcagagcgcctcgtttgggcaccaccaccaccaaaccatgccgtcctccttcaggccaagcactgcctccaccagatcagtgaaggtctacgcaaaggaagatgaggagaagggcagcaagcagtcattgttcgggagcatcaccgaggcgctggacttctcgcaggtccggtcggagaaggacgcggagcttctgtatgaagccagagaggccacaaaggatggaggaaggatgacaaaggagcaggtatccattgaactactgatccgcacaaaaaattgtcgatcaatggtgttatttagtttagtagtaacttagtactgactatacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcaacagaaactcaagtcaaaagaaatgctatatagagctaactggttatctgatgctgcttacctaattctgtagctatatgacgtgttcagaagtttctttcgttgaccatggacagatacaccctgcatctgatgacagtgcatccaatcttaaaccccggcattactgtaaacccaacactgaccttgtctccttctttggttatcttggatggaacacattccatgtgtttactcctaaattcagtaccacccttgacatagaacatctctgctcttggattcagagaacgtgctacggttagggacgcccatacatatcttgacattgtcacaaatgcctgataaaatggtgttcttggatggccgccattctcaacaaatgatctatgatccaaatttccgaagaatgaatcctccatactaggaggcaaaatggccagatacttttctcgacagaatctcccaaaacaagagtctggggccttcataagagcatcaaaaggatcactgaaactcattacataatcgaagacatccagcgaaaggtactcctctttgtgccccatcaacatcatacaagcaaagtaggcctcaacggcgtaattcttgtgagaccttttatcatagacaacagaattgtctattggggatgttaagttgccaagattccaccgagaaagtttcatccaacggacgacgagttttgcaaaatcatggatagactttgtcgaaagctcgaataattccataaacatatccgttgatactcccatcccaattgcaaaacttccttctttctgtaacgcactttgaccgatcttctcctccagttccatgttcttcctttccagttcatccaactccgctcgcaaacacacaatctcagagtctctcttgcacatgccagcttgcaactccacggccaacttttgttgctcctgaattctagagcccacatagcactggtacattggatttctccatttgttcatgttgacatacagatccttcaacccggcagtctcttgaagctccgatgtgaatcgctcatcagcgatcgtaatctcttcaggatcatatggcacaagagcttgctgaaggttcacgtaactcaatttgaggccagaaatcgcgtcgagaagcctctcaacaaacgcttcctcgcagcgagcagaggagcattcagagacgctctcatggtcggacacatgatgcgggtggactttcaggtgcgcgccgccgtcttcgctgctctctccggtggcgctgccgtcggccttgggcttttcgcggacggtcggcgcgacgccgacggagcgcaccttgcagatgtcggagatgcgcagcagcaggcaggaggagggcgtcctcctcaccttctccgtcgccgactccatcgcaagactgcgtactactggtctactgcaaaggcgaggcagagcagcatcaggctccaagaacgattcaagatggttgagacaggaagtaaaacatgcgcggattccaaggcgagagtttgcgggtcttcgaagagattgattccaaccggatcaaagccaagaacacgataaagtctctgcctttcttctgaaggttttgggttttagccgattgccaagaagaagaaaaacatcaaaaattgcaaacaaacaaacaacttcaccgtatattctcgcacagtcatgagtactcagtaatcactaaccagtgtaccttcagtgaccaccccaagaagctccaataaccgccattgaattctcgcgcctgcacggatccaagaagccaaaagcctgaaagaaaaaagctgcagcgaaggtgaggtccctgctctgaatcttcgagaatccaagtggttttgggagaatgggaggcaaagacctcgtgggctccaatggattcgaacaacaaaaaagggtggatcgaggaaggcgagtgggagccactcactcggggcagttttcttttgtaatccccagatgctaaggacttggccgaccataggaagcggggctaggtaaaccctaatctctcatttatctctgactcaatgcaaagactgtaactgcccatgcggctatgccatttaattttagttaattttaggctctgtaaagactgtaactgcagatctgacttctggccttctattccagatctttaccatggggatagaaagcgggaatattcagagggtatcgccacgtttttcgttttttctgacggtgttgcatgccgtgtcacgatgcagtaaagaagaattttttgggttggtggaagttgaatttgggagaggtagtacagtgctgaatggcgctcagtgttgttcagattttatgtttctactgctatctagtggtcctcagggtcaatcttgaatgataactgagatttctcggagggaataatttgctctgcccatccacatacacttacaatattttgcaccatcaaatagcctacttgtgtgtttgcacaataaacaaccccctaggagcaaagctttaaccaaagtttctttctgatgaacaccacacgattggagataagtaatgccatgtccccaatgcctcagtgtaaaactaactgatgctcgtggttaagcactcttccaattgattatgtctgcgcctttgagttagcccatacttgtcagttgccactccttaaatgcccagttgcctagtcctttaataatttccatgagcaaaaagcaagcagaaatactactagcatccatgcgagccataatttgttcatatttttgtgggagtaacaaagacgtggagatcagccacaacgattttctcctctgatacgaactgtttaattatctccgcagtaatatctgggaaaaaaacaaaccttttcgaaatacaaatcagtataggaaacaagtaggagtaacaaacgtacctggagccggagcacgtactggtatacgttaatacgtacgcgtgcgtgcagggttccaccactcgccaagacgatcgagccagcaacacgtacctagctacgaaaacgaactctcgccgatggttgatctgtcaggcctcgagatattcctcgccgtcgtcgcgctcatcgccgcgatctgtgccatctcctggaccgtgcgatgcttaatcggccggcggttcgaggtcgccaccggcgatcccaacggggagcgccaagggttgctgaacaaggaggaggtcgtcatcatcgacgtcgccgccgccacggaggcgaggggcgacgacgtggcgctctgcgcgatctgcaaggggaggctcgcggtcgcggtcgcggacggcgggggacagccgtgccggcggctgcggccgtgtgggcacgtctaccacgcggagtgcatcggcctgtggctgcagagggggacgacgtgcccggtgtgccgcgccgacgtcgttgcctcgcggaacgaaatcgtcggcgcgatggcgtgagagccgcgcgcacggggcgcggatgcgtgcgaccggggggcctgggtcgagcgccgcgttgcagggttgcacagggtaacatcaaaatttatgtttccatgttgtgtttctcttccggagatcttttttttgtacgtgcacaaaattggaacggagattaagctctactcctacctactttgactcttcttaagcccgtctgcaacaagaggccgatggacaataacattagcgctctggtccttttttcgtttagagtatccggaccaaaatacatgtctaaatcagtaaaaccatgggccgacaggacgcgatcttgtgttgctcacaataagcccaccagatcacgacgtttctagtcagcgacaaaaagtagcccatcacggtatcgcttcacaaagcttcgctctcagcccatcttgccaacgacaaaacttagcccatcacattcgcctcgcccacgcaaacctctatccgtcgcttctgcagtcgctgccttcgctgcggaccaacgagcgcgacactgccacgccccaacacaaacaaacaggacgctgtagctccaggaaaccattacataaaccattcggtcagcgatgcgcaatcatgattggtgcaacagtagagaatcaatcactacataatactattgtcaccagctagtattcgtataaatgtttttttagtacacaatccagtggctgattacaacatgtagacttcattaagtcctaactaacccatcgtccccacagcccactgaaaaactaatccgtagctgtttactttcgtattcatatttcctcgatttgctgtcaatcggatggcggcgtctgaatgacggacatgctagtttgaacaacacacagccatgaatatagtacaatatatttcttacactcatatatatataggtcaaaatcttcatgcgatgtgtaacctggaagcctgagatctcctaaaaaacagaagggtcagacaggaggtcactgattcatcaagctgagcaaacacgctggcatgtgtttcaagtcaaacctatttcattagtagcaagtcaggagcaatgttcagattacaaacccgtcgatcgtctgcaactgtacagaagtgcagaaactgagaaacataagctagcccgcatattctcgtagtgttgatcccttgcgagataagatggtgacattcgtgtctcagatttcattgaaagagtcatcatttgagaaattcggctttatccagggttaacaatccatatgattaatttatggattgaggataacttctctcggataatgacaaaaccaggtaatagatcgataagaatcatctaaaacaaactcgtaatagctcgtcacggtaaagtcgcattcaagcctggacccgcttgatcgatcttatcataaacccctatgtactctcggcacgatcaagtgccagattaaattattactcccttggtttttttagtttgatgtttttgacatccatacacatattctatcattaagttttacaatatatttataaaaaaaatattaaaacatataatcatgcgaaagcttttttcatgagtgagtatagctattactaggggtgggtagaaaaaaaatcgaactgaaaagaccgaggccgagaaattcggtcctcggcagtgaaagaccgaattttttcggtcaattcggttagtctccttggttaatcgaatagatcgcaaaaaccgaattaataaaaaaaaaattaaatgcaacctataatccactaagttcaataatattaaactctaattttcacattcctacttcttctaggcatgcaacctaataagagtctttactcatacgtgcttataatttttttttgattttgtgttgaaaatttcgattatttctttgcatatatgaaaatgttgttaaatttcggtcaggaccaagaccgagaccgaatttgttggtcctgaaatttttgcgttgaaattcggtctacactttccaatgacccaaaaactgaaaaccgaaaccgaaattttctatcggaccgaatgcccacccctagctattagcattgctaggcatattgaattctaatgctttttctatttataaatgatataagatttcaagatttgatcgcacatattttaggacatcatttattgagaacgaatgtaacaataaactttaaaaattctccaacaattcctactaaagcagtgggatttctaagggtatgctcgatagtgcagttttgtaactcattctccccgcattgaaaacaaaatagctcattaacgtattattaattaagtattagctaaaaagttgaaaaataattaaaatgattttaaagtatttttttctatattttttataaaaatataccgtttaatagtttggtaagcgtgcgtgtgaaaagctgttaatgttgaggttgggaaaggtagcgccaaacacacccggaattaaattatgaatgtagtaattttcatatgtggtataggcccttatttggaatgtttgtgctttgcgacaaataggctgatgctacaccaaaattcataatccagagttcagttttttatagaagaagtttttgatcattttcatccatttcttattcaaaatcgtggtaaacaaaactgaagcagtgaacctcatattttaggctccaagctcaaactatttggatttttttcaatatatacctttttttcaatattttgtgccgctttggtgtgtaatctctccgcctccatcacaaaataagccatcactacatcttgcaattgactgtatttttaaaacatttttaaggaacataccatagataaaagcttttgagatgcacttgatgttgcggtggcaagaggtatatggtgtcaaccccaatgtctcgtgtttaatctccaattccaaatcttgtttaaatagataaaaactctttttatatataaaatgatagatccaagcatgaacctgcagcatttggcgatagatccaagcatgaacctgcagcatttggcgccatgtacatatatagcatggcacacgcatgaataacccgttgactgtatgatattttgtactcctgatggctcaattgacctttgtatgttacaatcatacacaaagtcaaatactgtgatggtatgcagtatgctataaacatacatacagtccctgttcttttcagtctctcttttccagttcttttctggctatttgccagacacttataataatacaatttctaaaaaatatatattctactgtattgaccctttatactaatctatttataaagtttatttcttaatttattaattcatcatgttaatcaaataaacaatatgtttcaataatgcatgcaaaaatccgtgttcggaatgttccctttttatgaaatgacttgctaggggtgtatttataaaatttctcacggaaaatggctaaaattgtgaaaatctcaccactgatgataggttgataaccatccaggaagatgaaagtgattgaatcgatggcgacaactagttggatgaaatttctcacttttcccacggaatgctatcaaccggcgtttaaatcgagcttcgccatttctgtggacgcacccagctttgggtggcctctgccacgccgcaaagcgtccgccgtccaggcaggcgtacccgcccatccattctgccaatcgctttgcggctgcaatatcgacaggtttctgcaccggatttccgcagcgcggcactgttcgagaccagtcgtcgcaaccgcgggtcgacgaatggttgtcatcactacaacgattgatggtgatactggccaaatggtcccagtaaatgcttacaagtttcacgtaattccttctcccgctttcttctcttcgtttgactcgacgggatagatagatatcagtagatattagagcagttacaatagcagctataaaccagctataaccacatatcgagaaaaaaaagtgaagagagagaataaagcgggctacatatttatagccagttacaacacagactccgaaacgttatgtgtgtatgagaggtgggaccgggtataaatagtgtagtacattttatagtaaactattatatgaatagtctattagattagctatagatgatttggagccagtagttgactatattattaaacttgctattaggaacagtggttctaaatttccaactctccttcggtcattttcagttttgtgttcgtctgatgcaacttgtttttgtccaagtgcgtgcttgatcttcgcttcgtcgactattcgacctctctatacactatacagccacgaccttaatgccgacagcagcgaattaattagggagccaattgcctcgctgactgttcatgcacaagtcaccgagaaacagtggcatgaattggattgtctgacaagttcaaatgacgggatttgttctggaacccaagaatcatttcaattttaaatcggctgacttccttcattgccagggaagcaatttggtttcgactggaagaccagatcaccagatgcaatgcacgcggcattgtcagttgtcacaatggcgccgcaccaattaagaatagtgagcccttccttgcttcgaatgcagcattttgacactgtcagggaacaggaacgccatcctctgtttctcttttctatcgatagcctccgaagagcacgataggagcacgaacacccatcttttttttttctctttttgtatcttacccaaaaccgccagcttgatcaagatttggagatcaaaattcggcacgctctgatgggggcaaataaaaaaacaaaatactttttttcccaacaaagcaacgcgcaccatgacaaaagctcgcaccggcgcatgcagaaaagaacacccgcgtgatcccagaagccgccgcgccgagcagccaaacgccaaaaaaccgggagctcgtcggcaagcgcgcggcggcacgaggacgccttcctgccgcccaaccaaaaggcggcgccgcacgtctgtgccctcgcgggcagaacgttgaaccggccgtggcatctactactcctcctacgcctctttctcgcaccaatcaagcggcctgcaactcgcggcgtccccttcccgtgccgtgcaagtgcgtgcaacccaccgtgtcgcgaatcatgtccgcttcgccagcggggggcgagtctggccgctggtcccaatcgtcgcaatcactccggggggcgcccatgggccagtgctggcggctgctcctgccccgggacccatcaaccaccccctatgatagcaaaagtgccaaactgcgcgtcccagttgcttgcttctgttacattggatcatggagtagtagacgaccatggacgggggtccattcggtaagttaaatcggaacaaaggcgttgctttccttcccataccaaatacgagtagtggttcagacgtcataaaggtgaaggaaaaatccgggtatccttacgaatggcagtacagaaatgtgcatgtgaaaaatactttctatcttcgtttatctttcgagaaaagaaagggcgcaatttgagttggaattggaggggattacattggactgaagctcgtatgcacagttgatcaaacactcaccattatctctcggagcaaagaatcttgacagcctaaaaaagactctgtacagcaagaaggggggaaaaattatgtttctgaacttatcctacgaggcaagttgtgattggttttcacgaagccatcatggcagggggcaccacggtggcaacggggcaaccgccgcctcgctccccgtcggcggcggaggcggctgcccaccgccggcatatccggccgagcgaggcggccttccgccgggcgcgctccgtgccgatgctcatcagctcccagatcgcccattccacgccgggcacggccatgacctgggtcaccgccggcgcgcccaggcgccggcagagcagcacgagcgccgccgtggcgttctccctggcccagtccgtgccgcgcctcatttccgccacgagacgcgccacggcgccgtcgatgttgacgatcgcctccgcaccgccgcgcttggccagcgcggcgagcaccgccgcggcggtctcctccttgctaatcgctgacagcgccacctcggcgacgcctgcgtcaacgagcttgccgacgttctccctctcgccggccagcgtcagcagcgcggccaatgcgtccttctttgtgctcgtcgggccggtgcgcacgagatgcactaatttctccacgacggattggttcctgccgagcctgcggcggtaggaatgcacggacgccaagctgagcacggcggcggcggcgttctccttggcgcgccacgtcgcgccggagctcatgatatgggcgaccgcctcgacggcgccgtcggcgtgcatgatgcgcttcttgttggcctcgaggatggagagattaagcagcgccgtgacggcgttgagctggagccctgcatcctcggagtagagcaggggcacgagcagaggcacggctccggcctctccgacgaacgctcggttctccgagccggacttggatagcagccggatctcgtgcacgacgcggttggcggcatctggggagaaggagacggacagcttcttcacaaggaacgacgccgtcatgcgcgccgcctcgagcgcggccttgttggcggccaccgcctgggcctgctcgctcttgctcgcctcgcaggcttccatggcgacgccgttctcccggcaccacttggagatgaggttcttgagggccttgttcgacacgagctccagattggccaagacctgccctgtcttggggcacgttgacttgccggagctgaaccaccggtcgatcgactcgcgatcgtacgtctggccgctcgcgacgacgacggggtcgcgcattagatcgagagagattgggcaccggaagtccgacggcggcaccgggggctcgccgtcttcagcctcgacgtcagccttggaattggaatctgaaggccgaggcgtggcgctgaacaggacgcacttggcataccggaggaggccgacgagagcgatcatggaggccgtccatttctccgaggcacggtcgccgatctcctgctccaggctctcgatctcctcgctgcagctcgccgggtcgttgatgccgacctccaccaggatctcctccagcctctcccgctccggcacgatctcccgctcgatctcttgtatcagcgacagcacgctcgccttcagcgcctcctccgactccggtgccggcgagcaccgccggcactggcgcgacgcgagggcgaggacgtcgagcacgtcgtcggcaagccccagctcgacgaccggcaacaggtcgagcagcgtggccaggtcgtggttgagctcccgcagctccgcctccatctcgtcggactccagcagcagccgcatccggctgcgcgccgagcaatcggcgacgatcgccttgaaccgctgcagcaccaggagcacctcccgcaggcacagcgacgccgaccgcggcagctcccccgcggcgccgcacagcagcaggtcgtcgaacgcggccgccagtagcttggaccgcctcgagatggacgcgaacgcggcgcgcaggaacggcgcgggcgtgtcgacggcggacaggtcgcgcgccaggcggtgcagcggccggagcagctccccgtcggacggcgacgggggcggcaggaacaccgacgaagagccagacgacgacggcgccgccgccgccggattaccagccattggcgcagtaaccacaaccaaaagaaaaaatccttagcttattagtggagtaaaaccaaacggaaatggtggacacgcagcggagagctcgaaaagagagagaggtttataaacttcggaggcggtaggcgtggcgtgacgagttggttgagagctggaaggaatcccctagactgattttgcctttttccgtttatttctattgtgattgttatgcatcatgtgcttagtttatttgtgatggtattaggattatcttatatgcatactatagtattaatgtattatgatgcattggctggaaaggggggcagggtcgtcgcatggtggccgttggatgtggcgcgatggacggccgggatgggaattggatgagtgatgatgagtcagcccgtttcgtttttgatcggatcgcatctcgctctcgggtgcggcggctgggtaagactttgggacagatgagggacgagctaagcacccgagtggagttaaaagtacggtgagagtggcttttgtgagaggacaggcgaagatgtggaggactagatatcgtcagaacctaaggatagctgtaaagattactttgttcaaatccaggcaattttcacgtggaagtgggagacctgtcacactaagaactggagtaactgctagatctatacaagagccggctgctggattaaggtcctgtttggtttatagagacttattccaagtccctgtcacatcggatgtttggacacttttttaagtattaaacatatactaattacaaaacccattccataaccttggactaattcgcgagacgaatcttttgagtctaattacgccatgatttttacaatgtgatgctacagtaaacttttgataattatggattaattaggcttaaaaaattcgtctcgcggattagctctcatttattaaattagtttttttactagtctaggtttaatactccaaattagcgtccaaacatccgatgtgacatgggctaaaaagttttagccccatctaaacaccccctaatatgcatgtcctctacagtgagtagtagctaacatgtcctattccgtaaaaagaaaataacggttcgttgttagaattgaattttttttacggaggggtacaatatagaaattttatgcttactataatataaatattctactcatcctagaattttatgtggatgcgacacatcctaatactaatactaggatgtatcacatccgtctaaaatatcttatactacatccgtcccaaaatatagcaactttttgctatgaatctggacacacagttatctaaaatatcttatactacatccgatttgttgagatgtgaaaaggaataggtcccactacgataaggctattgaatgacaccatgggttaatggtcaccaagccaaggacatcgtcatgttggcaagaatgaagtcaaacttgtgatgggaataaagtcttgacaaaggatggtaaagacctcggcataaacatggttcaaccggatggtcacaagtgttgattttggcttaagcattgaccccaagttggatggcgcaaggcaaaggtataatggagctacgaatgttttcttagtcttttcccggtcttggtgtttggtgtagaccggatttgctagatagacgtcgtactattaagaggggtctatgaagcgagcatgtggatgatcttgcgccatattagttcatatgcatgtaggtgtatttggtgggcttgtctagccaagtgtggtgagtattatcaagtcctaaacaaagagatatgtgggcaaatcctataggtttgggtagcctcatgtggttatgtccggtggagtatcctttggagtgtgagccctttctccctgagaaaagttgtgtttcttggatggattgttcatggattggatatccctttgaataagctttccatagagtccaagagcgccaaattccgagacccgagtcaagagatatcgcattttactaacggttggttgtgctgaaaattaacctgcggtctgaccgtgggccttaggacggtctgaccgggcctgttagccggtctgaccggcgtgataaggccggtctgaccggcttcaatggtctgttgcactggtctggtttatggtggtgatacagagctgccagagccgcaaccggtcagaccgagccgaaggaggtctgaccgagccgtggacggtctgaccggccactacactgcggtcagaccggccaggttgagtgggctcaatgactgccaactagccgttacaaagtagtccggtctgaccggccactctatggcggtcggaccggcagagcacagagttggggatttcgaccccaacggctggttttggtggttgggggtatatataccctttccccagcaacaagggtaaggttttggcactccattgcattatcttgaacccttgcaagagctctcacactcttggcacttagtttatctagtgaggtgttagagagtgagttaagccaatccaagtgcattgcttcattgttatagctagtgtggcacttgatcatcctcggcaagcatcctagacttgttactcttggaggttgccacctcctagacggcttgtggaggtgttgcccggtgacctctctgaggagattgtggaggaggcccggcgccgtttgtgagtggtttggagttcaccaccttcgaagtgaaggaagaactaccctagtgatcgaggcttgggtagtcctctccgtgggccggctcccaccttgcccaccccttgatgaagggggcgtgcggtggcttcgtggttgagcggtggagttgggctcgcctcaacggggactaggaaaccggcaagtttctgaacctcggtgaaaaattccttgtctcttgtctcatttatttgttgcatttacatttgtgcaatttacattcatagagacatatttgagcccatatcacttaggtttgcaaaacttaacttagttgcttagttaaccttgcacctcaccttgcctagcaacttaggttagttttgttgaagtgccattaagttttaaaaccgcatattcacccccctctagtcggcctccttgatcctacagcggatgaggcagttgctcacgacggtgacggttagagtggactagggtggcgactgcgacagacggcgagaggcgatgactgccatggaggatgagggcggtgacggatacagtggactagggtggcgactacggtgacgactgccatggaggacgagagcggtgacggatgcagtggactagggtggtgactgcggcgaacaactagaaaggcgacagatatagtggactagggtggcgacaacggcgaacggcgaggcacgaaccatgttcctccccttgggttgtgtgtaacaacccgccttccagaaccgcgtagcccagcccatctgataggcaggcccactcacacacaccacccacttacactttcgtcatcgcatcgtgtaaaagggttaattcaaaagtggcacggttggaggaaagaggcctataagttggtccaacccttaggctgtgtttggaacctagggttcccaacctctctccatcgtattccacgtgcacgtttttcaaactgctaaacggtgtgtttttacaaaaaaaaagtttctataagaaagttgcttaaaaaatcatactaatctatttttttaaaaaatagctaatacttaattaatcacgtgctaatggatcgctctgttttctatgctcactgtgcaagtttggaacggctgattctgaacacagccttagtaaactaacaagattaaactaaacatgcgtacacaattctcataaaccacacaggtcaagtcatagtttggtcaggatgttatatacaacccctccaaatacctgacgtgcctatcgtctaacttacctttaacaatttctttactgattggtttgttttatgcgcacattgttaccaatcacgacgacaccaccgtgaaaggcatgaacacggtcaaaactctaccggacacaccgtcgaaaatttacattcacttcagagacgtggtctacaggttgcgcggatcaacagggtaaagaaacgtccaagaacaacccataatatctcgatccaagctacggcttatcggaggacgatgtatgccatatggaagaagcaagaagtaacttccatataccattggaaaaagtacaaattaccctctaaaactatcgcagtcgtccgaattaccccctgaaccataaaaccggacattcttcacccccaactatgcaaaccggacgaattacccccctcgacctaatccgcggtggttttggtctacgtgacgtacacgtggcatcccaattagcgttttttaataaaaaaaaatagtgggacccgcttgtcatactctcccacctctctcttctccacttttctctcaatctctctctctcttccccctcttcctctcaatctctctctgtctgccctctgcaggcgtgcacgagggcgagcggcaaacggcggcgtcgcggctacggctgagcggaggctactacggcggcagctgcgggcgcggcgcacggggcgggcggcggacaccggcgtcgcggcgatggccgagcggaggcgtcgcggcgactcttgggcacaatggcacacggcggcatggggacggacggtggacggcggcgcgcgggggtgcgctggcgggcggaggcgtcgtcgaggtgggggcttggcggagagacgggaagcacgatttttcccctgtaaatttcccggtggcttgtcgcatctcgttcatcgtcgttttgtgcttctacctgttaatctatctgatggttttcttctatcatttgagttttggtggagtccacagaccggacgctcgacgaacaacggcgacgaggtagtcgagcagggcagcagcagccacaccggcacgcgcagcccgctgaaccgctcctggcagagcagcaagcagaggacggcacagccggagcacagcgtccggtccgcgcccgcagccgccgccgcagtcgatgccgtggtgaactcgagcgccgccgtattccgctacgcgacccacgtctcgccgtcggagttgaagatgccgtcgccgagcaggtcacggaagacggtgtgccagaaggggggtggccgccgccgctcgccgtcaaccgaagcaacccagccgcgcccgccgtcaacctaagcaaccctggggaagtgaggaagaggggtggccgcagccgctcgcctgcgccgccctgccccgccgcttgcctccccgcgttccctgcctccgccgtcgcctcgccttgcctcgccgcctccgctctcctccccgcgctcgctgcctccgccgccgcactcgctacctccgccgttgccgggaggagagagtgtgtgtgagagatagaagagatagaagagagagagagtatgacatctggtcccacattttttaataaacagaacgctgactggactgccacgtgtatgccacgtaatttaaaaccaccgcggattggatcgaggggggtaattcgtccggtttgcatagttggggatgaagaatatccggttttatagtttagggagtaattcggacgaccacgatagttcgggaggctaattcgtactttttccttatactattcgatttgacaccatcaaattccaggtgcgcgatgccatatggaacatgccaatcccgcccaacaccctgctgcgcggttgccggccggaggacgacgcccttctctgtgatccggcagttcggctacctccaactagcgaaagcgcggtgacgcgtcgaggaacacgacacgggcgggggctagctgctgctacctgcgcgcgaagctccgaagacgcagccatgctgatcactccacttaaaaaaatgccgtagccgacgacccgacgtgctgatcaggaaaggtttcgcgcaagttcagagaaccaaggtggtggcgatatgcagatcgggtcaattcatacaattcgcttcacgtgcgcgttcctttcatcaatccgcgattaccttttgcctcatctttccatcacccggtggcagccgactagcagaaaccttttgggtgggtttggtctggggtgtgttgggtacttgagttactgcagctcgcacggcttagtacgagcactttgcgtgcgcctaaaccatgttttattgtatttgacctgacattcctggtcaatttaaacaggccagcagcacacgtacgagtttaaggaggggccagcacaaaagtgatagctgcctttggtcatcaacgttataaaggtcataactaattcataagtcataacagtgaactattgatcttttaattaggtgttaggattagtgatgttctcctcaaaaaagattaatgctgttgaaagattagtgggtaggtggtctgctctcctgcgttaagatttctctatattaccaatagtagtgaatagcccacgaataccacatgcaaatttgaattatgaagatacatgtctattcattacatattcagtgtacctatagttatttaaaaaataattgtatttgtcttattaataatctaactaatgcatgcatatataccatcacaaattggaagcggcaaaaaatagcatttccacaattatatgggcattcacctatgtggggttggattataacagcttggattgaaaaagaatccacagattttatgacatgttcatattaatttcaaatcttagagttacattaattaataagtactccctccatttaatattataagtcactttgatttttgtaaagttaaacttcttaaaagttgaccaagtttatagtaaaaatatagtaacacttgtggcaccgaattatttacattgaatttaacattgaatatatattttgatagttgttttctttgtgttgaatatattactatattgttttataactttggttggacattaatggtttgattaaaaaaaatcaaaacaacttctatgatatgaaacagaggtagtactactaaattgagagtgcaagatgagctcatcaaatcatcaattaaacatcacctacgacttgctaaatactaattctgaatttaaagtgtgattaattgataaaaatactaaaataaaaatgaaattcaaagagtgaaaattgatatttatattaatttaaagtttgagattactaagttgcagtagaaaataataattaagacacatattggatataacattttattgcaaattttaggatcattaggtgcttggcgcggctggccaaagccaaagccaaaaataatatgtactgaaaataatatgttatttccatgcaaactgtgcaattagttttttgtttttatctatatttaatgctccatgcatgtgtttaaagattcgatgtgacatttctgggaaaaaaattgggaactaaggcctggtttagtttccaaatttttttttcccaaaacatcacatcaaatatgaaatattacatatagatttttaaaaaactaattgcacagttgcagggagaaatcgcgagatgaatcttttgagcctaattagtccatgattagccataagtgatatagtaacacacatgtgctaatgacggattaattaggcaagattcgtctcgtggtttccagacgagttatgaaattagtttttgcattcgtgagaaaaacccctttcaacatccggtcaaacatcgacaccctaaaattttctttttttaactaaacatgccctaaaccaggccttagcagtgtaaccggactccgctacggtgcctgtgttgacatggactattgacgtgtccaaccatttggctgcctccgagccctctcacagtctcactgttagaagtgggcgtatctagttataaacgtttagggtgctaataatggggtagttatgtgataattttatttgttattgatgtagcttagggaaatgtgtcagctagagccaactatgaacatataactcatattagagttaatatatcgtaaggttatctctatttttcttctaatagaaatggagaggtcatacccttttaataaaaaaaagctctatttttcttctcctttctttatctctcacggtctcacctatgtatttaatgtatttatttttctatgtactactccctccgtcccaaaatataagagattttagtgggatgtgatattcatagtactaggatgtgtcatattccaccaaaatcctttatattatgtgacggagggagtagcttttatatgaaagctaaccctcttcattttttaaattctctcctttacataaatttctagttagcttttgtgtttagttcacgccaaaattggaagtttagttgaaattggaacgatgtgacggaaagtttggaagtttatgtgtggaggaaaattttgatgtgatgaaaaagttgaaagtttgaagaaaaaatttggaactaaacaagggcatattttaacttgctctaatgctgcagcaaaatgatagttttgtctttaaaattaaagttctttaaaaaactacttatttatttagcctggattatattatacaaagtttatattatacaaagaatgcaataggaaaatagccgtgccgatgcaacggaatatcaaggttgatatggttcctcttgcaagtagcggaaaatataatatgttagtcatagtacaatgatttagaattttgttattaggaacgatggaacttgttcttgcgtagaatatatactgaaagatgccattataaaatttattaggacgaataaagtataagaatagagatagacgtacatcggaaaaatcagggcccatacaacgctgcacctaatctatcattaagattcactagttaagcacatcaactggccacctaatcatgacaaatgtgcgcactgcatttcttcttttttttaatatgctttcagtacaaaccctagatatgaatgtggacatgatgtatgtccagattcatacccaaggtttaccttttttttttgggacggagggagtatatcataagtagaactcgtaccaaatgacaccaaaagttccagcaaaatgtcgactagttatcatgtatcttcaacagtagccatccaaataaaacataatgcatcaaaactttggctgaaaacaatatgttattactccttaattaatcgccattttatgctaaaatactagtgacgatactgtgttaacaaagggataagaccggcacggcgtcggtgtgaagtagcaaagccggtggcaggttcttgataataaaagcacgacgcttttgtagtcgtccccgtatcaatcgccagggtgtcactggatgctgcactgacaatactgttaggtacagcaattagaggaggagatcacgcatgtaccctactgaaaaaaagaaaaacaaaagaacctgaacgcttttcttttatagcgaaagtttactagctccagtctagaagcatggaaccggcggttgctctgcggaagctagcgacgaaggcacaatgcggtacaggagaggcgccgggagtaaatgggcaagcaggcagcgagagagagccgttagcagtatcaaatgcgtccctgcgctgccgtgacagggaggggacacatgcatctggggctagcaagcagactgccgatcgagcgtggcgtggggggacccaacccgatcgatggatcaacccctcggttttttttctgtcatctgcgtgtcggcgtggggcatccaccattccaccaatcaaagtcgcgagctcatctctctctctctctctcgtctcatcggctcatcgcgcggtcctgccgccgtgccgctcacttggacgaactcgatcgcccaccgtttcgagcgaaaccgagcgccgcacccgcacgaacgcacgcgcgcgggtgctgatccggtcccgtcccatccgcctctccacggcttggtttcacgtgggctccccggacccggagaggttgctagctaggatttggtttgagacggaaccaaattcatgtactccctccacagtctgcagaaacagcttcggattagttgagtctgagtgcctcacagatgatgcattagcaggtccatgtttgagggggagggcaacggctcaacctaaatccgaatagtctcgtcactaagagtgggtttagcagggaccaaaccaactgatctatcatccacctttgtatttttgccggtgtagttagcacgtaactggggtggcgatggagcatgacacgaaccaaaaaggatgggtgctcacatcacattcgacacaaaatacttttagaacgaggtatccatcagtgtgcttctagaaggccggagttaattaagtttagcaagaacccttgtgcatgtcactgggagtgacagggtaaattaagctcacgaagtgacagggtgataagtgacatggacgtcgcacaagtgcagaacagaccggccagtaggggattaggtcccgtgtccctttgtgtaggcctataaatggtgcgcgaattgcgtatgggtttggggggcaatcggtccagcccggtctaagtttcgcccgagattgcgaaagatcaacagtccaaccggcgaccggtcgattgcttgcgcagcgcgctcggagcaactttgggttgggtccagattagagaaacactttcgatcattccatcgatcggcgacgtgcaaccaacctcgcatgcacgtcgcaggtccatctctccctaaagcgaccgcacagggaagggacatttgttcttttgctatgcggcatttaatgtccgactaagacttccaggactccaggtgataagtgtaaatcagttaattagtgtcccattggattggctatcatcgactatagattcgtttaattagagcaagtttaatataatagcccactactagctccaatttatttatagccaattaatacaatagttgcttactgtactattaatatatggtcccacctatcatacatacattacgtcttggagtccgtgctgcagctggctacagatatgtagtccgctgctcttctctctcatcttttatctcattaaaatatgtttatagctggctaatagcctgctattgtacctgctattaggtgtaatgaaacttcttgtttgatttttcaaaaggaaaatactagtaaatcacttgtcaggcagtagtggtaaatactactataacggaagaaagtggaggccgtatctgaaaccaaacgcatgcatgtgtcacggcgttgccaccaaagttggacggaaatagatactagcactgacgtactccaacacttttgcttttatcactttttggtttatacctatgtgcacaaatttgtcataaatcgagtaagtgcaacctacgagggccatgtgccgaagccggagggagacggcgatgccgtaaggccatttactgatgtgtcattctccctcgccattccacatcggcaaagcaggagggcacacgccacgtctacttctaggcccaccagaataaggttcgagtgtccaaagatggccattggttcttggcgaaaaagaggacgaatgaagctgggagacgacgctgctttcgcgtcgtggagcgagtggcatcgccctccttcccatgccagccgtcgccctccagccagccgcctagcccgccgtcgctgtccgcagccgtcgagctcgttctcgtccctgccatcggagctcgccggccacaccacccccgatccgctcaacccgaagctcgccggccactccgtcgctcgattcacgccggtcggaggagagccagaggagaggggtcgccgccgtgggagccgaggtcgccggccgcgccgcccttgcagggccggaagaggaggaggaggggaggcgctcgagcctccggttgcgagtggcattggagtgagcggcgccagcggtcgtgggggacaggaagggcgtgtcgcctccgcgtcgctcggagctcgctggccgctccgaggtcgccccgtaccgccagatccgcgttgccggcctgaggaggagggcagcgcggcgacgaccatggtggcggcgacgaaactacggccgcagccatcctcgcgccgcgcccggacgagccgtcgccactggatctggcgagctgccacgccgtcgtcgagactcgtcgctgccacgccgtcttcgagactcgtccccgccatgcgagaggaggggaggccaagaagttcgccaccgtcgagcgccaagcccgccgccccgccaagaccgccgccgccgtcgcctccttgctgccgagtgagtggcctccatgccaagaccgccgccgtcgtctcctccttgccgccaccgccgtcgtccccagatccaccgacgctccgcccggccaccccagcgccgtctccgctcgccactgctccgcccggccccgtcgccgtcgaggccgccgctccgctcgaacgcctcagtgccggctccgctcgagcgtgagagaggggaaggagcaacgttgggctcgaggaaagggagagagagagagcggaaaggtggagaaaaaaaaaggaaaactatatttttgtgaaccccacttgaggtactgcattgtgaagcttgtgcctcttagtgttcctcagcatatgtggcagctcaggtccggcattttaggtgacgcattgctattgccctaaaagacgacgtgccattgctgctgtgtcgctggcctggcggaggaagccaacaagtcctgatgagtctggcaccaaattcaatgtacagtactagtagtacgtgccaggtgcaacttgctaataataaatcgcttaatcgagcatgcgcaacggcacggcgagacgagacggacgcgcagctgcagaggtcgtgcgccacatgcatgcacgttgcaaccgcgattattttgtggcgtgctattcgatgtagttttccgtgctactcctatatttgttggagaaatagggacgttacccgtgctacgagtcgttctggaagaactgttctcggtggatggagccatggaggccagctagctgcagacgcagctggctcttccgttcacctggagagcatgcaccaagaggcacccttcctatacttgctagtctacccaggtgagctgtgacgttacacgtaacagctccgaagtttgcaattttgagcgttgctgtgtttgagttccttccaatcgagcaaccacgttatatcgcctctagtcttacgatccataggaattaatgggaggcgtgaaagtggcctgtccttgtatactctgttgacttgctatatgtgcacttctccaatttgtgcgtcctcttgtttcagccagctagctccgctgctccgacgtcgttgggcaaccgaaaagaaagttgcagtcgaagaagagatctcgcagaagaacggcaggatctcatgccggactggaacgtaccgaggacgagggacagaacagatattggggactcctgtagcggaaactctaaatgcgcgatcgatcgcggctgcgatcggatagcgatcaccacccctcccccctccatccctacacgtttccttttttttttcaccgcattaattttttattttagtaaatttatgcacataaagtttatacacctaaagtttatagacccaaagtttataaattaaaagtttatatatccgattcaaatttaaatttgaattcaaatattttttatatatagtatttctatacatctaaagtttatacacctaaagtttatagacccaaagtttataaatcaaaagtttatatacccgattcaaatttgaatttgaattcaaatattttttatatatagtatttagatacatctaaagtttatacacctaaagtttatagacccaaagtttataagtcaaaagtttacatacccaattcaaatttgaatttgaattatatccaattcaaatttgaatttgaattcaaatatttttatatatagtatttctatacatctaaagtttatacacccaaagtttataagtcaaaagtttacatacccaattcaaatttgaatttgaattatatccaattcaaatttgaatttgaattcaaatattagtttatagacccaaagtttataagtcaaaaatttacataaccgtttcaattctaaatttaaatttaaatatttatgatgtagtaggaaaagaaaaagggaaggaggaagggggagaggagggagcgacgatataggggaggggcggagagcgatcacccgcccattaggcgtacccgtcctatagtcctgtagagaaagatggaaaagaccaaggccgaaacggcccggcataaaacacacaccggtataatctgatccaataaggaataagtccactcgccatctcttaactttgcgttgagtttgtttgacatctttgtctccaataacaaaaattttcacctctaaactatataaaatcgtgtaatttagggtctcgtagtagtataaatgtctgatttcactgacgtggcatcctagtcagcaaataaaaagtaaaaaaaatgtgggaaccacacataagtgaggagaaaaattgtgggacctgtgtgtcagcgccatcttctttctactattttcttcccaaccacacacagtgcttgggtgttggccgtgaggaaggcaaccgatcagtctgggatggagggaggcagtcggcgagcctaggaaggagagggagggggaggcggccggtgagcccgtccgagcttaagcttacttggcctttgtcagaggggaggctcaactcgttgttgccccctgtccccttggttccccgtcgacatgtaggaggaaaccatagatggagaacgtccctgaccaggacacggacaccgatggccacatcggagccactcgtccataggaggagacaacaatgtgggatgtcagcaacgaggggcttcgatgatcttctcccacggatcctcctctacaacagcttttaccattgatttggtcgccgtgtgtgggaacacccaatttaggcttggtgccccaaaaatccactcgtgatcgttcaggatttcgatcacgcatagattgatatacagaacagctttcgattatttacacaggtttgttcatacaagctaattatacaactgttaaagggtgaaaagatccaaactaaaatatccttatttgaaatacaagaaaatccaaagtactaaactcctaaacttcttcaactactagaactacaattaataaattccaaagaacttcaaagaactccacaggcaaaaactcgagtgtagactagcctagaaaaactcgttcttgtcgtagatctcgcttccttctgatctccttattagcacgtttcctctatatgtcaaattatgcaagggtgagtacatatgtactcagcaagacatattataaataattaaagatgaatagatatgaataaataaacaataataaagtaaaggagtaatgaaaaccataaatcatctttatcctcaacaatttaatttttaaaactacttatacttcaggagtaggaatcaccctaatggcacaactccagaaccgggagtacggcacattcgaatgatttaattcacctctgcagagactgtccagttttacccgcacgatgtcaacagtttgcaaggctgaggacaacatagccgttcgagagtcccacttactactagttactgcacagtggggtcttggttcatcatagtggtcgaactcttgctaggcctaggcaaggtatctatatcgtcacactttcatgaatcccactgttgtgaaacactgccgcccaaactccttacgtaagttcaccccaaaaccgctcatagagccacccaatagtctttcatataatgggacaatatactaggctaagtcaaattacttggttgtgtggatggacgcaactatatcatttcccatggtataagggggtaattataatccggttaaaccacccaaaaactttccaaactccccacaccagcatcacaaacttcatcaacattcataatcacaacattcataatctcaactcataaatgcccattttaaccggattcctaagtttgtaaagttatttggaatagtaaattacataaaatgataaccaatgcttctttctatgttctcatgcaatcatgcttaaaagcatttaacatctacccatgagatgttaaaagagtaaggtattatgcatcaaattaaatatgaagatcatataaagttttctatatgatcaaaattttaattatgtcttgccttgtgccttaatatttcccgtggcttcagcgtagccatctgggtccacgtcagctccttggatgccgatagaacttcttgtatggtctaacgtacgaatacgaaaagatagcaaataaagcctataagcaaattgctacaaagaaacgataaagtcaaggaataaataaaattggagcgaggcgaaaggaaaaagggaatgggttcaaaataaattttagattgaaaataaaagagaggtgatggtttctataggttggaaatcgaataaaattgaggaaaggataaaatggagaggtgaggtttatttggtggattggtttctagtcggtgctagggtagggtagcacgacggctagatatttggagttggttagccgatgctaaggcataacagctaattattggctcgtctagtcgatgctacagttaagcagcacaatggctagagagttgagaagtttgtgcaggtttgcagggtggaatagtgttaccctacagccgtgagtggcagcagagcggcttgaatcgcacagagcctgaaagctagtgtgcgacgtgctatggaggttgagggagtagtgaggctctgaccactatacacgtcgaggcgtggggtgcgaagagcaacacttcgaccttaagattaggtgatgccgggttttacgaccaacggttcgatgtcggggtttgagatcatgcgaacgtctccatggaaggcgtaaagttcccacggcggctatttggtagctaaggatggtacatagatggtttaaaaaataaattaatggaatttgaattcaaaaatagattaaaatttaaaatggtattttaaaataaagaaaagggcatttaatgaaattaaaggataatttaaagtttttaaataaaaaaagaaaattaaaatttaagggatgtaaaggtatttgaataaaataatttttaaaggttaattaaaatagtttaaaattagaaattaaataaataaataaataagaaaaggtatttaaataaagaaaattaaataaaaatttaaaaatagaaaatttggtatcaaaagagagggtttaaaattagatgaatttaggtcaaataatttttggaattgggtcaatggttggagagatatgggctcctaaagattaaaaatcaaataaaagaaaaaggaagttactgtgcagtgggccccgctgtcagtgtcttctcctttctcgttttcttcttccttcctgcttcctaggaggggtggtggctggtagagatgaagggtaagatggccggaacggcgaagataatgcgtggtccggtcaggagaaagagagcttcggtgtggctggattcaagaggaaaaggcaggggaaaacgggtaaaatggattcgccggagtgaggagaagctagtggtgcaagggaattggaagagaggctacgggggaggagatcggccagtgacttggtggtgaccattcatggtggagagagagagagggagatcgaagctcggatggggcaaaaacagaagggatggcctcgccttttataggccggagaggcggtggaggaaggatggccggcgacggcacggctcatcgtcgagaaaaaggcggcgacgcgtgtcggcgtttaatttgctgtaatggcggctcggtggtcggcaacggctcgcggcggcgcgtggcggaagcggattggtgcggcaaggtggcggcggcggattggcttggcggcggaggaggaaaggcacgggacggcgtcgacggcggcgcattgggaaggggcgagcggtggcggcgcccatcgagagagagaggaaggaggcggctcggcgggcttcggctcagttgggctggcagcccaagaaggagggaggaaaagaaaaggggaatgggccaaaagaaagggaaattggcccaaaataaaaaggaagtttgataattttgtatagaggatttggaatggaggaatttaaaggagatgaaaattaaaggatagatggatgtggactttttgaatcttggtcaaggaatttgaataggattcaaaggaattgaaaactaggaaaattttgaatggaaggctttaaatagattttaaaggagataaaatttaaaagagggatgtttgagggtcttttgaacttttataaaaggaatttgaatataaggtttttgaagcaaaagggggattgaaatatttttaaaataaaatcaaagatatttattttgagatataaaatttgataaggggtaaaaataaagatgctccaattttataaaattcaataagaaccaaatataaaacttgtcaaaaaataatcaaatgggaaggaaaagcaataacttaatttctaactttggatgaatttgggatggtggcaaaaatagatggaggtaaataactaggattttagcctccaaaatatgtggtatggattctcagtgaattatttgtggctaaaggaaatttatattgtctgaatgaaaaggattggaaataggtttcttcgcacaagagcaatcactctaaatattgtgataatattattcttgtgccgaggaggaaatcaagccataagaattaaattggtggcttgattaaaataggagagtttgggaatattaaaggggtttatgaaaggtattgtataaagaagaaaaatggggatttcaaaggggaaatatttgtgggagtgtagaactggattcagaagtatatgtggatgtgaatttctacaggaacgaaatttgtggtagattgatattcttctaaaggataggtatattgactcagggagattgaaaaggatattttatggactaagggaatatttaggtggagatccaaaggaaaagtattggttctgggaaaaaaataaaaattggtatttcatgtgtttggttagagatcaaaaggggagtatttggtgggagataaaactagatttgatggtagtgtggtaagctctaaatgaaaaggtattaactctaaagagattgatatttcatgtgctctagagatggttgagcgaaaattaaaagggttttgttcggtaaaggagtcaaaggaaatataatctagagccaaagttagagattaaataaaataaatagaaaggttttgtaaaattaaaaagggattttaaagaaagcttttaacttagcaaataaagtttagactcaagtcaaagaaaagatcaaaagtgaaattactgaaaggaagaatcgagaagagcatgacttaaaatatttcgcaaaaaattttccctaaaaatttaagtccattacatcgtggtacggcgagccggccgcccggtggggggggggggggaggagggaggaggggatgggatggtggtggggttggggatgtcaaggggcggtgtgttgcttatgacatgctcgtggtaggacgaaggagggacccaactcggtgacaatggagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatattttttttctttttgctgactaggatgaaacatcagcgaaaccagatattcgtattgctatggtattcaaattgcacggctttgtatagtttagggtaaagattgctggtatcagagataacgaatgtcaaacaaacttgagcaaagttgagggattgcaagtgaacttattccatccaataaagacttgtttgtggactttccaaactggcccaatttaaggcccaaaactatgaggttctcatatttcctgggcttcccagttctcaaatgctcaagaagtaacgatgccctgacaagtgacaaatgcccattgagcaggtaccgcgttgcgaattttttttatttctaattttttttattaaaagttttacaaaaataattttccattttgaaaattgacggaagtagtcgcctaccgccctctgggagggcgatttttaaaaatcgccatcccagatggcggcgaaaatgacgtggcagacggccgttcgctctcgggcgacggctgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaaacgaaagagagagaggagagggcagcagaaggggagcggcgaagccctgctggttcgctcacttcatcacaggtttgctcccatatatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgtggagaaaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtgaaaatggcttttgaacggtcatggcccctcgttatatttgtgtcggtacaagagaaagatataaatgtttcaatgcaaaccgaagatgtagagggtcctatcaatgcaagggatgttgttggaccatcgatgcaaaatgagaaaaatcaaccaagggaggagcaggccatgggcatggcggatgagggggagagagtcggtataattgttgatgaaatggagagggaagattcggataatgaggaagcgaacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggtaagtgagatgtacagcagtgttgttggtaacattggctttgaaccaaaatcaattattaggcacatcgagaataaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccaaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgttcgtcatgcgggtatgttgcgggctattgactacttgcagaacggttgggatgagaagggacttccagctaagtggcccgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacataatgacccaccaacaatgagaaggaggtcagggtcggccatcagaaattttactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtaacaaagtacatggaagataaaatcaaaaaggtacggcgacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcagaatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatactta

SEQ ID NO: 78331 - DNA, 544 bp, Oryza sativa
tgaagtgttctggtgaccagacatctgcgcgctgtatgactgggctagcaaacaccacttctggcagaccaacatcctgagtcccgaaagcctgcgtaagcagtgggacaagctgacaatgcagcgtaacgccggaggtgagcagcgcgctgtcaagccagatctggacttcaacaacactgactgggcctatggggtgatccgatgaaatctcttgcagagcagatgcgtaaccacgaccgcgagcagatgagccgcatggcccataacctgccagagcagtaccaggagtgcgcgccggtcgagcaggtggcgcaggtattcaacaagctgttcaacgagctgcgcgccgcgttcccggccagcatggcgaacttccgcacccaggaagacctgaacgaattccgccgtcagtggctgctggcgtttcaggagaacgggatccacaccatggctcaggtcgatgccggcatgcgcattgcccgccgccaggagcgcccattcctgccgtcgccgggccagttcgtcgcctggtgcaagcaga

SEQ ID NO: 78332 - DNA, 2750 bp, Oryza sativa
  unsure (1)..(2750): unsure at all n locations
tttaccttgaaaaccaaaaggggcctttgagcctccttagagaaaaaggaaaatgtggcaaagttaaaattgaaattttggtccctcaatgtgcccttttcaaaggccaaacctattttcccagggttttattttgagttactttgtgttagacgcctcaaattagtagaaaaggttggtattcctaacggctctaatatatttaatattcggaaggtagttccaattataaaaagattttttttgaaacatcatgagtgaagtgatgcctggtagctaagaaaaattgattttaagacaanctanatttccttggtttattgaaaaatacagcagaaggatagtaatgatttttgtcaagttaaagcaagaggcttgtaaaaggtcaagacttccacaaaacagttgacacattacgctgccataataaattaagtttttagcanccgaattgaccagnaaccttttttcctcctaagaaactgattgcgacgaacattcaattaggcatcagtattagattacaatgacaaaagcaggcagctgcgtagatttgttgtcatcattttagtagaagagacctaaaggacagcaacttggaagtaactgacagggccaccactagtatagtaccagtcaattttttttatttttttatttttttgcctttccatctacatcttgctttgtatacaagcaaacctgtcgcttgcgagcattaatgtcttttaaccccttcgttaagtttttggggctgttatttcttccctgctgcaaatggtaaccaaagatggtgacaaccggtggtctgagtcggagccagcaagaacggattacctaccctccttcccatcgtgttgtccctctcaaccagaagaattggaccttcatgtcgtggctggagatctgtgttgcaacctttcgatctactaacaggaaatactccagcaagaagggcaaagtagggatcttagaactcccatcgtcttcccctagctgccatagccagcactttgtatcttttttgctatccgtgatacggcttgcccaagctgaacttgttggttcctattaccaggggtgcagctggaacaaaaagggaaggggtatcattcgcttgctttactctattttagatcaagtttaagctaatatgagtacctgagtttgaagagtgatgctccgatgcaatatacttgaagtattctactccgagcagaattaatctggatcgtatattttaaaggacaggtaagtaatctcctaatatccttacgagagtggtggccgtgacgttctgcgtgacgctggtggcgcgccacggcgcgacggccatggcggcgttcctgatctgcgcccaggtctggctcgccacgtcgctcctcgccggccaggtgagctagctagctacctacctacatagcttagcctacattccgatgatatatgcatggctgcttaattaactttgcttaaattgatcaatcaacctcaggccttgcttgccagcgcgtttgcaaagaaggatcactacaaggtggcggtgaccaccgcccgcgtgctgcaacttgccatcgtcctcggcgtcgggctgacggccttcctcgccaccggcatgtggttcggcgccggcgttttcaccagcgatgccgccgtcatcagcaccatccacaaaggcgttccggtacgatggtcatcataagcaagaacagattaatcttcagatattagtaaacatttttctcatgaacatatctgacgattgtctccaaatcaatcagttcgtcgttggctcgcagacgataagcacgctggccttcgtcttcgacggcaaatggaggggaatggcatcgattaggataggatagggagagggtgaacagttagataatgacagtttacgataatacccctacgtgaattattatcgctggacaaatatagccctccacatttcttctccaataaaatcgggtgggagtagaactagatctcaaccctacgattaaatacgatcaatggcacggattaatttctactccaagtagaaagcaccggagcgagtctcgagtttgaattgagggggtaccggtggacatattgtgaacatagatgaattgtagctaaaaaatttttcttaactggttcctgggcaccctcccccctcctacctagctttgcccctgcctattacatgtggtcaatgatgtcattgtaacaagatagctttcgtggttggatccaatgacaacatcaagctgagaggcttttacttcctgaatgcattgcctcggagaacctattccatgagatgtaggaagaaaacatgttgagtttgagatgaatatgtgaatgtagtcgatgagcaggacttgtagttttcataaatgttagaatagaattatattcggactcatatcataagcactccgataaataaagaggcaacacctaacgtaagtgcatagggactatagcataggcgaaggaatgacttcctggcagcctaactggtgaaatgtcctagttggggatgagcattgtaatcaatgctgtaaaatcaaagtgtgtctggtccttattctgagatgaacaattggcatttgatattattggttttgatatttgaagattattagcgaagtggttttggagatgattgatttgtaggtgatgaacaggaactgctgctgactgtttggcccggtcagatcggagctatgcgtgcagtcagaccggccagcccacgg

SEQ ID NO: 78333 - DNA, 582 bp, Oryza sativa
gagtcaagtttgagataacttggtctcggaatatggtttctttgtttatttcatgtgtaggtgacttgatacctcgggagaatatttgcggtgatggaccggaagtcggcttggggataagacgacgtccatggtggtcaaagatcatgcgggatacttaggctagagttgatgcacgtggttgatggagattctatatggtatacgatggaggtattgtgtacgtatgggatgcggagtcgaatttggaaggagtccaaatttggtacgattggttatataaagtttctttcttgtactaaaaggtttcctaaagtgtttaagactcttaatatgagtttggttcgtggctttaagcttgctacctcatgtataaaataaagggggagcgtgaagcttagcggtatcgctttcgagagcaattgagttgaagtttgagttagggtttcgagtttagtcgagatttttataaggagtgcttgtggggcacttttgtaacacatagagaagtaataaagtcgtcatctactttaagagttcttcgatttgtgtttcattcggtttcgggcgtctaaccgatga

SEQ ID NO: 78334 - DNA, 1199 bp, Oryza sativa
  unsure (1)..(1199): unsure at all n locations
cagctgtttactgtcatattaccatgtttcttagttctatgcctatttccatatatcgttctcatattatatacagcattccattgtataacggttcatttttcattttattagtggctgccaaactgatggacaaccttcttgtggtgagcaacccatatagtctgataagctcaatctgcctcacacttcttccatggccacagaaacagctagccaggtaggataccaacattttcgtgtttaccaacattttgttcagctttcactgatatagctaatatatttgttgtcacttcctgtagatgaaagaaactgtatctgctgatgctaaaaagaaaaggtatgcttctatatactgcagagctagctaagtcatgtgtgttctttacctttcacgcacatttcctttcctattatcattgctgaatatcctttttcccttttcttcagcgctgcttcggctcctgcaaccacccgcacccctaaaatccaggcacagaagcgaacctaaactctgaaatggtactgggtatgcacctagcacccataagttcttaactcattggatgacatattattgacaaggaaactttacactaatggcatgttctatttagcactttaaatatgcaaatgaaaaaactatcagagagtgatgatgacatgtatttacaaactgtttgcatttaatttcagaagcaaactaagtataaggatgctccacccactgcaattgatcttttcaaggagtgccattgcaaaagcaagatgggtttaatgagcccgttaaagaatgtattggattacttttttttttatactttggaaattatttaatgagatgaaatggtttgggattcttaactcctgtgctaggttggaagaagtatcatgtaatcctgccaaaagggaaaattatgggcttttgaattggccagagaaaaattttttttatatagaaaaggggactttgtttctcaccaccaaactaaatgtttaaattatttgaaaggttggtttggagtacaaatgaaaaatattgttttggtgtcccgcgggcctaaagggggatcgggggagggggctaaaggcttccccttttttattataaaaaatatttgagggccaaaaggggcacatgggctttggttttnaggattcatattccgggaaaaaattggggaggaaggcctttt

SEQ ID NO: 78335 - DNA, 1308 bp, Oryza sativa
  unsure (1)..(1308): unsure at all n locations
gggagagtggggccgcccccctaaacggtgtgggggaaaaaaccccccctgtttttttttttctttttttttatataacaaaaaaaatttttctttttttgaggggggttttttaaccctttttttacggaaggggtttttaataatcccgcgggaaaaaaagcccggggaaaaaaaaagggtgccaaaaatttaaaattttaaaaaagcccctccaaaaagatgaatttttttagctcaaaaaccgccatgagattcatgaatagcttcgggtcataagggtattgagcttttagaatggtaaggcgggccataatcaaatttttaaggggcggaagnaggatatgtacaacgcggcttttttaaggtgcccggnatattgtggggtttgtttgagtngggttgtcaagacttttgaattgaagacgtcaggggcaactatccaagggccaaagattttgattattcatggattggctaggtatnatcttagtgatctaaaatggagaatgntggtgtcaaatcggattgtatgnnatgacacagacccaatttgagaattagcttttagagnatgcgccggtatggtttaaagatgaacccacttaatatgtgcttttggtgtgtcgncgngnaagttcttaggattcatggtgcatgagagaggagttgagatcatcctaaagaagatagaaanaattcgtgatttcaaagcgccgacatgcaagaaggaagttcaaaagttgctaggtaaggtgaattatttgagatgatttatttctaacctagcaggtaaaatcgatgcttttgttcctatacttctcttgaaaaaagaagccgattttacttgggagccaaaacaacaagaggcgtttgaggagttgaagaggtatttgtctactttacccgttgtgcgagcgcctaaagccggaaaaccttttcggttatatattgcctccgaagacaaagtcattggtgccgttttgacgcaagaggaagatggcaaggaatatatcattacatatttgagccgccgtcttttagatgtcgaaacaaggtatgtctttattgagagactttgtttatgcttatactatgcttgtaccaaattgaggcattatttgttatctagtacatgcatagttgcttgtcaagccgatgttattaaacacatgttgcaaaggccaattctaagtgggagaattggcaagcgggcatatgctttgatagaatattatttggcttatgaaccattaaaatctatgaaaggccaaattgtatgtgattttatagtggaccatcatgtag

SEQ ID NO: 78336 - DNA, 4246 bp, Oryza sativa
  unsure (1)..(4246): unsure at all n locations
agattattatctgctcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccaggagtccaggttgcccttcgttctgatcatcggcaactatttcgacttcattggcgttgacgagagacatgcgtgcacatcagaggtcaggacacactgcactgtcatctgatgtttgcttgcatgcgcacaagttctggccgggtttcagtgaggaaggcgaaaggatatccatttagtgatggctgctacctgatcaattaatcatggccacgatgcttcatctcggattaagctttgctacaggatccgggatgatgaagatttcttattagattttctgataaaaggaaaagataacatatatattgatctatgcttttccgaataaaaactggcaactaaataatatgactatagatttcaggtgttgcgatgttgttcctctaaccgaaagttcactctttcctgcatgcacggaagatttatacaccgtcatcgcttcaaggaattcaagtaggttacttacatattgtatgtgacctatttgaagtattcttgatttctaattttcgtagaataattaatgatcatgttataataagtgttaggtaatcaggtccctgaatatataattatgtttatcaataagtgtgtttacgtagttaggtttatacagagcaaaactcccatagttcacaaacgaatttgatctattctataataattttagaactgagaactcacgttaatctctattttttcaatagcaactaataattagttttccatgtatgtcttatcatgtttcaaaaactgtatgaagccttattgttgacgttcatgcagttaaatatcgtgactaattccaatttttacaattattatatatcatgaaaactgtactcatgacctattaataacgaatttcaaaaatattaaatcagaaaaaagttataattcagtctgtcaaattggaaatattaattataccacgacgaatctacaaatgagactccaacatttttttttcttaacggaacatcacaatagttacttatcaattccaaatcaataaattaaattaaaaatactaaattgagattccaacatgagaagaaaatgagtagtgaatgattccgatttttataattatcaaaatagtggaaaggctattagtaatatcccgaatgtgtacatcttgatcaacatctattagttataaatctcagaattattaaatcttaaaaaaggctatactgagactcagaccagataaaactcaatattttaaatacaaaatttacaaatattaaattaagaaataatataatttggaattaacagctgagtttcctaaataagtataaaatgctacttgggatggatcttatgtttatactttttaattttggttttttgaacagtcaatacaaaatatattgttttttctttatagctataaaaatctacaaataattttcaaaacaatatatttaaaattttaatatttaataattctaccaatgatagccgtgcatcgcacgggttggcgactagtgttcctaatgcttataatgatgttgctagggagtatcctcctgatactaggcaaggccaatataaccatattgcgtcgcaaacacaacctattaggccaccaaatacaccaccaaatcaacataggcctgataatatggaggaaataattagtgggattattatggataaattcaggattgaaactaggaatcgtgctaaggtttaccaaaagtcgtatcctgactattatgataatgtgctgtttgcttgtaattatagagttcccgaatttaccaagtttagtggtgaagattgtagaaccacatgtgagcatgtaggtcaatttttagcacaatgtggtgaggctaatagtgatacttttaaattgcgcttgttttctttatctttgtccggtaccgcttttacatggtttacttctttaccggcaaatttctattcatacttgggctcaattagaacaaagatttcatgattatttctatactggagaaactgagcttaggttatgtgaagaaaaaaatataatgagcctgtcattgattatattaagagatttagggatgttataaaccgatgttatagcttgaatataactgatagagatttggctagtctttaattgctcctcttagagaaagactagatggccaacaatttcttgatgttagtcaacttttgcaaagggctctggctcaggaaagctgggttaaggataataaaaaaattgttagaccatatgagaaaaggcctaatgttaatatgattgattaccttgaggcgagtgatagtgaagataagggtgatcatgatatgtatgttgctgaatggtcatggactaacaaaaacaagccttttgtttgttctaacctaatgccgactcctcgcaaagatcggcaaagtgaggttaaatatagttttgatgtggccaagtgtgataagatctttgattatcttttacaagaaaaacaaattagattatctaaaggccatatcataccatctcaagaagaattgaaacgtcgagcttattgtaaatggcatgattctcattctcattccactaatgattgcaatgtgttttgacgacaggttcaatcggccatagatgaaggacgattgaagttcaccgatggctccaagatgaagcttgatcatgatccttttccggtgaatataattaatttcaatgacaagaaggtgttgattcggccggagcaagccgaatctactaaggaaaaaggaataatcattggtgaatcaaggccaaagatgatagtgccaaagaagccggaggttggtgttttgaaagagaataaaagcgaagcttcgacttctaaagctcctaggaagaccaaagtgacccttgatatgcttttggagaaatatgaaaagcaaggtggtgagagagcttgcaacaatgggaaaagaccaagatcacctcctagggagcgatttggtcactcgccaagatggttgcattcacctccatatcatcattcacaagacataccatggggtccctatccaatgccgccgctgggttatccttatccttattacatgccatggggggcaacgccgccaatgttcaatcatatgcctccaatacaattcaaccaaaggtggggaggaccaaggaggccaattcatgaacatttgtcttcaccaaacaacggctggttttatggtaagagccgggccagtgaggaaaggagagaaggaaagcgcattaaagtggaggcaaggacttcagaggtaattaccatcaaagtagggtctcatgatgtaccaataccttctggagatgaagttagagagtcctcgagaaaaaaatccgaagccggtaccagctcatcgtagtcggctggtctgaccgggccttctagccggtctgaccgcagccatacggccggtctgaccgggccatcaggccggtctgactgccgacccgacaatggttcgaccgacgcctcaagccggtctgaccgnccaccgaatgtggtctggaccgngcatnttggccgtcttgaccgtggttaactncggtttgacggcttccaccccgtttgttagaagtttgaaaatgcatatnaggcttcattcattcattaaacccaatggggtttattactcccttgaaaaatccaactatgttaccgccaaaattagaccaanntcaaacttgggggttaaactttccggaccgccggtcccaaaagaaaaggtattaattcaa

SEQ ID NO: 78337 - DNA, 5199 bp, Oryza sativa
acgttatgacaacgcctagaactgcccaggtgagactgagtggtttcgtgaactcctgatggatttgccggtggttggaaaaccagtgccagctatcctaatgaattgtgataatcaaacagtgattattaaggtgaacagttcgaaggacaacatgaagtcatctaggtatgtaaagagaagactgaaatctgtcagaaagcagaaaaactccggagtgatagcattggactatgtccagacagctaaaaatctggcaaatcagtttaccaaggggctaccacgtaatgtgatagaaagtgcatcgagggaaatggacttgagacccacttagagttgcacaatagtggaaacctgtcaattgtgatcggagatcccgtgaatttggatggcgaaacaaactattgtgtaaccgaaagaagagacccttaaatgggctcatttttatgatgtacttctcttctattctgtatggtaggatggcttatgcctcaatgtattccgggtggctttcattaagcagagatgttgacctgcagaacatcttagaaggaacacacttatatgagttcgactgctagtcacagtctatgagatttgggtgatctctagatactcatgaaaggcctggagtatgacttataagctccaacctgagagaatactaacggaataaatatttgaatattattgtttcccaaattgggcttaattgagttcaaaatatttcttagtgatggtgttgcacaaaaatattacatttgtttagaatagttgtcgtcatgaaaaaaaaactttggtcctaggagtttaagttcttgtgatggaattttgttactcctcacatgcaacatcgccaaaaaagtgaatatttgtgataaaaaattttaacactaactatcatttatggctataaagacatcaccattattttaacaatggagtatttcaatcagccaaaggttcaaaggtgacatccaagtagttgtgtgaaacttttgtctatccagccattacttccttaagcttcatcagatacaaggtcgcagataacttcgtgtgctttactgtacatctggcttgcagaggtgtctcaaaatcgttcatcagctgagtaaacttctcatggtccctctcgttgtaagttaggtcctcaacatcacgcaacattactggaatagtctcattattgacatcctcccgatcaccagccaacgaggattgaacaaacatatcatgtttgtgttcttccttgttcagaccaccgccagctttatccccaatattctctagctattgctctctatgcttagtccaacatgagtaaccatccatgaagcctcggtagatcagatgcatgcgtgttttggcactattctaaagcatcttctcattcttacgatcaaagtatggacaagtcatccattcattgtttgttctgctcttgtcttgctctacaacatttatgaaatcagcaacgccccttcaatactctatgctagatcggtcacttttatacatccatcttctatccatctgcaatgtatgaaatgaaattaatgatatgtatatgtagctagtaattattacatcgaagttatattggtaatttattattaacttggaatacttttttttcaagtgaagagcaaaaattcgcccctctagccctccctcccaaactatgaatagtctgctatataggaatactattctttcgaaagtttgggagtatttatactatgggttatccgtaacgggccgcaaacaagccccaacaaagattaaggataatccgtgataggcttcacagtcatctttatccggccttaacactaggctcgtcacggatgaccctcataggtaacgggggccgtcactaatgaccttaacgggcaaatcacaccccatatgaatgttggttatccgtgaggggcctatcctgaggactaaaattctacctctcttgggccatctttgatgaggctttttgcagcttgataaagatgactatctttgtaacgggtcgctcatttccatcacagatagcctgattgtgattcccggttctgtactagtgtggatatatgctatgtccgtattcattttttagaaattcgttttttagacgggttgcaagaacaagtttgagaggagtacaagaagaccatgcagtggtcctgacagctgattcatctttttcatcccaggattgatgatttacacacatataatacatatatatgatatcaattttagagaaaggatacggtcggggcacagcagcatcgctactaaccattattaattttaatttaaagctatatatattctgctagctagcccacacgaggcgtctcggcgacggtgtcgacgaagattcggacacggttgaagcgaaaatcctctggcaccgccgtgccgaatggcagcacgacgatgtcggcgtcgggcttgtccttgagaatcaccttcttggcctcctctatgctcagcccaaccacctccggccacgacgtcttcgccgacgagctcatcttccctcgtctctgcctgcatgtggatcgataagttaaatgccttaaaggtagttaaataacttctagctatatatatatatacacacatgagaacaaaatatacttcctctattctttaatgaacggtgttgcattggttaattagtttatttaaaaggaaaatagaggcagtataaactaaggaaaactaaggaattaaaaggtactccactcacggtctgatcgagttggtgatgaaagaagctgatggcgacaaaatgacttgtagagttcatcgagagcaccgatacaaggcacgtatttataatagagttccagaggcaggtttggatcaggattatagcttgccaaggtggatctgactgtgtacgtgcctgcatgcatatgccacacgacgttgctggtcaagctgtttgatcaaagcgtcgagtaattaagacacaacaggatcacgtggcgatcgagcggattaatgttgaccaagagaaaacgaaacctccaaaaagaaaaagatagaaacgtgtttgatgatggcgtggcacgctcgtggccccagcggccggccactacgtacaaaacattcaactaccgtgtcacctacttttgccaagtttgaaatggcaccaccgcaccaccatcgatcagtcaacagctctgtccagtgtccacacgaacaacaaaccagtttggtttctcacacaacaattccgctccttttgttaagaaactacgggtgatctcatccacccaaggaaataggaacaacggttcctatactaaccggtagagaagaggagatcgctcctctctctccctttagcgtccctctcgacaaccgacgcgatgttcctaaatatcgcgtcccctgcagttgacaccgcttcacattgtataaatgtactgttgatcaatgagaaatctatcgattcgctctgtttgtgttcaattctctctctcgctcaatcaattctatccacattcaacacgttatcagcactttcgctctcgcgaaggagatcgcgaagtgaaagaaggaagaaacatcgcttttgatctaacagaaaagcgaacaggagattcaacagagaaggtacgatgcctacctttcattggattatggatgccgttctcggcctccctcgcaatcagcgcgcccgtcgccttcaccatcttctccgtcgatcggagaggagtcgccgccaccaccacggtcgccactaacaccatgaacgtcgggctagggctggtggccgtcgccaccaccctcgccgacgcatcgtggtggccactactccggctgctcctcctccgccttcgtctccggttgccgccgtgcctcgccgtatctgtgtgcagggggtgcagtactgcgcctaccacggatggacggcagtggtgacactgcccggcgagccatgtgacctttccctggagatggagtcgctgccgccaccactgaccgccccttcaccacctccaccgacaccaagccgacgccgacgccgttcccccactcccgcgctactggggtccggcagaaccggtaccctggctgcgcgcacgggggagccgcccttcttcaatccgtcctcgtctcgtcgtcatgcaggtgaagccgccgtttgccgtcccggcctccgccacaccttcatcgccattccccatggctctcctagccgtacactccctaacggggtgccggggaatggcgtccgggctcggccggcctccgattccgatgaggatcgggagccgtcggcctaatccggccggcaaaccgccggcggacggaggggcggccgtggcggcagtggatggtggatggcgacaacggtgggtagcggattgtggatgcaagcggtggtggacggcggcggatatggaggcagcggcggcggcgcatcatgcatcggcgccgtaacggggagatgggggcggcagatggtgcggcggcggcagaggaagggcggcgcccccctcggtggcgtcgttggcgccccacggcggcggaggaagggcagcgccccctcggcgtcccctcggcggcgtcggtggcgcccaacggcggcatcggtagcagcgaaatggcggcggtgtgcggcgaaaagggtggcggtttgagcggcgaaaacggcggcagcagcgaaatcgtgggggcggttagggttaaccctaaccccccgacggcttcccctgcctttttgctgagggccggatgggccggcccaccgccccccttgcctgccagcctagtgccacacggtggtaggccgaatcctttagatttcggcccaccacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataagtgtttatttaaataccctggttcactaaatttatttggtggcttaataacatgccttttgcatattatttcaagacacgctctactttctcgctttattaatttacaaaattctataaattctgtattttgatttagcaaattctcttaattatgtacaacataattaatggaggatttaatacatgttccacttcacac

SEQ ID NO: 78338 - DNA, 596 bp, Oryza sativa
tcgggttccggattgaccaccctatggtgctacgggtaccgggcttccggtgttggtgaaaaagtcgcattccttaaaccccccgtcgacatgatcttcaaatacgcgcttttgcgctaagttgtccgggggaagatatagggcctgcccggaaatgtcaagtggacgcccctctgcgggggtcgcttaatccggggtgtttggtaagttaggttcaaggcggaacgtgcaattttccggaaactctggagaacggcgcgtatcgtgcgtatccggggaacataggcaatatactgggtgtttcccgagattcatctgatatatggcgcatctcttggggatacgggtgtatcactcgggctttcgggggtcttaagcagtaatctcgcgacaccgcgccggaagtgcgcggagcattctctggagatgactctgccactcttgcgagcgatgctcgctactcttttcttggaaatatattctggtcaaagctggagaaaaaatcacgtgggtcgataactcgcgataatatctttcgcgctatccgtgagtgatctctctgggcgcaacgagcgcgggattaacacgcgccccgt

SEQ ID NO: 78339 - DNA, 1156 bp, Oryza sativa
  unsure (1)..(1156): unsure at all n locations
cagtcttgatgacaacgcgtggacagccccccttggggtttagagaagaatgaagacaaaaaaggaagaagatgtggatggaaaacgtgacggtagtattttgtttctaatcttggaaaagatcaggggcagggttgcgaatcgactaattataataatatttatctaattgtgcacccttgcaattgcacggatctaatttacctttttattaaaaagtaaaaactaggaaacggtacgaattaccccccgaactatcgcggtcgtccaaattacccccattaaccacaaaaccggacatttcttcacccccaactatgcaaaccgaacgaattacccccatcgacacaatccacggtggttttggtctatgtggaatacacgtggcatcccagtcaacgtttttttaataaaaaaaatggtcggacccgactatgatactctcaaactctctcgtttcccaagttttctaacagattctctatctgtagctgagaaattgtcgaccaggtttgagagacaccatagggagcagcccgccggtgatttggacccccatgagcagcccgttgcccgccggggccacatcccaagcacaaatttgccttctctacggaaccaccggttattttctccagtcttaacgccccatcattgtcccccaagcaaacgtgtattacgtttccggcgccttggctccacccaatggattttttgctaaaaccgtaagttccctttccctagtctctgccaaaaggtccttctacatgggtgttctttccagtagcgaccgcttaccttcatcgattaaatcataaatccacgctccttcctctgtccatccgtaatactgccctcccatccttatcatctactggtcccttacctctgtgtaaagtccactttattgctcttattcattcatctcaatcgtcgcctatagcgctacggcgcgggggtcctctcctcttcgccgaccccggctcactatcccatggccttttacagaaaatgacaccgggtccgtcttaaaatcacaactctggaatctcctctctttggnaactgcctcccccttattaccgcagcccctcttctccattcccacacacactctttctcttgctcgcaaacaccggtttcgactccgcgctct

SEQ ID NO: 78340 - DNA, 1011 bp, Oryza sativa
  unsure (1)..(1011): unsure at all n locations
ctgggcccgaggcagaccttaggctatattcttaaggcatatttggggtatgcttgggacccaagccaggtcccaagctacttttatgcttagagttttgagtcatatacgcaatattcccccttaggtagggagaatcccatatatgaaatcttaggtgggcccaggacactccagagtgggcccctagctacgtcaccctagggttactttttaatttttaaagacattctcagcatgctatttattttataatgatgcttttgccggataaatgggtacctcggttcctatttcaccgacacatagtataagatgttttggcttcttcatttctaatctagattcattaattttctatgaatttaaactatatatatatatatatatatatatatatatatatatatatatatatatatatatatatatatatatatatatatatatatatatatatatatatatggatatatatacattttaaatgactctggaaactttctcacattcctcagctttactcacttaatacctatcctgaccgggttcaggcccggtcgtaggtagattgtgactgtttgttgttaaacttcgatacctagcaattaactatgtatgcaattaacgtaatgcgggcaagaaaatcaacgccctgcgtcgatcccgtgtggacttgcacgctgttctagtcccctccatctttacccttgcgattatatccctcctcactgtgggcattttttcatataactctttgtaactctccaaaaaaacgcccctatcggcccgcgtcaagagagcccagtgtctcactcccaagaatctttctccttcgttcggaaatagtaactcccgattcgttgcctcctaaaaaattgcgtgtaaatttcctcaccagcgcgtctccatagggcngatacacgcgcgctcaacaaggcacgcccacaagttcctttctcctgcgtcttttaaagaacgcggggcgggggcgctctctcttnctcccca

SEQ ID NO: 78341 - DNA, 14527 bp, Oryza sativa
acacagcccaggaagattttgggctccaccacccatgaaaaaaaaaagataaattgtgcccgcaatctcacatcacgggaaactagaggatggtatatgaaaacactccctcgagaggacttcggttttcttccgagacgtctacggatcgggcatccgattttttcacgggcgcgcacccagtctccatcggcgtatgcatactagtaatcaatagttaggttgcttaatgtttttaagcagactttaaacaaatcttttcttaaattacttgtccaattcacgattcgattgcaccactaaattcgttgcaattaaacctttaaaacaagaccacacatgattataatttaatgaaaaaattatttagctttattaatgaattatttttaaatgtttcatgtagtattcatataatgtttcactatttatttcactatttaatttgcaaatgttacacatggtgttccttgaatgttttagcaagtattttataatgtttcaataattatattttagtgtttatatgtgatataaaaatatttcaacaatatcaagtttttataaatatattgtatctctgatatgattttttttgggagaatagctactttagtccctaaagtttctctgtaggatcagtttagtccctaaccttttaaatggtccaaagaaatccttaaactttgtcataaggcctagaatagtccttgggtccaccaaaaacatcatatggatatgtcatgtcatcattcgtgcaaaatctacgatgaattgtccaaattacccttacttatatcataaaaaaaataaatataaggatgaattagacataaccataggaaaaaaatacttctccttttttttcacccttttgaggtatatttttgctcttacatttttccttttgttttttattttcttatgatatatgtaagggtaaattggacaaatcatataaattttgcatctttttttttcacccttttgaggtatatttttgctcttacatttttccttttgttttttattttcttatgaaggtgacatggcatgtccatgtggcgattttggtgggaccaaggactatatcagcccacatgacaaatttaaaggacttgtttggacaaaatgaaagattaaggactaaaatgacccatgagtgaaactttaaggaccatattagctattctcccatttttttcactcattgggactcagttttacatgtcctattgtgtactgtccccatccatcctaaatcgtggcttaaccactgtccacggcgccgcctccgtctattggggggactaataggcgatcgatcaccaagcgatcgcccaagcgatcggatcggcccccctcccctatactccatacactcctccctcctcttcccccttcctcctccctttcttctcttcctactacagtacaccacacaattttttttaaaagaaacaaaaagttagaaaaatttatgtatataaatactatatataaaaaaatttgaattcaaattcaaatttgaatcgggtatgtaaacttttgacttataaactttaggtgtataaactttagaggtatagaaatactatatatagaaaatatttgaattcaaattcaaatttgaatcggatataattcaaattcaatttaaattgggtatgtaaaattttgacttataaactttaggtctataaactttaggtgtataaactttagatgtataaaaatactatatatagaaaatatttgaattcaaattcaaatttgaatcagatataattcaaatttaaatttgaattgggtatgtaaacttttgacttataaactttgggtctataaactttaggtgtataaactttagatgtataaaaatactatgtattaaaaaattgaattcaaattcaaatttgaatcggatatataaacttttgacttataaacttttggtctctaaatttagatgtgtaaactttgggtctctaaactttagatgtgtaaacttaaggtatatgaactttaggtgcataaatttattaaatagaaaagtaatgcggtgccaaaaaatgaaatcaggtggagggagggagggggagggggattgatcgctacccccgtccccaggcgatcgatcaccgatttggatttccggcgatcctgttcatttctttgaaagcgatcggaactgagacggacacggatagggggagccacacggacgagccaaaaaacgaaattttgtttattttgactcaatccgactcatcctcccttattactccgactcggctccggcgcgttactcctgtataagagaggaggcaaatcaactcgacagtgcggaacaaaccaattaggccataccacacgatggagatcaataacaatttcggcggcgcagtaggattcgctgccgtcgggccttggcaagaagccatggttggttcaagcgcagggaactgagacgttgtccttcgtcgacatattggacagaagcttgcacgtgagagttgttcctgatctgcaaggcaagctgtgcttgggatgtgtccacggcggcgactggctgctcatggtggacgagatcaccggcggctgcttccttttctgtctctcaaactcgtccacgatctcgctgccaccgttgcgggagccgttaggagacatgggagcatgcgtagtgttggggtcatcgccgttgaaccgtgactgcaccgtggtgattaccagtctacctgaaccggaagagagcttcctgctccattgccaccccggcgacgaggagtggaccaagctgatggtaccactcggctctgacaggttgttcggcaaactcgtcaactgcgcaggacagttatactctctctcttcctttaggaaattgctcaccatagatgtgatcgatgatgctctccatgctaagatattgaatattgagtgggagagttcatgcggtcacaattttgaaccgtacatcgtcgagtcgtgcggcaaactgttcgttgtcctagcatcgttatacgggtatccctacaactgcccgcttaatggggtttccgtgtatcgtctagatcgagccgagtcaatgcttaagaaggtggacgacattggcaccgatcgtgccttcctcatctcaggtcactatggcttctcgtgcaccgccatggaagggctggtgcaaggcaactgcgtctacatcgtgtggtcaggctacgactgcgagaggatttacaagttctgcttggatgatatgacgatcagcttacagccgatccttgctcaccccactgaagatttgcgaaggggattttggtcggttcctgcagggtgagttacactaaatacctttcatacccatgctatgctttgattaccttcgttatgaacaatgtgtatatgttggcttatggtctctaaacaagttatatgttttaattacaggatcgaagctacggaattagtacaatcagccccatcaattcattgtgatacagaggttcgtatactttatctccaatatttttatatggtgatgtctactataagtgatataaccaatataggccttctatcttttctcatcctaataaaccatataggtttatacttaccaccataattcctaatagtagaacataaagtgtataattgcttctactagtattagaactcataaatcaatggtttaaatcgcatccaccatatttatttatttatccttatttcgagaagaatcctggagtagactaaatacacctcttgagaaaatttaagtactatatatagtacttatacttgcttacaaaattgtaagctaactatgggccgcatctcctcacaggttaatgtattgaacaatttcaacaaggatgaggatgcacaagctaccatcaaggcatcatggcaagaccttccaatagagatgctagagttaatagtttcaaatctatcattggtcgatcgactacgatttccatcagtttgcaagcagtggagctcggtttccaacccagttgcacaagcaaaggtttggccatggctcatgcactgtgttaggcaagatggtgcttgcaagatgtttgatcctctatgtggcgtcgagtattctatgaaggttggtccatttgatgccaacgagcgacaggccttccgcttctccaaagacgggtgggtgatcgtcacccagagtgacgacaacatcttcgtcataaacccattcacaaaagagattgtgaagctctctatggccagcggctggtacagattcactggcatctcattctcgtcggtgcctacttcaccagattgtgtattcctgggtgtgtgtagctctcccaaaggcgatgggatcaaagtgtggacatgtcggcccaatgaggaagagaccgaggataatgagatatactacgaggaagagactgaggatgaggagagagactccgaggagaatgagataaactacgaggaagaggctgatcaggatgaggagagagaggctgaggagaatgagataaactacaatgaagaggctgaggatgaggagagtgagaccgaggaggattattggagtgagtttgattttgagaacgacgaagtcatgttcccagtggcacgcaataatccagtctatttccgaggggagttctacttccttgggcagaggggcaacctttcagtcttcaacccaggcaacaacgagtggagaatactcgataaaccggagcccatccgcgctgatctaactccctacgatgagggcaaggaagcttgctacatggttgagctaagaggagaactgatagccgtgttccatcgtaacgccaatgagcccccacgagtgctcaaactcgatgagtccaagatggaatgggttgaaattgaggacattggtggaggagctttgtttttggattacagggcatctattgccttgccatcatctgaagctggacatggtaataggatttatttcccaaagtttagtgaagatggaaagaaagcaattttctatgatctggaggccaagaagtatagcccgatgttctccggagctaaggaaccaatgaactgtgtttggtttgtgcctaagtaacagtctgatgaatactcctagccaagtacttgtgcgttacaatgcacactaaagtactcctagccaagtactgtatatgttacgcaacctcctaaacctatgatatagacaacactaagggtgtgtttggttgagctgtggcttttggaaaagctgctgtgagctgtgggccgtggaaaatctgctgtgggaaaagcagaagcccgtttggttagagcagctgtcaaactataggttgtagaaaaaatatcagtaatgcccctaaaggcctgtgggactgtttatatgcaaattactcgtaaaaacttaatttgttcaatatttcatatttaaaaggctaatttggagaatggcctaaccaaaacttgtcacttgtttggtttgaggatccatttatctgtgtgttcagaagtacatgttcattagtacgatgaagaaggaagttatcccaccaaaaccatgggaagacctcatgatggaccaactcatcctaagatggttttattcctcaaattaaagagaacatttactagaattgagctaaagaatatctcaattatcttaaaatgttgctcagttactttctgttcaagaacagaagttaggttgagggctaacattccccgattcctttcataattttctctggatcttgaagcttgtttccccataggttgagggctatcatattctaatggcatacaaagaaaataaaaggagaacttcagaacttacacaaaattcaaagaagcatgaaggtatggtaaaaatatacatctctaagtcatataatgtttttcggagagctagaccagcactaaacattccaaatttttttttattgaaacgatctttagcactggaaggtttcttttcctgaagaataattcaaaccataactattggatcggatcatctacaaagatattgcacagcaggatatattttttatcagatcaggcagataaacaactttttggtttatgctcctcaagttccagccatgcagcaaagtcacttcccttctcctggattctaatccttcctttctcaactatctccaaggcattctcaaaactccctccattcccattgtcctgttcatctgtttcttcaagctcagttctcctgtccagatccacacacatcaatgctgccattctttcagccagtcctggtacttccctcaactacatatcatcaaaatacaagcataagaccactcatgggagtaaaaggctctgtaaatgaacacacgcaaaatttgtatttgttggtcagtagacaaagctatcagatgatagcatgaaaccaatacagcaggccctaattatgcagtgttgaccatttattaaccaacataagaaagctaagaatacaagagtacaagacattaacagcaaaaaaaactagaacactcttaagttagctcaaactgtagctgtcgctcacttaactaatcaatacagtataatacattgacaatcagcagtctaagcaggccggagccagaagggcgacgggagacgcggcgccggacgggcggcggccggccggcttgagcacgggcggcgtcgcgccgccgtcggagcagggatgcgtcgggcgccgccgttggaggtgaggtcggcgtcgcagggcggcgccggacgggcggcggcggcgcaaaaacctaacccgcgtcgggccgcccctgttcgtcgccccagcagcgcgttgggtctattcgcgagaagggaaggggaaagaagcgaatcgttttttttcactactaataatctcatgatttgttgacgcatgacgatacagacttctactaacacgggctgattaattatgattagatagatctagctataaaaagataaacataataacatcaattttgcttaataattataaaacattcgattgtggcctatttttctaactgcatgatatatgatgactatctcctatgagtatgtacataactatattagtattttccctatttcttcaatattgttttctatttcttacatatattttaatttggactaatttttttctcataattaaatagataagaaattatttgtccatatttctcctgtagcatgagtatagtgcattatataatttaaaaattatattataagtgtatgtaatttcatgcgtaaaatatggaattataggataagatttgactttttctaaaattgccgcaccatagtagatagttagataagtaaataaccataaaaataatatagtcaaattgtttctttatttcattcgaaacaagacatttcttatgtaagcatctcaggagaacttcgagagaaggtaagaaaaaggagaggttagtcattagctcacgcacatgaggggaaaagttgctcatatccatgatatgatatactcccattaatcgataatatactaatattatttaaaaaaatacgccgtaatgtggtgtgaaactaaaacttaaccctatattcttctgttgttcaagatcttcttgttgttttctcggtcttctttattttcgataataatatggccacatctaccactattacttgcacatgaatactagcggctagctcatgtcttctgttgttcaatcttcttgttgttttcccgttcttctttattttcgataataatatggccacagctaccactattacttgcacataaatactagcggctagctcatgtgtgtgctccgtaatacatattatgtatgttttgacttgtataaataataataattttctttgttaatgatattatatttatggtaaggcactttattgttttttaagaactggaaagatatttttgctaaacataatctagaatgctataaagattaataatattgaataatacatagtcatataaatatatataatttttatggataaattagagaacgacactttttatgaatccaatgatcacaatgcactatatatattgttgaagtcagttgttactttgactatttgatagttatatggcaatgcattacaataggattttttgagacaaaaatacggattagtttttttagtcctttttttcatgacgagttgggttttttacatttctttagagaggtttttagggtatagtttttctaagggggacgaatcgattttttaagggaaaaaggagaattaaagtgcagttgaattgtttcagtgttttttaaagttttaatggaaaggaggcattttttaaagaaacatttagtgatcgtgcttttaaaataattaatataaatacatataccttatattatcgagatcatgcttttaaaataattaaaataaatacatagactgtatattatcttatagagattagatttaacgataataatgtgaatttaatttattagttacttatatatatatatatatatatatatatatatatatatatatatatatatatatgtgtgtgtgtgtgtgtgtgtcacatatccctatcttttatctccaaaatcgattccttagtcctaacgtaagccattcttaaccacggcaccgctgctagttgccgccgtggacgcagtccaagcaagaagctcaacggtaatgacgataagcaatatcttcctgtaccgtcagaattctccattgtatattatggtttgattggtttattccacggtagtgtaatatgtacttgactatatatatatgtgcatgctaatttaatgtcatgaatactgttgtaaaaataacttgtctccctcgccggaattctccattgtgtattatggtttgatcggtttattccacgggagtgtaatataggaataggcgtacttatatatatatatatatatatatatatatatatatatatatatatatatatagctacatgctaatttgatgtcacgaatactgttgtaaaaataactcgtctccctcgcgttttggaatcgtatttgaagttgaattgcgtggtttaagctaatattaattttgttttacagttgaagttctatcaactaaagatttatacacaaagtaaaacatttgaaatttttcaaaacaatgaccaatattattctgtactgagttgttcgtgtgttgcaacggaataacctaaaattaaacataagatgattatagtttatatttatgatatgagattttaagaaaaacatatattcttcatttgttcattaactcatctaaaatgtctttttatttcttttcttctgctccaacattagcttacattttgtagaaaaaagctttctcacatatatataacatatatttcctatttgttttcactcgcttatattccgacgttttaatctcttcgtagtgacctcaccacattggtccactcgaaaaaaaaacctcaccatatcgaatgagattgtaggagggaggaaatgcaaacacgttaaggggggagtgttgtgatagatgactaagtgagatgtcgtgtggaaaaagagagtgggtggttgtttgtttgtaaacggagttggcgcgagaataaaggagattattatgataaggaaagtgtattaggatacacaaatagtatatggccagtaatttgtgttatattttggaaaagttataattagattatatatgtgtttcatatatatatatatatatatatatatatatatatatatatatatatatatatatatatatatatatatatatatatatatatatataggacactcatatggggcaccatggtgcccgggcaccatggtatctaatgcacaaaatcacttaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatagtttaaattcatagaaaattaatgaatctagattagaaatgaagaagccaaaacatcttatactatgtgtcggtgaaataggaaccgaggtacccatttatccggcaaaagcatcattataaaataaatagcatgctgagaatgtctttaaaaattaaaaagtaaccctagggtgacgtagctaggggcccactctggagtgtcctgggcccacctaagatttcatatatgggattctccctacctaagggggaatattgcgtatatgactcaaaactctaagcataaaagtagcttgggacctggcttgggtcccaagcataccccaaatatgccttaagaatatagcctaaggtctgcctcgggcccagtcctgtcctgggccccgggctcatcttagtccttgtatattctatggtcctcggcaggaggagcgtagaaccctgtaagatctatatcttaagagaacgagctacagtttgcttcgggcccagtctggtcctacgccccgggctcaccatagcccgcacaagtcccgcactactcgagatagaggagtgtcgagacatacaaaacataaaggtgtaaattgaggttttcctcgggcccggccttgctctaggccatgggctcaccttggtcctggtatgcctcacgtccgtctgctcagaggggcgtcgaaacatacaagacacataatcatggaatattccttcatcaacgacacctttaaacgcaggagggcgcgacctcagaactcgctgggaagttgcgcgtgctccatagctagctgtgaggccgcatgcccagccataaatgaaacaggtttatgggggagatcctcggctagtctggagttgaaaggacgtggacaagacaccatcactaagtcacttaggacggtggagcctgggacacgcgtcgcacatgccccgtgccacttgatttagccaaacaggcagagaagctaccgtggcactatttcgagcagataaggcctcgtcaagcccaccacacaccatgtggtgagcacactggcagaaacccaactgtctcggacggagcccgagagcccggggtaatatgaattgcaagactcgaagggtttcttaaaggctgtgttagagaaccagttggcaacgataagacggctgatgagacaagactaagagtagatttggactataaaaggaaggggaccgatacggatgattagatgaaggcttggactctctcgctttgtagcctaaaaaggcattcattgtacttagctgatctagagaagacaacgaacaccaacacatgagtagggtattacaccttcgggtggcctgaacctgtataaactcctgcctgcctctcttcgttgggtggtcaagttccgcgaacccatcacgattgcatatacgtcgctcctctcaccgtcaaaccccctggtccgatcttcactctcggggagggatctctactccctgctattcgagggaccgccccgtcgacactatggaacgaacggagtacctactatttaaatgttagtttcatgttaaatatacttagtgaataggtgatattttttttctattattaattttatgtttgaaaacgactcaacgatcctatgcatgcttgattaataccttgtatagggcaaacttgaaatggactcatgtatgcattatctattggactcctacatggacagtactaggggtgaaaacggtacgaaaacagatggaaaccacctttatcgttttcgttttcatatttttttggggaatcagaatcggagaccctggatacgaaaacggaatcgaatattatcaaaaccgaaaacggagcgaaaacgaaccgacgcgaatacggtaacgaaaatttatcgaaatataaaaacccctcaaactgataaatccaattctcaagtctcaacggtcaacaattcatcataaaacacaatcatataagtccaattgttaagtctcaatagtacaacacaaaatacaatttacggaataaattatctatgtttaagagagtaatgctattgataaattccaatgcaggaaaaaaaaattcttatgcaacttcaggtgtgcataacaaatatttttttaaaaataacagccaaacaccatggtattcactattctgtgcttgaaaaaagaatccagggtatttcagtcaccaaatttccggaaattccgagaaaatttccggaaagtttccaaccgatccaagttccgatggaactgccattatcattttcgattctgtttccgagaaaatatttccgaattcgtttccgtttccgaaaaattccgaccgacagattctgttttcgaaaataggtccggaatccagaaagtttctgtaccgttttcacccctagacagtactatacgtttcaggttacaatgcgcaccgcgcgatgggatcatattggccggaactctcacgtgggctgacgtggacatacatagacggtacacactttgagaaagtttaatagtataattaactattgactattagttaatataaaagctaatgtgtataataagttaactataaggttggttgatggtttctctcctctctcttcttctcatcacaaatttaatgtacatgttttgaagcaagtgtatgggggttcctgtttcgcgcgtatgcgctaggagcgaaggcgggcgcgcactttcaccgctaatagcgcttagtgtcgttttcttcgggtttcttttttttggataaaaattcgccatgcgtaagtttcttccctttgttttgctgactgaaacaacctttcaactcagatttattcaggattggaaacttttcaactaagatttgaaaactttcaagcctagatttgaactcggatttaaaatttttcaagtcaagatttgaataatttcaacttcaatttaaaaattttcaactcagattttggaactttcaaatcttgatttgaaaattttcaagtcagatttgaaaacttttaactcgaatataaaaactttcaactaaagatttgaaaactttcaacttagatttaaaaactttcatctcagattcaaaaacattcaactcaaacttaaaaactttcacctcaaatcataaaaactttcaactatttaagtcaagattccaaaactttgaactaaagatttgaaaactttcaactcagatttaaaaaatttcaacttaaaccttgaaaacttttaaatcaaattcaaaactttcagcaaaaattaaagatgaaagattcaatttctaaaataaaaaaatcagcaaaaaaacgtttcacggtctccccgcggcggaaaaagagaagcaagaaaaacaaaaaaagggaagagatagactgcacgagggtgagggctgcgtaggccagaaacgcgcgcgacttgtgctaattagcaatttcgcaagtgtatagcctaactcttgcacgagagtcaacactcctcatttttctctctttctttcacataagtttatagttggtttataactcactattatccttactcttatgtagacgtgggcatatatgtgaacacgtggagatacgaatcggacacaagctagcacgtgggaaataagaaacaagaaaaatactaaataaaaagatgtaccagctttttttaaataaaaatacaaatattacatattcaactggtgaatcaatgaaagaaaaataacaaatagttaaaagtgtctcggtgaaaaagatgcacaacacaaacgttagatgaaaaactcatgggttgataaaattatccaatttatcataaataatgtaagtatcttatcctgtttatttataccaacatgaataagtgaaagcaaggaatacaacagaaaaaaattattaactatttggctgagcaggaccggccaggaaagagcccaagaggcctaggagccatcccagttttgggcgatgggcagatggcccagccggtcaaaaaagatcagaactcacgactcacgagtgaggtttcctctatgaattttttttatttataattttttttattaaaagttttacaaaaataattttccattttgaaaattgacggaattagtcgcctaccgccctctgggagggcgattttttaaaattgccctcccaagagggcggcgaaaaatgacgtgggaagacggccgttcgttctcgggcgacggccgttaacgaaaattgcaggcggcccccctttgcgccctcccggagggcgaatttggtactggtgcggggggccgccttgt

SEQ ID NO: 78342 - DNA, 2342 bp, Oryza sativa
ggggtgagggtccattgaagcgggataggagtgaataaagatgtgtagatatcaaagttttggtgaggtgggagcagagagaggggggggggctcgcgagagatcgtaagcgaggaggaggggtggttaagatagtttgtaggatgatatagacggttgcgaaaagcgagatgacagcgagggagaaggggagttaagagagagcggtggagattaagaaggtagtattgtaaggggatgggagagtaggatgggagggagggggaagtgaaaaataaagggatggagagtggggtgtagaagaggaaagagagaagtgcggggcgaggaatggcgggaggataaaatagtagttaatgatgaggggaaagggagatagaagtcggagtgtaaaagtgtaaggtagtgtgttggacataagaaaggagcaaagaggaggtgggaagaaggggtaggttgttgtgattaaaggaaggggaagagaaggaggatgatagaataaggttaagaggggagagaaaagggacgggtcgtggatgggtggtaggaggagtgtgtaatgtgtagattagtatagtagaaagcgggagagggtgaggaagggagaggtttttatgtgggatgggaatagtgtgggagtgaggggggaggtagaatgaaataaagagcggcgttgcagggagaagggggggggtagagagatgtggaagaatactcctttcggccatggaggagggcaatttttgccccccccccctataaagcccagtccctcctctgtgaaatttcattatattcactaaaaatccaaaaaaaacgaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagatatttagaggacaatattgtagagaatgtaacttagggcgtagtacagaaatgcgaggttaacgcagttaatgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcgaaccgaagatgtggagggtcctagcaatacaggggatgttgttggaccatcgatggaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtttatgaagtgaggtgcattaaggaagattgtccgtggcgtgttcatgcatttagggtaaaagggaatgatttttggaaagttagcattggtgaccgagcacaagtgctacttacaagggtgggagaagtattaacggaacattactttcaatttttgtggcagttgaaaatttcagcaatggtgttggttaacattggcttttaaccaaaattaattttttcgccccatgggaaccaaattcaagttcacctttagctttgcaaaagcctggtgaagcccaacaaaagaatttttgggaatgagttttggcccattttaaaggttttttaagaaaaattggccccgtttgtttaccccccattgtcccaagggaaaaaattaa

SEQ ID NO: 78343 - DNA, 1881 bp, Oryza sativa
  unsure (1)..(1881): unsure at all n locations
atgtggttttggaancccgtctggaccaactcggactttgctcgttctggtcgcagccgattcggaatttagccgatccttgctctatttccggaatgattttcatcttgaattccaccccgtttctatcttcatctccgatactcagattatcaaatttggttattaaacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattccttaaaatagcttagcttagctagcttgctcgtgcagccgagcggcgccggcaatttctcaccggaccatcgcttggcctcgaagcatctttgtacccaagtgataagctagacgcgctggagtgctggaccgtgtgggcgccctgccgtgccgtgatcgcgttgccgatcgcgagcggcaatctttgacccccgcgaccgcgtacctgtcgtcccccggcgtacgcgcagtatccactatccagcagcacgagcgcgcgcaacacacaagtcacaatcgtttgctggatggagcagcggtccaacgactggccgctggtttgttggtcccgtcagttgcgattcgtttggacgccgtcagcaatgattgccttgctagcagctgcttgattgccaggtaatagcggagacagcaatactctactagtagagtagcactactagttaatgacgtaatgaccaagtactcgtgcacgcacgacgtgtatgcatgtaccgacgtacgctacattccgtgcagtttctttacaccgagtaacttatttactgcacacgccaacatacatcagggctgacatttccaagcgtctctccgctatatgaacgcggatgcacacacaagggaacgcctcttgctctccacaaactttccatcaccacctttcgggcgttaaccaaacgcatcgttcgttcgtctctctctcgctcggcccgcgttcggttgcttgtcacgactcgaaagcctcaacgacaaagaggaggacaaagtaagcgcggctaagcttcgtgcaggcgcgcacgccaagtcgtcttcgccggtggtcaacgtctccaccgatcgatcgagatggcgtcgccggagaggcgatcgtccacgacgacgacgtcgtcgctcctcggcagctttcggacggcggtcaagaaaggtccggttcctgctctccttcagcgcgacgcgggggatcctttccttcatcgtcggctcgcgcgccgggccgcggcgcccggttagcttcggcccgccggcgcggccggctagcctgctcgactacgagggcagcgccattgtgtcgccgccggccaggtcgggggcgccgtcaagaacgcaaccctggggcccgtccccggcgaagaccgttgagccgnacgagcaagggcggcgttcttgaagctgctgaagaacgttaagcgccccggtttttttnttctcggccccccgttggngggggcgaaacacaaattttacggggaaaccaacttgttattggcaacttttaaaaacacatacatataggagcggagggttgttggaacttcggacctgtgcaggaagccatccatggatggattttccgccgtggaggatcgtttttaaaaaattcttgtttttaaagacaaaaaaaaaaaaaggtttgtggtttaagggtgtttcg

SEQ ID NO: 78344 - DNA, 4178 bp, Oryza sativa
  unsure (1)..(4178): unsure at all n locations
tggtgtttttttttccccacacacacatagcacaaatttatttcgggccccaaccggttgcaagcgcacagaatatttttnatagtgtttattaatcataaaaatggaagatgtttttggccctgccctttgctaattcancaagggatgaagccgtgttttaaggtctgttcccttttaaagaaacaagtatccgtttttgagtagcaaaatcctaaataactccactaaggggggattcacttgaaaaggtattatagaatttgggtaataagtgattcgaataaggcccatgaataaccggaaccagtgggctgtgattatttatccgctgttatttatgcactgacacatatgtacaaatatattggcccctaccggttgcaacacacaaacatcttttcaagtctttaatattctaaaaattaaagatgtttttggcttgtactttggctaagtcatcagtgtatgagtcggtttttaagtctgttcccttttagaaatacagatatgtatctgagtcatttttggaaatacaaaagaagtcatataagaaatctttttaaaaaatttgtatgctaacttgaaatgatcgaactcctaattgtagctcatgattttctaaaaaatacatatccaagcgaattccaatagtgcatttcaccttaactaaaccatataaccttaactaaaccatataccaataataagattaaaataaccatcactcgttgcaacacacgggctttttttctagtctctacttacttgaaaaattcaaaatgtttccttcgtccaacaaaaataaaaaagcaaaaaaaaaagtccgattgctcttataaagcgaagaaaaaaaaatagcgtataaccgattctccttaaaaacgaaaaaaagcccgagaaaaaatagcggaaaaaataactaaaaaaagtcggtttcccaaagtggcgaaaaaacaataaaaatctggttttcgtcgtcagtaaaaaaagcaaaaaaaaaaagaacatgctaggaagaaaagtcagaaagaaatgtgccatttctgaaaaatggtttgggaaaaccacacaagaaaaaaacacagtttataaaaagcatgccgctctgaaaaaactattagaaaaaataccgtttataaaaaaccgggttgaaaaaacaatcggatttaacatgagaaaaaatcgttgtttctaaaaacggtttgagaaatactgtctgacttaacaagagaaaaaaaccatcatttctaaacaaaggttagagaaaactgtccgactcaacgcgagaaaaaaaaactgccgtttataataagaaccgctccgaaaaaccgtccgaatcaacgcgagataaaattgatggacgcttgggttggataggatccatcaattttttttccatttcctatacgacttttgtttcctcatctattctattctcatgtattggagaccctgcacgtctctgtatgcaattactagactatttgtttttgttaagtatagctactattcttgataacatttgatatggaaataatattaaaatataaacatattttaaattgttatttagataagagtgcacaatgactctattttgtgtagacttgaccatgcgaggcagtgtaggatttgattgatcctattattggttgcaagaatgagattaaaagagtattttagattatatgcatgttgtcatatgaataatccaattattttaggtaaattaagctttggtaaggttgccatcgtcgaggttggaccattacattgaagatgttccaagtttctgattatcttagctataaatgatccatacaaacattgtcattgaaatagttatgcatagaaaacgtatattatgattatatttttttttcaccgattgcaatgcacggacattttcgctagttattataaaagttcaaggtgtttttgtctcaaatcttcgtacgccgtccgaatttttttcgtcgtcgcgtcggcttagttcccgcatgtcactcagagatgcacacacgctattccacacatgtgatagaggaaagaattttttttatttataattttttttattaaaagttttacaaaaataattttccattttgaaaattgacggaattagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttctactgtggggggggccgcctgcaaatgggcggcgagggggcatggaattttgcaggcggcccccttgccgccctgggggagggcgattttgtactgtgctctatatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgccgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctacatatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgatatattcgtgcaaaagctgaaacaaaaatgaactaatatctgggctgaactgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccatggcgctgcgacaggagaagacgcgcatgaccgcacgcatcttctcctgcatccgggcgaaggtcaccctctgctcaacgtcagtcaagtgcaaacctctgttcaacctcacctggactgcggtgatatcggcactgatatcccgtgtggcatcagcctatgcaagatggaaataaaaaattcagtagttgtcctatattatgcaagataaatgaaataattgttggaagtaatacaaattggacgtaccgccacgaag

SEQ ID NO: 78345 - DNA, 22254 bp, Oryza sativa
  unsure (1)..(22254): unsure at all n locations
atgtgtgtgtgcacccgcgttcatataacggagagtcgcttgtaaatgtcagccctgatgtatgttggcgtgtgcagtaaataagttactcggtgtaaagaaactgcacggaatgtaccgtacgtcggtacatgcatacacgtcgtgcgtgcacgagtacttggtcattacgtcataaaacagtaatgctactttactagtagaggattggtggctccgctattacctggcaatcaaacagctgctagcaaggcaatcattgctgacggcgtccaaacgaatcgcaactgacgggaccaacaaaccagcggccagtcgttggaccgctgctccatccagcaaacgattgtgacttgtgtgttgcgcgcgctcgtgctgctggatagtggatactgcgcgtacgccgggggacgacaggtacgcggtcgcgggggtcaaagattgccgctcgcgatcggcaacgcgatcacggcacggcagggcgcccacacggtccagcactccagcgcgtctagcttatcacttgggtacaaagatgcttcgaggccaagcgatggtccggtgagaaattgccggcgccgctcggctgcacgagcaagctagctaagctaagctattttaaacgtttcacttttactcagtcgtcagctactgcagtgctaccattttattaaaccttaacaccagtaccttttttttaaaaaaaagataaaccttgcctagaattctaaagttttgaattaaagaatgtcgcatgatctatatgatattgttccattttcgttaaccactactctattataagtcgttttgatattcttttgattaatcttttttagtttaactaaatttatagaaaaatatagcattgtttttaacacaaaacaaacgtattattaaaatatatttaatgttgcatttaacaaaaactaatttggtgttgtgatgttgtcattttttctataaaattagtgaaatataaaaacgtttgactagaaaaatagtcaaagtgacttataatatgaaatggaagaagtaactcgcaatgaaaaaataataaacaataaaaaagttatttataggtaaaacttttaatatatgtgctggtttaaaagttaatattgaaaaataaaactatgattaaataactctaattattttaaaattaagttttttaaattacatttgggcagcagatcaaaatgataagctaatgagcaagtgatgagtgtgtatggtaataaatactccctccgtaagtcgtttaggacaatgtataagtcaaactttgggaatataaatcatgaataactctcaagttagttgttgagtttgaaaatgtaacttacaattctacatactgttgcttgtccatgagcacaacgtgtcttatgttaatcgggaaaaagacgtgtcttatgtatgttgccgtggaaccagtaaaaatcagcttgttctcctcggatcttaatcaaagaatgggtttacaattcataagttagcatcaattatctgctaaccttaataattaattctgaattatggaatattataacgaagtgtgtgagaattagtgtcgaacacgtcaacttaatcatgtactagagtagaattgtagatcaatcaaggtgcgtgcagctctgaattagttaggtcagactgacagattgacatatatatatagactcccgttttttcctccttgagaagttgagataatcggatatgcacagtaaccagttggccacgtgatagtaaaattgctcttttttggctccagagttgactgatgtttgttctttcgccacactctctttttcttttctttttttttttgcggggaaccggagaactttatcgatcaactaaaagtaggattacaatggcaagccaacagctcagaaacacactccggagcttgctcacgccaaaccatagactgtttcgttctcctagctagctgagcgagaccatgcgccaccgcatttgcctctctgcagattacctcaacgcggaaagaaggaacaatggggatagcagaccgaacctccctcaacacgagccagagacgggatctgtcgttttcattcagtgctatagaataagcaacatttgcgcagtccgtttcaagaatcaatggctgtgtttagttggatcgaaagtttaaattttggttgaaattggaaataatgtgactgaaaagttgtgtatgtgacaggttaatgtgatgaaaaaggagtgaagtttggatttaaacacagccattggttgtttcacggattgcggcggcccgccccgcgtcccgcactgtccgcatagaagtttgaggcatcttcccacaagtatacccgctgggcacctcgtgggtttccgccagaacccgcagtcagcccacatatccacgcgtgcgcagttaaggccgaaaaggcttaagggtgagtttaagaaaaaggagattgggaagatgcgcaaaacgaggtgagtcattagtgtatgattaattaagtattaactattttaaattttaaaaatggattaatatgattttttaaaacaacttttctatagaatttttttgcaaaatacacaccgtttagtagtttgggaagcgtgcgcgcggagacgagttgttttctcaccctatctcacaccaacgaagtgtgaatgcattgatgcaagctctgccgctggaagcaggtgctgcagctagcactgatgaactgctaaatatcacagcgtttgttgacatgcgtgttagcggagcagtcacacaatcaacgaaatcggccgacactgtgccacacacaggacgacaccactatcaacgaaatcggctgtatcgaattgcaacttgtttctctatatgatgtccttgaatgcaagagctcgaccgtcactccgtttccgctagcactggaactctggaaggttgccgtcttcctagtgctgtcaagtgttcgatgtagttcttgatcgcctcagtgagattccatccacggtatatactatttcacgttgcccattcattccatttttgtgcttggtatcgctgatgaaggttatgcaaacttagccggtctaccggtatcatcttcttgctttccggggtgacatgctccaggtagggattttatgtttccttcggcttggtgctcgtctagctgaacaatccgcgtcacatcgtgtcccatgatctacagaccaaaatccctcaatccccaagttgaatcgagcaaaaatacatacgtggatgatgatgtttcttctaagtagctacctgctatggctggccgccatggccatgggttgatgcagctgtcgtttcaaaaatgtttctagcaatgaatgttgcaaaagccaatgaggacggtttgcgcggtagctgcgatgaagcaggaaggacgatggcgctctcggcgagggcaagcgttccgcctagcgtcgcggggcgggtgacggcgccgctgggcaaagcgggtcgcccgcatcaaccaacctctttgaaagcgggttagcatatgtgggtcagtgggctagtggggcgggccaacccagcgggttagcggcacagcccgccccacttatacccttagtactttcacccattctgccaccagccggattccatctatacacgcaagagcttctgcctgactgcctcttctgcggactggcagttcctgattatattccaagaagaatccaagaagaaaggatcacaaaagcccgttcctgacgataatgcccgttcctgcttcccctgtcgcaggcaaaagcaccatcaatattcacttttgcaacactctgaatgacaatcggccgtaaaagccacgtgtcatacacatgtatctccactgtttggaaaagatcactttacatccctcatctaatggttcagtttcaattacgtctcttaacggcaaaaccagtgtaaatataattctaagaatatattgagactgattttaactaacgtgacggtgagacttcttcttctaccctccttccctcttctcttcttcctcatgtttcttccctaatcaccatctctctcaaccagttatctcatggtggcgcccggcggaagaggcccttgccgctcatcttgccggcggaataggacccacatgttagtgagtacaataataaaaataaatatcggccccatgtgtcagctaccctttctcctccctctttaccctttctctctcaggtggatagcgccgacaggccgtggatggacaccgcggcagcgggacaaagcacgatggtcacgccacccctcccccccccccggtctccccgacagccgtcgccgcagctgacatagatgggtttgcctgtgtggcctccgcctcgtcccttaagatcccctcctcccccttcttggatgacgccccgccgtcctcccaactactctacgtgctcgagtcaggatgtcataggagatagacgagggtgtcggccgtcaccatgccgacgagctcctcctcacgtgcggtgcagccggctggctgccaagctcctccctcgtgatgatggaaggtgagagaagaggaagagataaaagagagagtggggagaggtgagggagagagaatatggcatgaggtggaggccattgataaagtgggtcccatttgatgactcagcaagtcagctgccacgtcggacgaaactgcttggggatttgcaatggttttgggagttaggggacaggttatacccggttctacggttgagggatgcgattcaaaaggggcatgaattgagggaggtaaaatagacatataaaaaacaagtgagaagattcgagctcattgtttcatgcgcaggcctaaactcgacccatagtaaaccaagtgagacccaaacacatttaactctaggccacattgctgccagcattgcagcccaaaccaaaatgtgtgtggatcaatgaacctgtcagttcaaaaataaagagaagcaacgagcatgcttctccttccgacaggatctccgtaattgattcatataatgaccctaaattttaaaaccagatatccaatccataaaatttataatactgtttatattgcctctaaagtggttttggaccttagttgtacgaattttaaagtttaatcgggcgattttgaaaatactaacatagtatacttacatatcataatcattggcccttacatatcataaagtttagtactctgtagtgatgttatatgctagtattctttatataagtgtgagataaggggataaaacggacatttaagtgaagatttaacatgtactatgttcaatgtgcatatcacatagtaaaactcatccaacatatatgcaaccaacattgtatgcaaaatatatagacattttgtaaaatcaccataaaggattacagaaacgatattataaagtttaggtgttatatgtccggttttaaaattcaaggtgtttgttgaacttttatctaaagtttagggttatatcatggactttttccatcgaacaacgaaaatgtgtgtcaaggcaatattactgtgcgcgtggaactatagcacggtcaatctcaaaactacctctgattggacggctgagattcaagcaatatccctcgtgttcccactcccttcctcctgtcctgcctgccgaattcggaaaagaaaaattaaccacactatagggtatatgacagtgctcagttccctttaaacttctaaaaattccaccacatcaaatatttaaagttttggacacatacataaagcattaaatgtggacgaaaaaaaaccaactacacagtttacatgtaaattgcgagacgaatattttgagtccatgatttgacaatgtgatgctatagtaaacatttgctaatgataaattaattaggcttaataaattcgtctcgcagttcagaggcggaatctgtaatttgttttgttattagtttacgtttaatatttcaaatatgtgtttgtatacttaaaaaaaattggtaaacgaaataaacccggccatagaaaggaaaaaccaaagtgggttggtagccatgtgaaagtctgagcgacgccacaccccagttcggacggacacgatttgccaataccacccccccaaatatccgacggctacgaccagcttcccaccagcaccgtaccaaccaactaccacagcaacgcccgcgagcaagtccaaactgcagaaagttgtcgtcaaactcgtcacccacatcgaccggagccggccgcctcaacgcactcacaagtcacaaaccggcacgcacaccacaccaacccgagaccggctagaccgcgctactggacgcatagccccaaggaggccacaggaccgtggatgcttcgacttcccacgcacgcacgcacgcacggttggtgaggaccaggctgaccgagggcggtgtcgcgcgtcggcgcgtgtgtgtggtccggtgtggggggattggtggtgccgtggtggtagtagctcggctccagatgctcggtcaaacggccaccaaccataactccattttggactggtcccgtttaatggaagtatggaaccgggcaaacgacgcagagcaggggcgtttcgcttcgcacatgatactactacactatgcacgcatggaacgcgtggttggcatttggcaatgcgtacagcgtagtgaggagtgacccggtgagcactcagccactgtgcactgaaccgttcaggtggtttttttttttttgcttgtaagaacacgttcgtgtggatttagttagcaaagggtgtgttgagttccacgccaaaattagaagtttgaagaaattgtgatgatgtgacggaaaagttgaaagtttttgtgtttagaaaagttcggtgtgatagaaaagttgaaagtttgaagaaaaaagttggaatctaaacagggccaaagtgtactgcacagatggtttcttgactgtagtagttttttgtttttttgggtatatttagttcacaccaaaattgaaagtttggttgaaattagaacgatgtgacagaaaagttagaaatttatgtgtgtaggaaagttttgatgtgatggaaaagttgaaagtttgaaggaaaagttttgaactaaactcagcctttgttgagcttatcaagccccatcgtctcatcggttggtgaagagctctgattacaagccaaaacgatttattagcgcacaagaaataatttgtaggtaattgtattatatatgtcgttagcgatttaaaaacaaattaaattattttaaaaattaaaatttttgcaataaataattctttttatggcaaatgatgaggttctatatgagaatatctgatttacgtggaaccatactattttcatgaaaatccacacataggtccaatgatttttcttccaaaaataagtctttaggcgatgcttcacttggcctagttttttagtgatgtgatcaggttttgtattatactacctccatcccatattgcttgtcgctttaagttttattttaatgtttaatcattcgtcttattcaaaatattttgaaattattatttattttgtttgtgacttgttttatgatcaaaagtattacttatcatgttttatatttgcactagtttttaaaataaaacgaatggtcaaacgttgcaagaaaaagtcaaagcgacatctattatagaacggagttagtaacctctttccatctggactcaagcttgctaatggataaagtgcatgacataaatgggtactcaagcttgctaacggagtgcttctttgtttctaaatatgtattgtgtggatgtgctaaatctaaagaagattttattgagaaaaaacaatagttaccagcctattgaatgacacacaatgtggtacagggacgcgtagagtggatgagcattggagtggagtagatgtggacctgtttagcaggactactccatctaaaaaagaacagagaggattaaaatgatgtaaaacaaataaattaaagaggtgaagcggtgttgggttacttcataatttcacttcagacttcgctcttagagttatttataggagtgaaaatcctaccatgttgaatccaaattgattttacatcttccttttaagaattaagtttagataaatattttacttgtgttattagcaatcataaaaacagacccaacagccaagcactgaaacctacgaaggtaatccctaaacttaaccataaaattgaataccaaaatctaaaatcagatccttttttttctttggcgagtacaagtagattctgattcacaagctgagcaaaagatgcgttcacgctcaggtgcacgttttgtacagtgtgaaatgtattgttcatgttgcccaattgctggattagtttagagtaaataaaattcttaatttaacttagccactgtcctagcacagcagcgaccactctctttggacatggaccggcgatctggggtgtgttgggaatcctgttcctaatactaagtgctcgcacggaaaacgtagtagcgattagcgagtaattaattaagtatttactatttttttaaaaaaaatagattaatttaatttttaaataactttcgtatacaaactttttataaaaatacaccatttaattaattgaaaagtgtgtgtgtaaaataaggaagatgggttgggaagaaggaccggtgatctggtcttcgtcctcctcaagaagtcaaaaacacaaccattccgagctcccccaccaaacaccatttgcctccactataaatccgagctctccagctgcttccactcctcaggaatcggtagttgtcatcacgcgcacttccattccgctcacctacccaccggagaagaggtagtcgccgccgccgccgctgtcgccgtcgccggagaagaagaatgggttcgttgccggagcagttcgtcttccgctcgaggctccccgacatcgccatcccggaccaccttccgctgcacgactacgtgttcgagcgcctcgccgaccgccgcgaccgggcatgccttatcgatggcgccacgggggagacgctctcgttcggcgacgtcgacgcgctgtcgcgccgcgtggcggctgggttgagctcgattggtgtttgccatggtagtaccgtgatgctgctgctgccgaactccgtcgagttcgcggtggcgttcctcgcgtcgtcacggctcggggcggtcaccaccacggccaacccgctgcacaccccgccggagatcgccaagcaggtggcggcgtccggcgcgacggtggtggtcaccgagccggcgttcgtcgccaaggtgagcggcctcgcgggcgtgaccgtcgtcgccaccgggggcggcgccgagaggtgcgcgtcgttcgcgggcctcgccgccgccgacggctcggcgctgccggaggtcgccatcgacgtcgccaacgacgccgtggcgctgccctactcgtcgggcacgacggggctccccaagggggtgatgctgtcgcaccgcgggctggtgaccagcgtggcgcagctcgtcgacggcgagaacccgaacctccacctccgggaggacgacgtggtgctctgcgtgctccccatgttccacgtctactccctccactccatcctcctctgcgggatgcgcgccggcgccgccatcgtggtcatgaagcggttcgacaccgtcaagatgctgcagctggtggagcgccacggcgtcaccatcgcgccgctcgtccctcccatcgtcgtcgagatggccaagagcgacgccctcgaccgccacgacctctcctccatccgcatggtcatctccggcgccgcccccatgggcaaggagcttcaggacatcgtccacgccaagctccccaacgccgtcctcggacaggtataacccaaactagacgaacacaaggaccaaatcaaacaataaaaacaacaacaacatccaagtggaaatttgatgtgaatttgatcgagcaggggtacgggatgacggaggcagggccggtgctatcaatgtgcatggcgttcgcgaaggagccgacgccggtgaagtccggcgcgtgcggcacggtggtgcggaacgccgagctgaagatcgtcgacccggacaccggcttgtcactcccgcgcaaccagccgggggagatttgcatcaggggaaaacaaatcatgaaaggtacacacactgcccaaattcattcacaattttttgagtttactttcattcgaaaaaaaacggagcaaattttgactgggtcgaagctgactcgtcgccggttcttggcgcgttgcgtgtgcgtacgtgcaggatacctgaacaacccggaggcgaccgagaagacgatcgacaaggacgggtggctgcacactggcgacatcggcttcgtcgacgacgacgacgagatcttcatcgtggaccggctcaaggagctcatcaagtacaagggcttccaggtcgcccccgccgagctcgaggccatgctcatcgcccacgccgccgtcgccgacgccgccgtcgtcccgtaagtatccggactccggcatgatcaacctcgccacgcgcgcatttggcattcgcaatttcaggctctgaacatcggcttgacgactgaatggctgaatttttctcaacgatgcagaatgaaggacgattcctgcggcgagatcccagtggcgttcgtcgtcgcacgcgacggctcggggatcaccgacgacgagatcaagcagtacgtcgcaaagcaggtgagagatcatgatcgatcaagaatattggttctgcaaactaattattaaccttagcatcgaggtgaactgaacgctgggtttatctctgaataatcaggtggtgttctacaagaggctgcacaagatcttcttcgtggacgcaatcccgaaggcgccgtcgggaaagattttgaggaaggatctgagagcaaagttggctgctggaattccggcgtgctgatgaaactggcatgagctagcttgcctgagatatccagctattgtttggtttttgttttgatcatacttaaaaagatatagtgaaatgtaaacatgatgtagtcagcaatgtaaaaggaacacgccctctggatatacatgaaagtttgagaggtgatctcatcggtcatcagtaacacaaatttgtcgcaaagatttttattttttgttgttgcacccgtgtaaaagtgaattgatgccattttatttgttggagaattgagacttgagagtactattacattcagtagaacagttacaaaattactgaattgcatacagcctgacagaagattattcttcctagttggaactgtaggattaatacgttgtggtagaggaaaatgtgcagtacctgagccaaatgaacaggactggcttgctctatgtacaaaccaggatggaagggtaactggttagttaatttaaacaattaaaagaaaacgaactccaataatgaaaggcgttgatggtgaagtaggtcagccgcctgaatgacatgctggtaatgttgtaaattgcccatctttgaaagcatgaatgaactgctggggtaaggaatgctcggcctgaaaatattaaaaagagatgactcagcctcacattgtttgcctttcactttataagccgtcgccaaaatttgaattcaaaacttaattttcgaattttgctaaggacacggatataatttttctactcacaaattatatttttgttgnnnnnnnnnnnnnnnnnnnnttatcagctacaggcagaattggcacgcattatggtacaatatgaagacaaaaattccacatttctagaaatccaacttttcaagtgtcaagtaaagtggttgaccttggctcaattggtaggatattgtgggtgtacctccccataggttaagactgagtggctctgatttgggtacctttctacgattcttttcttaaggagaaaaagttcctgctttctttctctaagactaagtacagtataattattattatgcagaaagagagaaaataaggtttagaaaccttgaatcttgagagtcatgaaacgaataataaaaccaaaaatatataaatagctacttatacttgcttcacacgatctaactatagtccaaatttaaatagaagagaatcaaatggtgaatgaaaagaatttagagaagtactcacccaatcgccgtcgctgtttgcatctggaacaagagcattgatttcactagatttagcagttgttatagatgtctctaaagattccttgcttaaataaagttggcagccagaagtgttatcaatcgatatagttggtacagagccctgcataattaagtaaattacatatgaggctattttcatcgatgagaccaaatccaaactactccattcaacaaaatattggatatcaagaaagcagatctcatctacctcacattggacctctatactgttgcagttcacaatttcacaagcagcgacaacaccctgaattatatgaagagaattagtaaagaaatcaatatgcattagagatgctttactttttttgaaatataccttgaacaataatcccattttgctacacttatcaatagttatgttgttcacttttcctgcaaaacaatacagagaagcatgcttaatcagttcgtgtcaacaataatgcatctcatgtaagttctttaagtagattgacgccgaaatacctttgacctgtagcacagaatccttgcatccaaatacatatatggattgcttggtatcacaatcttcaattactaagttcttgttgccaacatgatgttcaacaatccatctgatagacaatggcgtaaatgatgtgagattactttcattcattttgatatttctggacacaataattcaaaaagggaaactgcagttacttgcgacccatttggagctccaatttagaaggtaatttggttgaactagaggagggtttcttatgagcttcttttccttcagcagctacaacaccagttctatccgttctattcttgctcttcatgtcagctgtcaccgtcctaagacctgtagaagatgaagcactactcatcacatagagtacataaattgagaatgaaaaatgtggtcactgaaatccaacacgaaaatgtattgaccttgtgtcattgatttcccagagctgatttcagcgaagactgcggacattccggtttttggttgtgatgattgagctgaagaactgaaaagagatgcagaaggagggcagggagcagaaggtgctttgcttgttgaactcccaggaggttgccacacagggcccaaagggtagaatgtcttcacatagtcacgcaaactaggcacgaagagctcttttagagcttttgcccactctacatgatcagggtccttgcttttgtactccacaagcacctgaaggtaatttcatttgatattagtaagattaagcctattcaagatttttcgccgggctgaaacacactggacaaccaaggaggaactaactaagaagaaagtgtgagcgtgtcaagagtcgaacatgggaccacgaggttgaagccgcacacccctaccactacactagatattggatcttggctattcaagactttaaaaatgtaattttaatttcccacaataagtaatccgtataaatacgcccgtcatcgattaagtatgaagcaggaatcaatgcacacttgcatagtatcctcatcttttcatcaaaaggttttgtcaatgttttatttctcaagtcttgaacaaaggaagtgcctatgccgtgttactgtaattctgcttttcactctaggaaaaaaataaaaaggactgctcagtttcttggttcttttaaatctctgaacaaaggaaaaatcatgggcattaaccgaatgtctgttcttgatctataatgttgtttcaaactgacatcaatcctcttctttatgttaaaaacagtaatactacaccattgtaatttgcctccaatttgaagcaccttaccgccttaccagaaccagaccacgacgagctgtgtaccgctattttacttcagaacttgtagttgaagttactgaccttattgctgtagaactctgccatttgccaactctcttctacatgagcaataggaaggggcatacctgaaaaaataaatccacaaaccaattagcccccacactatcaaaccacttactgaggaaaaacatcagtttgcaggattgaacttgaacatgtattgtcgcaatggcgcatgcatgtttgaagttttctgactaccaagtacttagcctaccgaaaggttgggactagacactaaccgcaacctttgccggtgtacccaatccacgccagagcggccaggctaccggcggctgctttcagatggttgccatggctcgatcttgtcccctctgccaatgaatttgcctccaatattgtttcattcagaggccccatgaatactgcgatggaatccacggttggcttctgcgtgtcaaagcgatcgaacacattaaacgcaatcaatcacaacaatgccaatgtatcctcaaatgcgtgaacaaataggtgcgaattgcgacgaattcgatgtgaatctgcaatctattaaaagaacgaaagaaagaaatatggcaattttttacacctgagtttgcttggtcctgacaagaaggtccttcccaaccaagaacgccttctccagcaccctggtcacctccgcgacctccgccccgatcttgccggccgccgccgacaccctcccgacggcgccggcgacgagctcgtcgaacgccaggatcgctgggtcatgcgccgacgcgtggtcgacctggccgccgtagccgcctctcgccgtggcaccggcggcgccattgagagcttcgagccgggacaccgcggcctccagcctgcccaccagggcttcgtccatggcgtccgtccgtgcgtgcgtgcgctgcggatcgctaaggcatttgagaagagagaaatggcgaggcgagcgagagaaaatggcggaagttgatccggtgccgggagagccgggcacgtggacatgtgtgcgtacctgagccaacagaagttgcaagcatttctccctgaaaatgcttatcatcgaagaaggaaaaatgggacaccccaacccaaaggagtagtagtggcgtgacaagtgcatgtagcaaatggagtgtttatgcaagtcacatagattcaaaatttaaatggtattttctcttaaactatttatctgaattatgaactaattataccattggatttgttataattaactctttataacaaaatctcatatgacaatattccgatagtttttatgacataatgttattccaatgtttcaataagtgtttactcatgttttattgattcaggtataatgttgcatgtggtctttttatatgcttcagtaaatatattttgtgtttcaaaaaatacaacttgacgtttcaagagtgatataaaattttaacaaaataaagtatttgcaaatatgttgcatcatatatatttttatgttttcctaggtaggacctaatgtttcatgtaatgatggttattgttgcagccaataatttttatatagttattgttgcacgtgatctatttatatgtttcaacaaataattttttttatatttcaaaaattgcatgttaatgttttaagaatgatataaaattttaacaaatcaatatttgcaaatacgttgcatcatattttttttatgtttcagtagttgggacctagtgtttcatgtgacggtggttattgttgcatttagtaatttttataagttacatatatctgaaacattttctaaagtaggttgagttatccgtacaagtgataaaacaaaggttgatttttctaaaacacatatagttgcatggcgttattccgatgtttcaataaatatttttctgacatttcacaagtttatttgtgaatgttgcacgtggtattattggatgttctagtaagtattttctaatatttcactaactcatttataaatgttgcacgtgttgcttgggatgttgcaatgaatattttctgatctttgaataattataactcgttgtttctcgtataatatataaatgtttcaattagtaatataatcatatttataaattttatcagaaatatagctaagtgagaccttattgtaaagatttaattgtaatgaacacaatggtgaaatcggatggtacatcggataagtaatttagaaggaaaaatagtttaaaggtttattggtagagaagatgaatagagagacatgcacgagagtagggtataggcttggagcatagcagcttaactatgatggtttttctttctttcttttttttttttgcatgcagtcaaatagtagtatgtgggtgaacaacgtccgatcctttgctaaatatcggacgtccaatgtgtagcaacctctatttctccccctaagtttttattttgtttccatgtcagcatttcttatgccctgtccccaattgccccttccggaatatcgatttgaattcctgaatttgtcatagttttaaataacaagctataagtagcttttgttatcatatattcggtgttatgagtgtaactagagagtagagattgaagtgacccatatgatatgatagatgggctgatcaaccttgccattgataataaacacccttaccctctcttttttccatggcatgagagaagccaagataacctccgcgttgcaagcctgacatgagagaagtcaagataagctccgcattgcaagccgagttaggataagggctcctttgattcaaaggatcggtataggattttttccataggattcacaatcctatggattatttcctatggaggcctttaattcataggaaatgaaagaaaacattcctaaggattgcatccctttagttcattttcacaggaaaaaaagaaagaggtctgacctctttggaagagaaatcatgtgttttttcctatagcactattaaagggcacatttcatcttttcctgtgttttttattctcacggggttgaagaatcatactactttaattcctacgttttttctattcctatgtttttcctatcctgcgaatcaaagggaccctaaattccagcatatatatttggtggatgatgtagtcgttgtattttttcaacacatgattaattcaaccatcgtgagaacgagctcctattcgatgcttgaattgaagctcctagtagtgcacaagctgtgccacggccttcgagccggccgagtgtatcttagatttgcaatcggcagatcgcctttgagctctcccacggtgtcaagtgtgaactcctcaccgtcgaccgcaagcaccatcacgcgagctttgcttaaaaaaaagtgaggacaaagtatgtagaaaagatttatgttgatttgtgagggcagtttataatctataaaagctgccagatataagtgggcccagcctcggagaggcgggaagttacaaagtggtatcagagccgactctcgcggtttcacgggcacgtgtgtcgcagttgcacaggcatggtgcgcatggctggtgtgaacccggagtggtcacacagcatggcacatgtgctggcactgggtctggggttgatcgacgtccgtcgatctctcttaagggggtgaggatgtgacatcccgactcagggcttaataggattaatagaatactcatatcaacaagttgcaacttctttttcggaagtcgatctctaaagaactctgaggttaagcatgcttagtcaatttagggatgggtgactaattgggaaattctcccgagtgagcatgagtgaggacaagacttatgttggtttgtgagggcagtctatgacctatgaaagctgcaagatgtaaacaagcatgcgcatgagtgagaacaaacaggcccggcctcggagaggtgggacgttatataaaatatcaaaaatccattatattaggggacggagggagtacttaataactaaaactatagttagtcttttaatatcttgcttaataagttaatatgtctttaactaattaaaactatacttatttaattaagaacagagggagtatatgccattcttttatggtaattcttgtaactttaatataaatgtttcatgtgtttgacccatgctcagccattgagtgttatattcttaattgtttgcgtgtaacactaataatattgtgtacatttcgttgtttgctattctgaactatagtctagtaaagtaaaccgattctttgatgtttgttaggcttatgtgtctaactaattgaggatcacacaagaaagggtcgtcattgaacacaagccgaatcggctctccctcgtaagctacctttttcttgtcttttcgtgttatcttatccttaatagcaagattttcttaatggtaccaaacaactaaccttgccaaattaggctaggcttgctctagccttatatccaacaaaaaaaaaactactcaacagcatcccgtacacacgggataactactacaaataaaaatctagcaccttatcctcttatttgtcgcttccccttccctctccctctctctctctgactaccaccctcatgagcacggaggcgacgatggcggctagctgtgcagggtggcgcgttgggtgtggaggacgctcggcccgctctcctttgccagctcaggaactgtcacgccccgagctagtcccgactggaattagcctgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattacaaaagggaaacggaagccagggcttggaccaaacaacacaggcgcgacttgggaactaggccgaaaccctaaaactcatcgtaaccggcttgctcctggaagaactcgtcatcagcaggatccgcttcatcttcttcagcaactgggggggttatttatatagagcaagggtgagtacaggagtactcagcaagccaggggaaataagtgtttaatgcaggcttcaaagaaaggctggtatttttgcaattgattttatttgaactcttttctgaaacaactaagtgagtgcttctcaaacgacacggttgagacagtgcgtcccgtccggtcggagtatgtgcaatgtatcagtctttagatcttaaaacaaggttggcactcggccaacagcttttcaacggccacccgggccaacaacttttcaaacggccacccgggcctagctgatcccgtcagctacagatttttcaaacatcaaaccccttttcacaacagcaatttcacaagcagtagtcaaacaaaactacgttaggaatcacctcacatccgcccatgaccgtgggcacggctgttcgaacagttagttaacctctgcagagggggtacactttacccacacgacattactaacccggatcgcccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaagggggtcctctccgacaccaccccggcaaatccacatgtctctcggcatcatggctcccctgataagctagttactcagccaggggtgtcccattccacccatgtggtcgtacttgtcttatgttcggatgaaatttcaaggaatcggtccttaagtgcgggagcgggaaaaccgtacacccggtacgttccccggtccgcggttttggaaattcatttagttcgcaagcaccgacccaggcgtcgggttttccaagtcttttgtaaaacccaagttttacccaagttgtttttcagattttaagtttgaaagcgtccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaatcggatttacggttgggaagatattgaatttctaagattattggatttttggtctgaaggaaaaaggatttatttaaacccttttggaaaaagaaaaggatgagggagggaagatagacttttcctcgggcggctagggcgcggcccaagggaaatggagcggtccggccgagttaactgggcccgacggcccaaaaggcggcccagaacgcgcgcgggcgggaaagagagagggagccggtggaccgggctcaccacgcgtggtcccgggtgggacccgcttgtcagcggctcggctcaccgtgcggagggagcacgcggcgcacgcgcgcgggcggggagggacgcggtgcacaggcgcggttcgcggtgaacgcggatgcggcgggcccacgcgcagcctcacggctcgcggtggaacgcgcgcacgggaggggctgaccggggtcggcccgtcccgtcctcggctgagctggcgccgacgtggcgcctacgtggctgccacgtgggctagcgggaggtagacgacgacgccggccggaacggacggcggacgacagcggcgaacggtggagcgaaccacggcgatacaggcgaaagcgagcacaccgggtggttgcacaggacgaggggagacgagccaacggctcggattcgccggagggagcttgacggcggcgaatcgcggcggcaacaaccggcggggagggaagagggaaacggcgacgaggccacgaggggtcgattcccggctgtgagagcatctatgcggctacgggaactcgatgctagcgtcggattggacggagctacgccgagcgaggctggcgacgtgcgggtgctacggagctcgagcggcgacggcggcgagcacacggcgagcgacggcaacggttggggcggcgccggctagctacggggagtctactcgtgctaccaccgaaaactaagggggggggagatggagcgaggaggaagaacggagtccccttccgcgtcctcgaacgcaccggttctcccggcgctcagcgaaggacggcggtggcgagacagagcacgggggcgacggcaatggcacggaggcgaatggaagaggaagggaaaggggaggctggggtttaaatgggcggcaatgtcggtttgggaaccgacttgcgcggtcaagggcgcgagctggcgctcggcggtcgcggccaaagcggcgacagggaggatgacgccggcgaggaggaaaaaggggaaaaggagggggagaaaggggggcttgcccctttgccgattcgggaaaaaggaggaggtgagcgggggcgcgcggctgagggaggagggaggccctgcctccgtcccttggaggctagcgcgggagtggcggggccgatgcaattaccacgggaattacggggggcggttgggaacggaccggaaaactggcaaaggcgcgtgccaaaggttacgggggaggaaaacggcggtcgggcaccaaggaaccccccccggtttgaaacggaaggaccggggaatgtaattgtttggttaggacatccccctggtttgggggccaaacggttgcacggtttaagcggaaggtaaggggattgggcggcaaaaactaaccaaaaggggggatacacttgggcccccgcaaaaaaaccggggaggtattagggaacgaaaggaaaattgttgggggggggttaagccaaaccccgggggggagggtttgggggataagccttcccctcccaggggggatagggaaaaaaaagatcccggcccccct

SEQ ID NO: 78346 - DNA, 2739 bp, Oryza sativa
aggggtggggcccttcttcgcatgtgtggtccgggctggaagtatcggtgggcccggcccaagcgtggcctttctggtgctctgatgaggtggaacagcgatgcgtgatgagagcaggtacaatagtaggctataagctagctgtaaatatatttttaatgagataaataaggagagagaatgatagcgagctatagatttatagccagctgtagcatgaactccaagacgcagtatgtgtataataggtggggccaagtatcaatagtgcagtatataactattgtatgaatgaactattagattggctatagatgaattggagccaatagttggctatactattaaacttgctctgatgagagggaaggcaactgccagttgtcgtggacacgtggctggatcccatttgctggctaggaaaggacaaggtcgcaaattgcaattcatactactatcaccgtatcatcagtattttctttaagcccccttttgaatcaaagaaaaaccataggaattctagaagattttagagcccctttgaattgcagggtagaaaaaatggaggagtaggaaaaacacaggattctgacaggaattgaagtgtaaaacagaggattgcaaaacataggaaaaacacaggaatggtcgttttattggagtgcaggaaaaacgcaggaatcggatgagagagatagactcaaaggaaattttccaagaggttggagctcttgctaaatttcctccaaaatccatatgcaatgtgccattccatagaaatttcataggatttggaaaacttcaatcctttgaatcaaatggccaaataggaaaatttcctataggatttgaatcctatgaaattcccacataaattctttgattcaaaggggcccgcaatgtgccattccataggaatttcataggatttggaaagcttcaatcctttgaatcaaagggccaaataggaaaatttcctatagtatttgaattctatgaaattcctacataaatcttttgattcaaaggggccttatcctatgggaaataattctatagagtcctttgaaacaaaggattgtttcctatcaatttctttgaaattcctatggaatgaaccttactagagcaattttggaggaaaaaaagcacgaggtctcacctcatgttttccttttcatgtgtctaaggttcctgcgtttttcctgtgtgctaatcaaacgacagtttgaagactttcctgtgtttcaaaatcccataggaattcaattcctacgtttttcctattcctctattttctcaatcctgcgattcaaaggggccctaattagttcacgtaacacactcacacaaccattaatactacctccgtaccaaaacgttgctatctagatgagattttacatgctgtcctagatatcaacattttgagacagaggaagtacatccttaactcgtgtttagagagcccggcaggtggacactaatgacatcatcttctatagttcaactaaaaaaacacgttttcatgtatacaatctttcaaatgcaattcgatcactagttttcgctgcaagaaatttaagctggctgtggctaccgcgacagtacaagcagcacaaattatgctgcatgtttgtttgtagttgtttgctgctatgcaatcacaaaattctgttcccagtaattaacagtgaatgcattattgaatttatacttagtcatttatatagtttaggactcgtttgattaattaaataaacggcattctgcacttttgatccacatgatggtccaacttgtatttattttattttccaactggattgatattgtactttgcacgcgagtgatgtttttctttctaatttttcttgaagaattcatgcccatgtctatttcattttaataatccctataaagtataaacttcacagtatagatatgtatataaattccacatgaattcttgcaaacatttgaaagaaaaaaaatcaccgtctcaaacctagcaaagttcgaacaagtttgatgtagggcaagagccaaccatcaacttgtttatatcttacttcatccgtaccaaaaatataataatagtgtagtattagattgcgaccaacggagtattgggctgctatattttagacatagaaaatacttttgactcattttgtgtaattttatattgtttgaatgaaaaaaaacactaacatcttagtttctgaaattgggaataagtttgggaaaagttggtagtttggaaaaaaagttaggagtttaaatgagtaggaacgttttagatgtgattagatgtgatgaaaagttaagagtttagaggaagtttggtgtaaattaaatagggcctataataacattgaaagtaatgacatatgaactcattacttaaataaactttaaattgatcagagtaacatcaaaagacatcactactagcagcattaataacggtagcactagtagtaacatccaaactactccactttactaaaaaagcagagataactccaaacacaagcataactgcattaaccacacgagcaattaacatcttagatcacccaaaatgataaagtaaggtgctatctataaaacatgtacatctcagcaatagactaaattaatagtaaaccatctcaatagtatgtctacatgggtatctatagctctctaatatattgtctcgtttttctctatagactatcttcaggttagtag

SEQ ID NO: 78347 - DNA, 659 bp, Oryza sativa
gcttccagcagagtagctacgcactatgtgacccaacaatccaccatagaattccaagaacgagaacgaccttctctatcaatatattaaaaaaaaaaagggggcaagggccttctcttaggggggaaaaaaggaacgaggatttaacccaacactgtctttttcttatccagaccgagagtctggttaacctcgatttccacatataaattagatttctacaatacgatgggacctgaattatgaaaaagaaactgagctagttatattccttgaattggttcttgctaattttattgcatgcaatgacaagggttcccggtcatcatatttcctgtatttacagtcaaataaacttattggcggtatgctgtcggggatgtaatacgtttctattgtctaaaagtatctcacattctatgttatctgttactagtagggtatgcaaggatttgcaacataataataataataataataataataataataataataataataataataataataataataataataataataataatattattattattattattattattattattattattattattattattaaagctgcaacataatattattgcgactatcttcaattaaccagccgcaaagcgcgtgggtaaagtggtaaa

SEQ ID NO: 78348 - DNA, 3013 bp, Oryza sativa
  unsure (1)..(3013): unsure at all n locations
ggatggaatgagtaataatctttctaagcaatcacattaaattaaacaaacttgcgtatatatgtgcttttcaaatatagccacttaaagttttgagtattgatttgacttgtacttagcaaaagaatgaaaaataagttcctgttgatctttaaattcccgtgtttttattgtgaaacctgtaaataaggaattttttcccacttttcctgtatgctaatccttcattccgatgagcgaatagtttcaatttctatagtaatttaaatactccattttcctctaaaaatccttcaatccgaaggagcctttgcgacctattaactccactgtaacaagggatgaagggaatatgattgagaaaagttctacagatttgctttctgtaccccttccaagagaaaacaaacatgaacagctatatgtttttatttcctttaagaagtcccatgcactctcccctttctctagtatctctcttccacaaaattaattccaccaaatttcctttgttttgtttccatccaaatgctcaaagtcaagactcctaaacattgaaaccatgtagaaatatgaagtgtgtaacatattatttataagtattttttctttcttgcttgcaaatgatcgcttagtatggtctagatgaggggacttgggactgggaggaagacatatgtgcaattgtgacctctattccagttcactgtagtacagcaccattcgggcctatttatgacggcccatgtaaggcccggcacaagtgcatcttaagcccatattcatcactattctaatctttggctattggctctcttgagacatgtataattgcatttatgtactcaacgatataggtaatcacacctatatatgctcaatgaccgatatatagatgaaggctgaaacaggaataaattatctgaattttacttctcaataaaaggtcatcaaaattgggtaacttcttttccttcctgtcacacatatagatggttggagattggtcatgcatatatgatgagctttgtttatttccaaacaaaaaaagtgcttaatctcaaccatttcttattttctcccagaggttatagacaactatttagagtggttcatcgattaagttggattccactatgtgagcctgacaaactatatcggtgtgattaagccgctgctccacttcgtggccgctgcgctttgcaccaataattaaaaaggagcatccgtgcaagccacattcaaaaattagtcaaccattacatacaattttagctgttattttatttgtaattaaataaatatttcacgattcatattgcccagattttgctacacagaaagtaacaatttgagcatagatcatgttctttgcatggtaaacctaatggaaatatacgaagaattgtagaaagatcaacacatcacacattgagttatcgtaaatcattctacaaacatgctgtcagggttatagataccatatacataatagtagtcgactaaatctcggcaggacccactacataccatgtcttatacgaatacaaccttcggatataggaggagttccgcataaggaaggatgaatagggttctacatggaaaccacaaggactactcggattgtatccatattagtttctctagttctacttggacaaaaggacatatgggtataaatacaagactccataggaggagaggggacacggaacaatagatcaagacacaagatcaacatacaagccaacatacgccaagacaagacgccggatatcgacttcagagatagactagccagtcccctatggtgcctacggataccgtcaggagagatatagccgctaggcgctctgtctcttgatctcgccggatggccggattcgagggaggaaaggctatcccttgttgtcgactaccgagtcaagacccttcaagacnncgccatgnntcgacaacaagttaagataaggctcatccccaaatattgggtactggttgtgggattatgaatgaaacaaagaaagcaacngacnncggnnnttcggcccaacaaggttnggtatacccacattgccatagctaaactttattgacaatgcctaaaaaaaatactcgatccaaagtgaaaatattcatttataaaaaagtgaaaatattagttaaatgatagttgacagtaaaatttagtctttttttttaaaaaaaaagacgaagaagagaagaaataggtggcgatgggtatcgtccggctctgcgacggcactgaggttctggaatttcctctttttttttgtctttctttccaacggaaacttctttgctgtctctgaaatggtgtggtataacatattaaataatttccagaattctgtatcattttctttccaaggaatttttcgtatcttctccggacggtacatatcgtcatgaacgtgccgattatagacggccaaatatatacaagtagttgattaaacatatatgagttggtcttatataatttagtaaaaccaaaattatttggaagtaagtacatatattgttgcagtgattgattgagaagatttgttttcttcataaaatcagaggcggatacacgaactcgcgtgccccatatcagtgtgtttagattaagggttatatattttgcacattgcagtgtgcacaattttttaaagatcgatagggagatgcaattaaatcaaagaaaacaaccaaacaaccacattgtttctgttcggatgttctggataaatatgtgagttggtctaaattcagaaagggaaaatatatatttgcatcaagttaaaagaaaaaaaaaggcaaaattggttatatagcatcnaaagttcacgcttttggttttatagcaccgaaagttaccggttcattttatagcacccaaagttcaccatgttcccatttttaacacttccgtcaattctcgatcgttttccgtccgtcttgatccagccacacacacgatatgacgtttctacccctcaca

SEQ ID NO: 78349 - DNA, 3635 bp, Oryza sativa
agttccccaaaatattttccaaaaacatcacattgaatctttagacacatgcatgaagcattaaatatagataaaaagaaaaactaattgcacagttatgggggaaatcgcgagacgaatcttttaagcctaattagtccgtgattagccataagtgctacagtacagcacatgtgctaatgacggcttaattaatcttaaaagattcgtctcgcggtttccaggcgagttctgaaattagttttttcattcgtgtccaaaaactccttccgacatccgggcacatgtgctaatgacggcttaattaatcttaaaagattcgtctcgcggtttccaggcgagttctgaaattagttttttcattcgtgtccaaaaactccttccgacatccggtcaaacgttcgatgtgacacccaaaaatttccttttccccaactaaacacaccctaaacacaccctagataaaatatagaaaaattactttaaaaaaatcatattattatactatcttttaagtaactttaaactaatacataattgcctacttaattaatcatacgctaataaggtatttaaaaaaagagtactttttttaatgtgtggaggaaatatgcttccaagtcccaacctaaaccttcaaacgcacccttaacataaattttactcctgtgatccactccacctctcatttttttctcccaacccccctcaatctatgactttgttttcatgcactatgcaccacgccactagctgacctcccctacttctcctcgatagcaccaccgacgtcccctactctttggctgtgtttagatccatagtttggatccaaacttcagtccttttccatcacatcaacctgtcatacacacacaacttttcaatcacatcatctctaatttcaaccaaaatccaaactttgcgctgaactaaacacagcctttatcgttgtggccgtctcatcctccttgttgtcagagaccaccacatcatcgagcatcgccgccttttcttctcttagggcttgtttagtttccaaaaacatcacattgaatctttggacacatgcatggagtattaaatatagataaaaacaaaaactaatcgcatagttaggggggaaattgcgagacgaatcttttgagtctaattagtccatgattagccataagtgctacagtaaccaacatgtcataatgacggattaattaggctcaaaagattcgtctcgtggtttccagacgagtcataaaattagtttttttattagtgtccgaaaaacccttccgacatccggtcaaacgtccgatgtgacacctaaaaaaattcatttcgggaactaaacagggacgcccacgagcttgccgacggcgatcagttttgctcggactcgttgtcatgcttattatgtcgcctcaagttcgctattgctacgccatcgagcttgttggatccagtggcagatcgagtgtttgatgatagcagggacgaggaatactggttcagatcggacaacaactgatgaccgacatagcagggggcgaggagcttggcgggatggcgacaaccttatactcctccgttcctcgtctctgtcctgataatccacttattctgacaattaatctggtttgcaccggcctatcgtagatctattagacatatatatggtgcgacggggcgttacacaatacagtaagttttactccctccgtcctaaaaaaaagacaaaccctaggtttttgtgttcaactttgacggtccgttttatatgaaatttttttataattcatattttcattgttgttagatgataaaacatgattaatattttatgcgtgacttgtatttttaattttttttataattttttcaaataagacagatggtcaaacgttggatacgaaaaacagggtttgtctttttttgagacggagggagtacatgttagaagtgaggtaggcgtgccttgcagaaggcaaagggagccatgtgaagccagtggcaaagatgagctggcagccacggtccgacttggaacgaaacgtggcgacaagtacgttccctcgttgttcatgccctaatcaactcgtacactaatagggaactctgacgatcgtactaattcgtaaagacacctaatgatcgtgtcatttcatttgagcagctggttactgctgtacgactactaccatggaatgattagagtcatttcattgagccgttggtgtctgtggatctgcgatttgtcctactgacgatgattttaaccctctccagccgaatcttgcactgtttcctacagtaagttgagcctgcctgcacgggcactacagtctactgctcctacagtgcaggggaatctgaagaaaaatttaattggccgcactactcctcagacggcttttcacttcttgcagttacagatgaattttggatctaaacttcagtcttttcatcacatcaatctgtcatacacacataactttttaaccacatcatctttaattttaattaaaatctaaactttacgctaaaataaacacagcctatagaggccaacctctctctcttctcccccatcactgcacgcgtctgcgagaagcaagaagcagaagctactcctactactgatccgtagctggaggagtagatggtgatgtcatggccatggccgcgtgcctgcatgcatcgaggaagccagggctactactattgttaccagcaccatgcagtgcaaagaccagcatcctgcggatgatcagctacagcgagtacagccagtagccatggccgcatgcagtgagctactactccagctagcgaagcagagaaatggaggaaaatttacagtaatcaaggtcgtggtgtcagatggttcggcctattggagagatcagctgcttctctctgatcgatggatcagatcactatactgtgctatagccacactttacaggataggacacatctatgtacagattcgttatactaggatatattccatccagtaaaagattgtcatactttgggacggacgtagtagcatgttgtgatcgtcgtgttgctcctcctaatcgtcgccatcacgtcgatcgtcgccgtccgccacagaaagctgctcgcacacatttatggtggatgcagggctacgcataagtcctcaagtagaagaactccgtaggcgtagtgtggtgtttatgcgatgaatcgatgacacaagccatgaacccggcacaacttcttcgtgccaaatatgccaatcccaatgcatcccatatgccaagatcggttacttttgtacccaagggatttcggaatattttaacataggcgaaacgagaaacgagaaagctactccctccgtcacataatataatactcccttcgttttaaaatggttgacaccgttgaccgttgactttttaagtacgtgtttgaccgttcgtcttattcaaaaagtttaagtaattatttattcttttcctatcattggattcattgttaagtataactttcatgtacacatatggttttacatatttcacaaatttttctgaataagacgagcggtcaaacatatgctaaaaagtcaatggtgtcaaacattttgaaacggagggagtagattt

SEQ ID NO: 78350 - DNA, 8367 bp, Oryza sativa
attattttttaaagttttgtatgaagtttggaaatgcctgtttctcttctttttactaccctacttaacatgtctgtgagtgtgagctgctcatttattctatatgatctggctaatatcttctgcattttcttcaataggtttacaaatcagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcagtaagcacttacaaacctaaaatgtttcgtatgcaaacacaatatttgtcaatgttcaaagcaaacaaacatgatattctatgccatctttttttttcagggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttcatgtttttgccataaattgtggctagatgatcttgtttcatgctactgagtcaacattttgtcctggtttgtaggctctgacctgcctgcctacttatatgccattgtgcatgattcacgcaggatcaattttgctggacaaaatcatgattccatgctgcaaatttccaaagtgtggtctatatagttgataggaggaacttttagaggaatcctagtagctccatgtggtgacattaatactgttggactccctacttattacatacttattcaaagatttcaccatgccatgaactttaagacataattatgcctgtttttaacagaatggtctaaaattttccttttgggtttcttggaggctttcctgtgccagccaagcataaaaagggggcctgaagctttgttcttttcgtaacaatgcaactgactaaaaatctctcctctcttgaaatgttcatcagttaaaaagacaagtaggattttcaagtcagcagagcaaggttgctgcaaatccaggtgatcaatgtcaaatactaccagacccaaattcagatcacacaaggcaagcagcagctaaacatcaacaattctagtctacagcacatttgctccaaacaaaccattgcagcttagttccatttcatatacagagctcccatggcattttgagtgacagcatgatgatcatgatcatgatccatcttgagaattctttctttcttttttgtttttcttcagatgttcagaggaacagccagctgcagcagcggcggaggcgcgacggcgcggcgccggtctcccggatgcggtgcacctggcgggccagccgcgccgcctgccggctccggcgagcctccaccctcgcctgcttcccctccgccttgtggctcaacgccgacagcctcctgctcagcttctgcttcgccctcgccttcatctgctctgcctgcacctgatgataacatacaggcatctgtatcattcattcattctctaaagaattctatccaaacttggtttttagataatagatttataaaacccagcctctacatcaaatcagaagtacacgggcaaacctaaacttgtcgtccctcagttccataatataagggataatgggtggatgtaacacattctagtataatgaatttgaacagacggtctaagtttatatataggtttgggtttagccatacttctaactaatgattcaacaaattagccataattgcttgagggatgaataaacattatgcatactccctccgggttgataatacttgtcgttttggacaaaggtacggtttcccaaaagtaactttaacaactattttctattataatatatatgaaaataccaaaaaatatatggttttattgaagtatattttaaggcgaatctacacatatggtttttatatttttaagataaatattttagaaattatttgtagtcaaagattttaaagtttgactttacccttgtccaaaacgactaatattatcagcccggagggattactatattatagggctaaaaatagcttagaaaagatatctaagcatgtatagaaagtttttatttttaatttatgaaaaaccatacttttagaagcatggcacgaataatctgtattctcatagctgattagaacgcccaataataaaggtttaagtttttgaattcgatgtaagtttacctctgcgtgcctcatcttggcttcgaatttggccttctggcagctctcccattcctgaatcttcacctccttcctctgaaacctgacgaattctcgtccaaattttcgattcaataatcaaattccagaccaaaaaaacaacaaaaaaacaaaagttcagagaaccaaaaaaagaaaaagagagtgatatttgctgcacctcaacgcgagcttgcacttgtgcgtcttctgccacgccatggcgcgcgcctcgaactcccttttcttggcctcgccgccgccgtcgccggagtgaggtctcggtctcggtctcggtctcttctccggcgaggcgcgggggagctcgtcgtcgtcgtccttgctggcccacgacgcgatgttcatcttgcccagctgcagcccgagcgcggcgatctcgcggcgcgtcctgatctggagctcccgctccgacgacgccgacgacgcggacgcggcgcccctcgggctcgtcggcaccgagcagagcggactcagcgacggcgtggcggcgccggcgggcgtgccgctccgcgactgctccttgctcgccatcggcgtcatctccgtccccacgtcccgcatcgacaccgccgccgcctccgacgacacgcggagcctcttctgctggcgctgcctgctcgccaccgacggcggcgacgacgacgccgaggcctccggcgcaacgcggccggacacggccgctgctgcggcggcggccttcttggagaagattgggttggagtgcacgacgtgtctcccggcgagccacttctcggcgtcgttccactttgacggcacctgcctgaagaacgtcccgccgaccaccgccaccgccgccggcggcggtggcggcggcctctcctccctgtagaactcgaagccgccgctgtcgtagccattgccagctctcccatggctcgcgtcggagcgcgagcgagaagaatccgactggtccttgggataatctgacgaagaaatcaccggaatcaaacacacatcaccattgccattgcaagctccacaatggaatcgaagaggaagcgaaccttcgtcgagttcttggggcaggaggctgttcttggggtggtcgtcgtcgtcctcgtcggcgtcgagcctcgccggcgacgctcgcggcgacttctttgcctcgtcaaccctgccgatgctgccgccatgggatcccagcagcttcatcctcagcttggttggagacatcactcccatctgcattgcaacaaaattatcactaaatacatagtaaaccttaaccaatttgatggtttccaatgaaaatcaatcacccaagattcaggacaaatttcaaactgtcattactagtatccaagattcaggagtagtactagtttaattaatggcttggtaaattggggcaaaaaatttactacaagaattgactctggcttcctgctgcaaagaagagagagatttttaactgctcatactgcagttgccattggagagcagccacagctttgaatagagcagccatgaatgttggctactttgagcttgagagagcaaggtagaatccacaaccaaaaagtccaagagagagagagagagagagagagagagagagagagatgtataggaaccctgttgtggtagtagcaataataaatcaaaagcaccataaatggacatggctagagagttcaatattggaaagtaaagtaattagtggcactatgccactactatcttgacccaccaaaaatgttcatgatagatgagaaaggggagtagtcacattgcattatagcagtacttagcttcaagaaggggttaaaaaagagagatggatcaagcatagtagtacatggatattggatgatacatgaaaaatgaaaatgacatacctacagacatgagcatgaacttaattctacaaaccaaacacaacctaaacaaactaaggttgaaattgtagctaagaaacaagcatatggaggaatgaactaccaccaccacgactactactgtaatggaatactcggatagtgagtttgttacctgaactttgtgtatcctctcgtactccatgacagattataacccctctctctctctcagctttgagcttgctaaactgtactacctctagttacctgcaaattagcaagaaagcaaagaagcagggagggaggaggaagaagcagcaaagcaaagcagaatggctgcgagtgttgtgctttgctttggctctgatggggaagacgataaatactagaggaaggagacacgtagcattgtagcattggtgcacttgcaactctgaagagagaaaaattcagagagagatagaaatactagtattcagaaagacagagagagaaattcagagagcgagcaagcgtgcgtgcgggtgggcgtgcgtgtgtggaatccgtgtggaggaccactcgccggcgcgctcatcggtgtggctcctcttgctgctccacgagccgtccgatccacgcgtgatcgcctgatcggacggcggagatatcatcgctccgactggcaggtggggcccaacggctcggctaaggcattctacagcgagcgcgcgaaaatttcgggacgtatccgagctaaattcaactttaaataaacgagatttggaggaagagatactttaaaaaaattttaagaagaagttgtgaatatcctgcgaattaaacacatgatctcaggattaaaactaaaccctccttgttaatatattattaagtgcatctcctaaattaagtaaattaatgcagtacaagtatgaaattttccagggcattgtctatttgtttgttgttttcattcagacatgacaaaacatcatcaaagttttctaatcaaggttagagtgtgtgttaggaggcgtattcacgagcatgtaattgtggtgtgtgcatgtgtaataatggtgtgcatctctcgtataaccgctacaaaaatactcctttcatctatttttgaaagtcatatttccaaatctgaaaaatttatttttgataggcatattttaatccaacaacctatcatcttaatgactttctcggatttaatgcatgactctccattcttacacacatgattggctacatggacattgagaaatgtaaatattaatgaatcgcttgtttacgatgaatgactagtagcatgtttaaatggatgataagtagaattacttatccttggtctgtgtgccaagatgaaatatgactatcaaaaagtagatggatggagtagtacttagtaacaaattaaacagtttcgacccattcgaatttaatgaagatgaaaaaaccattagcatatgattaatggtgttttaattatttttaaacttgaaaatggacttatatgatattttaaagcaacttctataaaaaaaattcatatgaaatacaccgtttaacagtttaaaaaaacgtgctaacagaaaccaaactaaaaattgtatcttaatcaaaaacagggctttgataaattttaccgttaaaacataataaaaactttgttatggcttattcggttaatccctatatgcaaaagattgaaagggattaattatcctctctaaatcctattcaatcttagtagtatttgagaagggactaaccgaacaagtccttaatgttattacaaaatttcttggttttgggtgtgtttatttcacgtcaaaattgaaagcttggttgaaattgaaatgatgtgacggaaaagttggaagtttgtgtgtgtagaaaagttttgatgtgatggaaaagttggaagtttgaataaaaactttgaaactaaacttggcctttaacaaaaaaaaaattctacgaatttcattcagatttaaagctttgctctgagaggagaggcaaacgagtgtgttgtttgctcgttgttcttcccgagaactgaatgagctgatgagctcacctcacacgaaaccacatcacatgaatgcatgagcactagtaccaaatttttacctctacatatgctagtactggtagaagtatcagtgtgaattccagagtggcctatggcaagtagctacgtgtagttgaacactttttctccctttctgtattgtgcccaactggttcaaaagttctctaggactacactgttgattggagtacaatattttacacatttgtgcatgaaaaaaaataatttcccctcacttttattttgcaaaggacaatgtgatgtagttttatgattaaattagcagtaaacctatagttttatgataaatttgctacttaatctatagttttataaaactctattctaaatatgtagtttcatgataaaattattattaaatttttagttttatgataaaaacatcttaaatatgtagttctataatagtttgatcaaagtatatgtagttttgtaaaatttaccaaggtcaaacacaaatcctttattacatgtatcctttattacatgtccaaagtttctctagtctcgttattttcaattttttttaatgtgtgatgagaaatgttatgtgaaattaggatggaggcttttctaatcttctcccacacagcacaatttattttggataattcttcagcgtggtatcgtttacgcctttctcgctttcacataaccagagtccatgatggtacaatgctttagcttacaaaagtccttgactttgtgttttgaaagaagtgaaatttcctactctcaaaatgcccattgcaagaaggaagcgaagaacatctgagttgtttaatgatttttcaaaaattctcttcacccaacccctatggccctatccaacactagaccccatgtacacccaaagataaagccacaaagaaaggggagggagagaagactccaaagcccaaaacccaacaagaggaggagcacaccacaacaaaagaaaggacataaccctgcttaatttcctaattgtttagcttgctcctccttagaggacacaaagccacaccatcagctgccccttaaaccctttttccttctagggtttggcaatgccgtcagctcatgttcctcaagcacagcatcagtccaccaaaccattttttgttaattacccttttttaggtgatttcttgtcttgatgtttctagttagttccaccagcatgtaatttaatctgaccgttctggtttaggtttttgaggccacattatccaatgcttgatgtcacacttatgcaaatatacatctaaattatgtgcttgtctaactcagccagggtaattagcttcaacagttgatgtgccaaggagaatccagtttgtcttgtggcataaattttttggcggcaaattttcttcaaaagagatggcggcaacttgcatacttaaattaaaattaataagaggatactcctattatcctatacatactatagtaatgttgtattcttgtgtagtgctactccaaaagtccaaatggtgccatgaattgattcttctgctatggaactatggcactataggggaatatacatagatcattataaaagatcttgtatataggatgctatgcttttaagaatgtaatcatttcaattgtgccatgccctaatatgtgaagggtgttcttttacactaacaaatgatagtactagatgtgatcatgtcttttgggtcacaaa

SEQ ID NO: 78351 - DNA, 12785 bp, Oryza sativa
agggctcatctgcaagaacaaaccgggttaagctacggaatctgttagcagccgctgaaggcactgacctactaaaaattatgcaatcgaaggtaaaacagtatattttatttgtcaagtgcaaatgtttctattctgtgaaatttgaaatttgaaaatggtatacagtcaaggaagaagcggctacgttttcaaaggagtaagatccatgaatggggtctggtggctcttgagtctattgatgcagaagattttgtaattgaatatgttggtgagctgatccgccgacaggtaattatgacttaatgaacaacgatcccttcattgatttactgcatttgagcaacatgttataagattgatttatatcccacaggtctcggacatacgcgaggatcaatacgagaaaagtggaattggaagcagttaccttttccgtttggacgatgactatgtggtaggtgtagccagtttccttcaactacatccatctaagatgctatgtacatttttttacttcttttttatgttcgcctattagacaacagcagagttagttggtttttgtttgttttgatgtatggtcaggatagttctgttgttttgtaacctcaacctgttctatattgtgctctttctttaccaaattttatgagtgcaccttgtgctcttctgtattaattgtgcctattttcttaatctttgaaggttgatgctactaagcgtggtgggttagcaagattcatcaaccattcttgtgatgtaagctgtttaacatgaaactttcagttgtgatgcttattctatgctaaatgacgtcttgtttttcctaccagccaaattgctatacaaaagtaattactggcgagggccagaagaagattgtcatttatgcaaagaggcgtatatatgctggcgaggaactgacttataattataaatttccactggaggaaaaaaagattccatgccattgtggttcccagaggtaaatctgcttgagatagattttcaagcatgacaaacttgtgccaaaacataatgttgtcttgtcctgaagtagtcactacttaatgagttttagaaagaacagttattttattttatgctatgtctgaagtatgacgtttctatggtatacatacatgccaaatccaattttttttttaaaattaaatgcttagttcgttaccccttttttcataaattttgctaacagcattctgttatatatgtttgaaacgagcttgtaaatgctgttgccaaggttgcatattttatatttaccattgattatctcaactgtggccttggcctagcctagattgctactctcatggtacagcattttgaatctttggagttgcataaacacatttcttgttcattgaatgcaatcacttgtgctattattgatgcaatacatatttttatttacctctcccgctaactattttccggttgtttaggtgccgcggatcaatgaattaggaagtaaagtttataagtcaggtaattgttacagttaatatttgcaatgtaaagctcatagtcatagatgagcattcagatcattccttttcatatgcttggccgtctctcctgatctgagcataaaaaacttgtgttggaaactagaattgttgtttggttcagtaaatttatagtgttcatttttacagtaagcgaaaattctgccaacattaaacaacatatgtaaatttgcctcatatggaccaaaattcgttgaattccttccattgtgtattctgatcacttgttatctttggcaggaggtaactgcaattgggtgctaccccagtatgtatgtgtcatgcgtgcttgtcgattgtactgggcagaagttcactgcagaaatgttcttggatttactgacaggtacctgtgcaatctgcagctcatgctatcattatgcaccaaaagggaaacaaaaactgaaggtcattatttgttgagtaaattgcgctttgggctaggtattcttgccaaagtttcactttggatcacccttaagtgttattttttcactttgggctaggtattgttggcaaatgttaatcagacattttggaccgggtgacccacatgcaaatgagacatggacaacagagatggttagtctcattgacatgtgggccacccagtccaaagtgcaacttttgccaaagaatgttcccaaggcggtccaaattgaaactttggcaagaatacataaccgaaagcacaatttactattgtttgtttctagtgacataagatccctactaggtcgttgcttacttaacatttgctacctaccctaaatagatacactgtatttttcatccaaatttcgctgaaggttagcacctgttgtttgctaagatttttgtggattttatccaaatcaattgaactgaagaaaattgtttaaagattaatatccatacagtgaatttgatcacttgggcatggagaagtgattccagggtttaatatagcgattttgttcaagaacaaaattattgcactcacagttagatttattaaaacaatcatgggtaatggatataaatttacttagatttattaaagcaatcatgagtaatggatataaatttaccttagatttattaaagcgatgtaaatttactgcagaaaccttatgtcggtatctccagttccttcaacatgtgaggactatgagaaaaatgtactgtgcatgacaatacctgatcttctggccaaccttcaatgctgtttcaatcataaaattctgtacggcttgttgactttaaaatgacttcatggagatggagttctttattctttcttttgtccatttttcaggatggtaattgtgtagcaaggtatgggatcgtggaacatactgtactgcaaaaagatcacaaagttgctgagctttctggcgcagaagaatttgaacacgttatttatttaggttagatggactaattcgggctatccagaggaaggtaaagcgctcaagtgtggactgatggacttgttggttgccttagtgtgtctcctgaacgaggttcatgtttacttgctgacaaggttaatactgccccttcttgtacaggccaacaacattattacattgactggattgaggatatagagtttacacggtgatttcttcccgggggtacatttgaatgaacccctggtcattttcaattttttttgaagcatctaattacctgtaaagttaaaataaaccctataccaataccaatgaccataataatatctgtcttccccttttaaaatgtgtgctgtttgcactaaagtaagtcactctgatgccttgccattctgtgaatatagcgaccggattagccatctcgtttgcacataagaaatttgcagtcctgcttcatgggcctcttctgcatgtgccaacatccagagtcaacatgagtgcagtttgggcttctgtttgtatatatatcatttatttataatcatacagtacccaagatgtggttttagtttcagcagggcaagtctactgcttttgagaccattcttgatgagaccatttcattttcaattaatgtcatgctaaatcacacttccatgcaagcagattttacaccacttgtatgctataaatcacacttgtttgtgtgagccaatcaatgttcatggacctactcctgttgttgctgcaggtacatggatacatttaatctatcatccgtggtgtatgtgtatgtatttcgtccagaaaaaaaaaagcatccgaatcatgtggtatgtgttccattactttgcttgtccggattctttaactgttaagtacggggccatgcgcccatgccttttttatttggactgctcatgcattaatcagccacagaattaccattggcaggtcaggtggatacagacgtgcatgaatatctgatatcacaatcgtaagtatgaattcaagtattttaccagcttatatgtactttgtgcaggctaacaacagggcaaaagcaagccactaacaaccaacccgttccaaaaagaaaagaaaaaaaaaacaaaggtcctggattttgttatatcaaccgacagaaaatgaacacattcttagatatgttaattagttagcgagtactatattgttattagcttgtttgcctagtgggaaccgaaggtgcactcgtagaccagcatgatatacgtcgcataatcatcttcagctcaggaggaaactaggcgtctagaccgtcccaagcaaatcaccagtcgataacatcccttccctcactgttttttgcggtttctttattctttttttttttggctatttggaatagctgccacgttttttttggcaacagtgctccttgattggacgagcgaactggctgcacgagagtccacggtaatattgctgttcacctgataccaattgttgctgtatgttagaaaggttttcactgtggaagaatggaagtgtttagagagtgagaaagagaaaagatgcctcacttcatgaccgcagaaaccatatatattaagcactacaattccaacttgggggtacgtaacgtattattggcacaaagctatgaccctttcttcctaagcccaaaatccttggacagaagaacgatgagcccaaatatacttcggtgcagtacttgtttttagagtgggctacaatacattgtcaaattactgttatacaatttaaatttaaaatgtgttttgtacaaagggaaatgccacttatgagccattttcagtgggtcaatagtaaagcggtccaaaaaactgtttaaactaataatggatctgacgaaatagttcaagggtgactagaaaattctctatgtttgtgttagcccatagcatacatgtccagtgagatcacaagtgaatgcttgttactaaattgaaaataaaaggagaaaataataatggaaaagtatggttcatgtgtgtcaataaggtgtcaacggccttgtgctcggtcggaagagcatacaaaggggatatgcatgggatggaggtgaaattccatgctcacctaatcactttttggtggtcggttcgaatccggcaggccgtcatatgcatgcctatatttatgtcattgctaattctgatttgttattattttttcaaagttatccgtaggttatagttaggtcaatagcattcggatagctcattttttattctttttggcgacaaaggacatgtgtaagtaggagtattactcatttcatcccaagatataagatattttgattggatataatacatgatagtactacgaatcttcacagaaatcgaaccaaaatctcttatgttttgaaaggatggactagtcaatagtcgtcgctattgtttcaacaaaaaagaagtctatataattcatgcaatttttgtgcttttgtcttgggaagatgtattgtaaaggcagtcgaaaaagaaggaaaaataagttgcacgttaccaaagcagttctctttttgttgtatgcaagtgtagcgaggccttgtgcaaacagtccgtgcatacaaggcttggttttctacgactttcagcaatgttaacttggagtcaagttttttagaccgcattgtgcacacagctacactgcaatatttttgtttctccggctgattcctgtatctccactgtgtgctctttctaaggatatagaagtagaactattccattcagttcgtaaacggttcgattttcacataatcattctatatataaattccttataaagaactatatattaaatatattttacaactttttaattctagttaatttatccgtttgtgtcgttgaatagttatcacaaaatgattcagctattcccaaaaaaaggctgaatcattgtagtgaaattttcgtatattatatgagcgaaatccagtttttcaaatataatccttgataatataatcctcgataaaggccatgtttaaatttcaaattttccgtcacatcgaacttttctacatatacaaacttccaatttttccgtcacatcattttaatttcttccaactttcaattttagcgtggaactaaacacagcttaaaaaccttctgtttttcaaatattggccgtgccgtgtggcttctcccacaaactgcttactaattttgtacccgtcttcccctcgtaattaacccaaaataaaataaaaacaaacaaaaaaggaaactgatgcaaccgcccggtgccagaatctgctagcctgtctcgtctgtgctgttttacagctgcgaacggtgggcccagggaatattcaatattcaccccagcacgaatcttgacgcccaacagattcaccacagacttgacctggaatcaaggcaggtgcagatctgaatcggacggccgagattccctccggggctgtgtgtggactggtatcaggcagacgaagattcctgaccgttggatctgaatcgaacggccgagattcccgcaggtaaccccccccccctactcatcagctatatatacgcacactcgcagccgcgatctcgctggctaaacctagtcgcaggcgcgcagctaccttcctctgaaatggcagccatggcggaggcggcggccggcggcgaggtgcggcggcgaggggggtgctgcggcggcgggggaggcggcggggggttgttcccggaggagtcgttcgcgagctggggcgcgtacgggagggcgctgatggagacggggccgcggctggtggagcggccgacggcgaggtcggcggcggcggtggaggtgaacgaggtgagggggcggagcggcgcggagatgaagaggaacctgacgtggtgggacctcgcctggttcggcgtcggcgccgtcatcggcgccggcatcttcgtgctcacggggcaggaggccagggacgccgccggccccgccgtcgtgctctcctacgccgtctccggcgtctccgccatgctctccgtcttgtgctacaccgagttcgccatcgagatccccgtcgccggtcagtgatatgatcatctccgcctctgcatgcaatgacgtcaccttttctggatgattatgccttaattatacgacgttgattaatacactatgtaatatccgatttattattcatgtttaatctggtcaggaatacgtcctggtggtggtgaatattcaaacagaataaaggagattgatgaattaattagggcctttttagaacgtgatcgatactctctcacacatgcactgcttctgtaggccattaattaatcgaattaattctcatcaaactttctaattatcagattttttttttgtgttttatccttggagagataaggaaattatgataatactatatattttaaggcggcatgcatctgagtataaaaaagaatgctagatcacaagtaaacactgaaacatttttttatataaagaacaatttttttatgtgagaaactaaattaattatgttactccatccatctcaaaatataagcattttgggactttaacacaattttcgagataatattttgaccaacaatatctataaaaacaagggtgaatagctaatttagtccctcaagttttaccgaaggctcaatttagtccttcacgtttcattttgtaaatcatccttggacccacttaatatgccttatagctatttctagtcaatatttctattagaaaatgtcccttttgcccttaatttgtatacaactataaacccaagatgaataaacaacattacaaatgtacttttcattatttcaacatgtgcacatgaaacataagcaattgctatcgtatacacttgctagtacataatttatttttgttttatataatttactatgcattatctataaaaaaaatttaagcatgcaattttatcttatatatgtgaatgatgagggggtataagtgtcatttatcgagagaattgttggttattgataagtttgaactaaaataaaaacttgaaggactaatatggatagattgaaacatcagggactaaaccgagcctcagataatacttggaggaccaccttagctattcgccctaaaaataatatgttttagatgaaaatggttgcacagtatgatatttttttagtgataaatttagtaacatcaattttacatgattaatctttttttattattaatagttaaagttaaaaatatttgacttagcattatcctaataacgcttatattttggaaatggatggagtaatttattgacacacgatgtgtgtatattatatcactgtgtcacatacgtttgacaggtgggtcgttcgcttacctgcgagtggagctgggcgacttcgtggcgttcatcgccgccggcaacatcctcctcgagtactgcatcggcggcgcggcggtggcgcgcgcgtggacgtcctacttcgccaccctcctcaaccaccgccccaacgacttccgcatccacgccgcctccctcgccgccgactactcccgcctcgaccccatcgccgtcgccgtcatcgccgtcgtctgcgccctctccgtcctcagcaccaaggcctcctcccgcttcaactacgccctctccatcgcccacctcgccgtcctcgtcttcatcgtcaccgccggcctctcaaggtaggggtgcaagagggtttatccgtgaacccgtttatagacaaaaatagtgtaacccgtcgattgaactagcgggttaattatgaatttgatttataaatggatttataaattgatccacttatatatttagatgcggcaagccagaccgcgacgcgaaaacccataaattattatttatttaaacttgcgggtcggtccgtttgcacccctatctccagggccaggctctccaacctcaccgccgacttcgcccccttcggcgcccgcggcgtgttcgcggcgtcggcggtgctcttcttcgcgtacgtggggttcgacgccgtcagcaccatggcggaggagacccgggacccggcgagggacatccccgcggggctcgtcggcgccatggcggtcaccacggcggcgtactgcgccctcgccgccacgctctgcctcatgcagccctaccgcgagatcgaccccgacgcgcccttctccgtcgcgttctccgccgccggcatggggtgggcaaggtacgtggtggcgttcggcgcgctcaaggggatgaccaccgtgctgctcgtcagcgccgtcgggcaggcgaggtacctgacgcacatcgcgagggcgcacatggcgccgccgtgcctcgcccgggtgcacccgaggctggggacgccggtgaacgccacggtggccatgctcgccgcgacggcggccatcgcgctgttcaccgacctcggcgtcctcgccaacctcctctccatctccacgctcttcatcttcatgctcgtcgccgtcgcgctgctcgtccgccgctactacgccaccggcgagacggcgcgcggagaccggaacaggctcgccggctgcctcgccgtgatcgtggcgtcgtcggtcgcgacggcggcgtactgggggctgggcggcgacggcggcgggtgggcggcgtacgcggtggccgtgccggcgtggctcgcggcgacgctgttcctgcagctgagggtgccgatggcgaggacgccggagaagtggggggtgccgctggtgccatggctgccgtcggcgtccatcttcatcaacatcttcctcctcggctccatcgacggcaggtcgttcatgcggttcggggtctggacggcggcgctgctcgcctactacttcttcttcggcctgcacgcctcctacgacaccgccaaggcgctcgccgccgaggtcgccgccggcaaggtggaggaaggcggcagcaagccggcggtcggcggcgccgccggcaactgaaaaaaaagttactattatactattactatccactgaagttatctatgtgtagatagagaattagtaatatttgcattgtcattgttaattatcatcgggattgctaaaattatggcgctacatttttttactttcagttgttttttttcctcgtgtgattgtcatctctcctgtatgtaaatatgatctatcccattatcttttgcggttggttttatagtttaataatagtaatttatgtcatcatgtggcaaattgtggagtgatttatccttttcctttagtttatgttcataagtaatttcatccaaattaaatatcctggtctaaaagctgtgttcggcaatactatcacattgagtagaaagctcactcgttatctgcacgtacgcttcctaacttttaaatggtaaaattattttaaaaaacatattaattaattattcaaatttaaagtaattaatacttaattaataataagctaatgcctagcttatccagttttacatatcttctcctttctcctcttactctaacgtaggcacgtagcactgtagcagaagaattcgcattggtcacatttaggggggaatcgcgagacgaatcttctgagcctaattagtccatgattagttataagtgctatagtaacccatatatgctaatgacggattaattaggctcaaaatattcgactcgtgcttttcaggcgagttatgaaattagttttttcattcgtatccgaaaagccattccgatatacggtcaaatatccgatgtgacacctaaaaattctcttttcgtgaactaaacaggccataaatgaaaaggagaaatttgtgctattggaatttggacctgacgagatcacgagatgaagaaactggacttttgttgtgatagcctatttgaccacattttcctctgatgtgccgtagcgtggaccaaattttgttattgggcctccaggttaggttttgatcctgccggggcctcaatgatgggccatacagttcatgggctcgttataatgggccaagatgtttgtagacagatgctgagcttgaactgttcctttcttcttctttttattttttattttttaaaaacagcttgaactgtttcaggcttgtggtttgtttgatactctttttctggcagaagctttatttccaactagttgtttaccactttacccacgcgctttgcggctggttaaattgaagatagtcgcaataatattatgttgcagctttaataataataataataataataataataataataataataataataatattattattattattattattattattattattattattattattattattattattattattattattattattattattatgttgcaaatccttgcataccctactagtaacagataacatagaatgtgagatacttttagacaatagaaacgtattacatccccgacagcataccgccaataagtttatttgactgtaaatacaggaaatatgatgaccgggaacccttgtcattgcatgcaataaaattagcaagaaccaattcaaggaatataactagctcagtttctttttcataattcaggtcccatcgtattgtagaaatctaatttatatgtggaaatcgaggttaaccagactctcggtctggataagaaaaagacagtgttgggttaaatcctcgttccttttttcccccctaagagaaggcccttgccccctttttttttttaatatattgatagagaaggtcgttctcgttcttggaattctatggtggattgttgggtcacatagtgcgtagctactctgctggaagcttgtgagactctgtgttgcgtgtagttaatggtatggttttgtaaaattttagaaccgtgatactcatatatcaaaaaatttatgattttatacaacttagactataaatagatccaaatatttactaatctcagtttatttttcacacatcctactatcccacgcataccaataaaaaacaaaatacacatattttatccaaatcccgatacaaatatttcgcactttatgcactcccggtaatattttactttccaaacacggatgcaatgattgtggtaaaatctccctttgtcccacaataagttcaggcctggtttagtttccaattttttttccaaaaatatcctatcgaatttttggacacatgcatatagcattaatatatattaaaagaaactaatttcacagttgggggggggggaaaccgcgagacaaaccttttgagcctaattagtccatgattagcataaaatgctacagtaacctacatgtactaatgacggattaattaggctcaaaagattcgtctcgcggtttccaggcgagttatgaaattagtttttcattcatgtccaaaaaccccttttgatatccggccaaacatccgatgtgacatccaaaaaatttcttttcacgaactaaacaggcccttaatttatctccttacatttgtgccgacacaagttcatttttagagtaatcattgcatcagagtttataaaaatatggaatatattaagagtagataaagtgaaaaatagttacattgagatttgataattaaagtatgtattttatatagtctttttgattttgtattggtatgtgtgagatgtatgaaaaataaatttattttgagacggtggcagtactcgctccattccatattataagttgttttggtctttctatccctcgtgtggattaactataaatttagacacatatatgaagcacacacataaattaaattcatgcatgaatccattaaaaatccaaaacgtcttgtagtg

SEQ ID NO: 78352 - DNA, 11862 bp, Oryza sativa
cccatgattacccggttagggcagccacaggcaagaacagatttcgcaattagggtttttaggagataatttttccattaggcgccacgacggaacgggcgctacaggaacgcgtggcgtgtcagctctcgcgctcccgcgcccccgccgacgagaaccccgagctcctcagtccccacgcggcagtgctgcaccgccgccgctcccctccgtccatccgcctccccaagcggcggtgctgcttgcatcccttccttcgatatttgcacgtacccctcgcacttcattccacttcggttgattccttcaccaccccccccatggcagtgcttcactgctgcttgcatcccttccccatgtgcgtttttcttttttttttccttgatgatttccttgttgattttttttcttcggcttatatggataatatcgattcccatgtcccattctcttaaatctctccaatttcacaggtaccaggtaccacactatgcagttggtaccatactgtaccaagtaccagcctgtgctgtgctgtgctgcttcggctaattcaaccaacacagttagaggtttacatcatatgattcatcctcacatccaaaagacaactacatctgatagtagtgttctacatcatatcaatttgataggacaacatggtccagaccattagaaccttcccaaaagacaaccgcatcaaatggatgccgcaacagaacctttcttctccttccccttccctcttgctcttggtggtcttgttgacacatcatttgcattgccactgcaacaacaattctataagtcagtacctaaatctgaatacaagatgcaaatagattgcaaatgaggatggaattaactagtaagaaatactaattacatggatgatccagtagtattttttttgtttgacctaggtgttgcaccaggagtattgcttccttgatctgaggatggtgttgatgaagatgaccttttcctgtataaaatctggagtgagcagccaatttacaaatgaaaggaaaaaaaaaaagatgacaagtaccttttgctagctataggtcctccctgacatgtctttgcaaagtggcctttgtcaccacattcagggcatgtcctcttctttctacagccagactcatctgaagctttaatcctgtgtgtcctaggccttccaggctttctcctcaactttggcctcatcaatttgaaaccaggatctacaaatgtccacatattctttgatgtcattgggttccatatcccagcatatgtttgcctcaatctttgcactgaatagcactcatccacatagccattcatgtcaggaaaccttagagagcctatgaatgccaatgcatggttacaaggtttcccacttacttgccaggctctacaagagcatgtatgagcctttaggttcactgcatgcctccataccactcccttgttggacaccacagaaacttcagctaaatcatcgcaattactccttaccacattgtaatcttttagattcttgctctgttcattcagtgtcttaataatagatggaattattcttccttccattttgcttgcaagttggctcctcaagtgaaatttgtcaattatcatttgcctaagtgtgtcaaataagtccactatgtgtaattccttgatcttcatcacccaattgttgaatgactcagaaagattgttgttgatgtagtccacctttgaaagctctgagaatttgctcctactccaaaaaaatgggtgattggtttttaaatatgcaatagcttcaggagatttctcagcaatcttgttcatgtgatagttgtactgctggctggtgtagcacttagcagcaggccacatgttttcaccaaaaagtggtccatggtactgcttcttgaagttcttccacaggtgtcgcatgcactctcggtgctcagcagttggatagacatcactaacagctctctctagtcctttcccagcatctgtgctgatggctagcccaggaggattaccaatagcattcttcaagttctgcacgaaccatgtccaactctccgttgtctcagcttctatcacaccaaatgcaacaggaaaaagccagttgtttccatctattgcaacagcagctgccagctgtcctctatgcttccctgtcaagtgtgttgagtccattgcaatatatggcctacaaccttgtaggaagccatcaatgcaaggtttcagagctatgaacagccgcctgaagcatacttggtcttcatgaatctcggtatcaatatcgacaatacttccaggttgtgccttcaaaagctcctctctaaaagtgggcagcaatgcaaagctgtcttcccacttcccaaatatcttctcaagggccttctctttgcctctaaaaactttgtcatatcctattgtaaatttgtacttcttctctagcttgaccttcaatgcactagctcctagagttggagtctccttcagccaatctataactctttcagcaacccagctatttgttgccatggcagccccagtcttatttatggaacaacaattgtgggcaggcctatttaccttgacctgcacatataacaatgtaattatcagctttttatgcatcaaatttaaccatgaaatgataaaataattaactgaacatttcagcacaaatttaccttgcagccatagtatttcttacttgtagaggcatgaaacctccatttacaaccctgctcttttttcttgcaaaaagctctgaatctatgcttgccctttttctcagtttcaaaagaatagtcatggattatagcatggtgtgtaacagcttccttgcaagtagtagtatctgcgaacacctctccttcatcaatacatgggttatcaaaatcatatgcaaacacatgctcaaggtcagagtcattgtcatcgtcatcatgtatttggtcatcaagatcatcacaatcatattcagagtcagaggaggctgctgcatcactatcatagctgctatcactatcaacctctagtgggtcacaatttgggcatagctggggctcctcctcttcgttctcttccttctcatcatcccgaacctcttcatcatcgtcatcggcttggctcctcctctttgcacacttttttacaaccttctttgcactctttttaataggggatgtggcttcatcatcaggatgtgaagtgctctccggatgggtggtgctctcattttgggtggatggtactggttggatggagttctcaagatggttgtaactctcaggcagtgttagtggcgtagcatcaaccaataggtcagtaaatagtggtggagtacatggaatagaatacctcacagatgggtggcaccttcttttagttggtgaaggttcaacttgcaatggaccaccaaaatcattgacaatggcatgaatattgacaaccccgtgctgattacccttatccaaccaatctagcaattgtgaatctgtggttatctctactttactctgagttgacacatcacccaatttccaaaagctgatgtattgatttggcccccagttaaaattttcccctacatcgtcaactagcgcaagcatcgaatacctatccctttcgatcgaaattttgacattgtttcccttaacatatgtcctttgactcaaaagcgatgtggtaaaataagactcaaccttaataatggctgtcaagaagccttggtcattcctacaggataagtaaaacaatggagaaatattctagcagctcaacgaggaatagatgaaaaacctacatctaaatatacagggactgaataactaatgcatggaagacctatctaacagaaatatcataccaatgtaaaaacatatccagcttaaactacttttaacaaagttgtaaacatatggctactttcttatattacttcatgctaccattgtttgatgattaatttattaaactcactatctattaattcaaataagcacctaaggtggagaggccgttgtttaattacaatgcacagcatattcacacaaagagatattgctaatgcttgattatatcctgaagatacgcaagcaagatatggttagctatgcacatgctaaggttgcatagcaaaccagcaaattcggactcttgaaccagttgaacaaggattaaaaacattcaaaaagaattcctcaaaacacacacatatattgttggtaacatccctacatgatagatagaacaagtaggtcacaagcataagtatagattatatacctttccatggtggtcctgctgctactgcccacagtagccaccatgctgcttgaagcagctgatgctgcagcctgccgtcgatgccgacactcgctgcagccgcgtgccgcggccgcgcgctgcaacctgacgccgcccgacggagccgccgcaagcgaggtagccgcgccgcagcctgacgccgcccgctgcaggtgccgccccaagccgccgcaagcaccgcagcctgatgccgcccgctgcagccgtcgccccaagctgctgcttgacttgctctactcgccgaaatccatctgcacctcttccattggcatctaatacttcaaagcgaccgatttttggttgatttgctcctagtttgagagaagggatgagaggatctggggtttagggttcgtcgtgcgggaggagaggaggagttctgatgcggtagagttggggaagaacacggataaggttgaatctggcaagggcaatatggtcttatcgcgttgccttgttttttaatttaattacatcaattaattttgtcatcttactcatacggaatggaacggtgatggcatacggaatccacgcacactgcttttggtggtatatttgcaattcgtgattttataatggttatttcgagttaaggagtgaaagtagtggcaaatatgcaattctcccttgtcttttggatgtgaggatgaatcatatgatgtgaacctcaactattgtcatttagtttgattatgttactgtgttcatgccagaatgacgctagttgactatgttctcttgcttgttgtctcaaatggtgttttattgatgccaaaatgctgtcaatattacaatttcatgggcaggggcattcttgtcctaattttcatgaaaaccagccatataacggtgttagtctaagctgtgagtccagtggcagttatgttgggttcaaactgtttttaatggcaaatttgcaattacagtttttttagtggtagatccacaatacctgttcaatccagtggcaaatatgcaattgaccctagttaataagggtgtatttagttcacgctaaaattgaaagtttggttgaaattggaacgatgcgacggaaaagtttgaagtttacgtgcgtagaaaagttttgatgtgatgtaaaagttagaagtttttttaaaaaaagtttggaactaaactcggcctaatttagccttcagagaccggtaatttttcttcaggttcaccggcgagagcagagcagcggagacagagctcatcacaaagatcagcagagcaaccaacccacctggagtctggagacgagaccccccaaccgcccaagccctaacacaccacgccgcccgcgcggaagcgcgagatctgaatttccgaagtccggaacgccgcggccgccgccgatggagatccccaccgacgccatccaccgcctccgctcctccctacgcgagcccttctccgcccccgcctccgcctccgcgacgccgcccttcccctccgtcgcggacgccgtggccgccttcgactcccgcgtgggagtgggcgccgcgggggccaccccccggtgcggccgctgcggggccgcgggggggctcctccgcggcgaggggtccgccgtgtgcgcctactgcgggtgccccaggcgggaggggtgcggcggtgtcgccgccttccgcggcagtgtggcgtaccggtggctgctcggctcgctcgggctggatggatccgtgagctttttcttctcctcctcctttcctcatttgaactggttgatctgctcttgttgaatacttgaattattggtgaatcgagtgggatgtgtttttttttcattccattgaactaggtaatttattagaaacctaatctcaagcaaatgctgaatgcaaatcgaagactaggcttttgttctaaatgaagaaaatttaaggtagaaactttagcaaaattttgtgctgaacagtagttgggcaatacctagagttctttccaaaaggctattaaaatgagaaattcattaatttgcaaatgttctgtatcactagtacagaaacatggtttggaatcccggaaatttggattgttcaatagcatgtcctaaaaaaaattcttggctacaacgagcgtcgagcgagctaaataacaatagaaggaccccattatgctatctgctgcagcacatttactatcaagtgtagtccatgggaacttttcttagttttcaatgccatataattgatttttttcccactcaagcttatgattaatgaaatctttggatgcaacctgattacctgaatattgggaattttaagagattggtactgtacagaacacattggaaaggtaatatgcattattggataatgaaacatctattactacaacattgcttttatagtgaacttaagaggaagaacaaagatttgatatcagtatttgatgttatctccgatttgttggatgcgacacttgaatggcgagagggcatgctgtaggtatctataattatgaaacacttaatttaatttgtatactatatcatagttttcatgcttattcactctatgcatgatttggacctacttacataaagaacatatataatgcatagcatgcaaatgaatctcccaaaacaaatatatagaccatcagaagaagtggaaattaaggcgtctctatctttatctttgcttcaactctgtgtttatgattttcattataattacaagcttaaagatttctttaaatgcaaaaaatatccatgttcaagtttcttgttttgccccttttcccatccaggagcctgtagaatttgacaacgagtctactgattcaagtaaaaccaaagaagcactgaagaatgggatggtcttatctgatctgctggaccttaaactttccttcccccctgagaataaggaaacatctggaagtaccgaaaacaatgaacagtcatctgctgaacatatgctaaaattatctggtgttaacctagactcatttttcgctgcaagaatggagaacacaaccactgctgcagttcctactcaaaaacatactgtggtgcaggaaaaacaaagcacagatagtcatggttcttccagtttggagatgcgtgctacatacttaactggaacgaaaacaagttctcaaaacacaaatcaaatagaagttactccagcatttgcaaattgggatgctgactttcagtctgctagctcagaaagtgtcaccgaggactccaagaaatctgacctatttaacagcgcctcgaatgtcaaggcttctagttttccagcacatgtaactgccatcagcccagttgtacctagtggaaatgaaacatatatgagaagtaccaagctagaagattcaaaagatttggcttcagcaagtggcatgctagttaaagatgaaagtaacagtggaatctttcctgagaacaatattgctgagttcaccgagtcctcccttagcaagagttcagcgcatagtgatcaattgcctgcaaggggtgatactggagtcggtatagatgaagcttttgatgactggcaagagtttactggtggaaatcagggaagcctgtcgaatgcaggagaacatatggaggggcctatagagagcaacccctccgaaataaaaaccgtagatacctggcctgttagtagcatggaatcatccaataatgttactgacaactctgttgatgattggcaagcttttacttccagctctggtcaaggaggaaattcggtgaagccaatagaagggtcagctgctagtcaaggaggagatgtggtgaaaccagttggacaaacagcaagcatctcatttgaacatttttcagaagctaattctgttgagttatggcctgtgggcaatattaatgagcttcataataccaaagtagtaaacgaaactaatgattcttttgatgattggcaagattttacaacctctggtcaaggtcaaggtgcaccatctaatcaagttggaggcatgattgaagtctcacgtatcactcagaaagaaacaagtgatgactcatggttcacaacagatgttaaggaagaaataaataaagatttagtgaatacaactaatgccatgttggacgattttcaaagtttttctggttcagatctagcaccacaaagttcatcgtttgtaagtggagaaatgatgaatccttcatttgggcaacatgaaggaactgatactgtgcaatcatggttgggtggcagcaataatatgggtacaaacatggccacaacaaatagtgaagacaattcatttgatatttggaaagattttacaacgtcgggtcatcaaaaagaaaacatttctatttttgagagaaaaaaaactagcacatcatcagagccagctaaagaaactgatccaatggatttgtggttaaccagcaatgcccaggaatctaatagcagcaaagatgctaatagaattaatgactcatctggtggatggcaggattttgctaattttggtcaaaaagaaagtatgaaaattcctggggtagggcactctgcgaaagattcttcaagcaattcagctgaacttaagaaccatgaacagataaatgaagatagtgacccatttgatgactggcaggatttcaagaactcacatccactggatacaagcttacaagttccatcaaattcttcatttgataactctttagtacggatgcctgatgcactagaaggactggaatttgggagctttgcacagtctgttccatcccaaagccaaagagataataaggagaattctaacgaaacaaatacggtttcatccaatcataacttagaaaggttggtggtttttatacagtgttagacttttcacattaaaatgcattttaattcatatctgtgtgcctattccccatttgatgcttgtgcatttgatatctagcactagttacctggcaacatttattggttggaagatgattatactaatctatgtggtgaaagaaagataattattggactaacctgagatttatgttgtttttcaattgtaaacaattgaaactcatggcaccagcaagctctagcagtttgtctaatcatgacatttcaatgttcatccctgatcacctaacgtgccttttagtactctttgttactcttacctctattggtcattttgttgttatactcatcagatttgctgaaatacctgagtgtttgtaagatatttgcagttcatgttgcacagcaattccattgttaatacattcttcatcacgttagtaatataacatgtttccatcatgtgcaggatggttggaaggcagcagacaggcgatttgggttcactgtctaccatttggccaactacaagtcatgacacccaatctgtttcaaaaccggaatctgctgatgcaaatgtagagagactgctgtcgcagatgcacgacttatcctttatgctcaaagatgatctgtcgatccctgataaacctgtaggtcattataagccttgaaaccatgtgtgctttgctacgttctcccaagattcgcttatgttggagttccagccttttgattgtgggacctaacatgggaaaatgggaaatagctcgctgatgtaagtgcagacaaccttgttctcccttttacagcagccttttttttctgagagctacagtgcattgataagcggagatttatactggtattctctgttgcttgccttggctagcagagagctgcagcaccttgctcctcgcttcagtttcagattcagatgctttcattgattactgcttcattgaggcgagccacgaattctgtttctgcaatgtgtatgtaccaattcacggcctgtataaattgtgtatggaacgcaaaaaatgagttgttcaattctttttttcccctctgttgtgagattgttgaggattgagatttacttttgacgacctcgttacaccctttgtcttaaaacataatgtttgtagcggacatctttgcaccttaactgcatcatcctcctaagaaaaccatgctactggcctatttggctgggagaggactcggtttgaaggatattcaaaaatagcgtgtgtgatggagaatccgctagagtatgatttttcacctccatacgctaaacaaaggatggatggccggatagaagccagcatgctcttacttcctgtatgcacagagattttgttaaaaaaatggtttggaaataatacacaatttgtaacacaacagaacacttttatacccatgttttaagttgaattaattagtgcccaatcaggcgtgtgcttgctgtcgcaggacagggtgtaagcgacgttcacagggtgtacgaagagccatgttaggttgggggggaccaagaggagcagaacagcagcaaaaatgggggaaccgaattgattccagtttatcttttcttttaggtgttagctagaacatcgttatctagtttgaactcatgctttttgctcaactacgtccaagtcaaagtaagacgacattatatgaaggccatgttgagaatttctatctgaggtcaggcggcaaatattctccctttgacataaagagttggcaaatattccaaccgagttttactaactggtttcaggatcaggaataagattgagtcatagtttgtttggaaaaaatacgaattaccccccctccgaactatcgtggtcgtctgaattacccctctgaaccacaaaactagatattcttcacctccagctatacaaaccggacgaattaccccctcgacccaatccacggtgttttggtctacgtggcatacacgtggcatcacagtcagcgtttttttaataaaaaatggtgggacctgcatgtcatactcttccactttcccctctctctcactcttcctctcttttatctctcactcttcgtctgtctttctcacggatcggcggtggcgggagacaccgatgggcgggcggcggacggcggtattcgaatgacgggcgagcggagacgactgtggtggcggcttgcggcaccacgcacgggggcgggcggtggaccggggctacaggcctggcacacaggggcggaccgtggcgttcctgtgaccggcaaaccgaagtgacttgcggcggtggctgcctaccctttttgggaacaacccccggccccggctttaccagttgacggcaccgcctgcggtgggctttactgggccccaacaactcttctatacccccccctgcactttggttccatttggtccccttccaacttaagctgtcttccctggtttctcctaggctaaatttttcctccgctctttatgttttctcttccgttctgcgccctccccttcatattgttttcccattttcgacttactgcatgtcttcactcattctttgattcctcttttctatcttccttatcaaatctgtatttttctatctcctctatccattcactattcttatttcattaatctcgcgccttttcgtcttctcttactctcacactttcgcttttctatcgaaactcactcagctct

SEQ ID NO: 78353 - DNA, 2782 bp, Oryza sativa
  unsure (1)..(2782): unsure at all n locations
gatttttganttgaatggccgntgtgtgatggattccaaagtgtatcataacttgtaccctctactgtatcagagtacaatgaagctaatagatatttcctgttgaattgtatttatatgtgcaaactattacaataatcaaacttatgtattggagactgtgattcggctaaaaggataagtgaaaaaaagatcatctttgctccctcttatttatcccaaaataagatcatctttttaacaatcattacattagagttgatgaaattagagaacaaatacattagaactaaaagtgggaagcaatgcattgggatttaataaaatgtggatttttcaatctttttttctattggtatgtatgggacgagtgaaaaagttattttgggatggaggtagtattcaacaaccttcttgtgttaaatccgaaccattaagaacttgagatgccgattctcactaatcttggataaattggcacattttgagtaatttccagtaaattgaacgaattcgagatgacgattaattgacacattttgagttattttcgataaattgaagtcagctctagataatcaaaacttatcaagattgtaaaccatgcttggcacagctccagcagagctggagttactgcttcataatttcacttcagaaccaactcagagttaaatttaggagttaggcactaccaaacaagccctactcattactgtacttaggagacgactctcggttgggcgcccgatcgggagggggtaaaatcgggctgacgttagcgccgatttatgtacaaaaattactttaaactgatttttctcttaaattacttatccaaatcatgatccgattgtaccattaaatttattgcaattaaatctttaaaacaagaccacacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattcccttattaggggatttccaaaatatatgggtgtttttttgttgcaatggagtatttcagttcactgcaacattagatctatacatagtgaaacattgtgaatgtactagatgaaacatttttggtggaaaaaaataaaccaaattatcttaatagatggtttcaaaaatatgtaggttttttattgcaatagagttatttgtgtgtgaatacgtggtgggccagctggagggcaggcatgcgcgcgggggggaggggggggggggagcgtaatcattatcgtacttctaattttctctttcaagaatatgatgtgtcaatttcctcaggacctatcctgaactcgcgtagcgatggcttcttcccaaactgcccggcccatctggcccgcgctaagcccaaatcatttccagacaaccccaaaaaatccagcaccttctcgcaccgccgccgccgttcaccggagtctccctaactaactaaacccaaaccccgaactcgccaccgcctgtccgcctccagagtcccaaccgccgccctcgccgtcgtctcgtctcgtctcgcccgcctccatggcgacctccgccttcgcctccaccttcagccccttcccgttccccgcccgccgtccggcggacgacaccctcttctacgccgtctactcgctccccctccccaccgccctcccgccgccggacctccacgccgcgctccggtccctccacctctccctctcctcccacctcgcccccttcctcgcctcccacctcttccaccgcgacgccttcgcgctcaccatcccgccgcccgaccacaccggtgccacctccccctgcgcgctctgcgcctccccccccgtcccgcacctccacggcgcgctccgcttcggcgactccctcgccgacgagtggctcggtgtctccctcctcttcgagctcacccgcgcgttcccgagcctcgccgtgcgcgcgtgggactccgacggggagttcctcctcatcgaggccgccttcgcgctcccgcggtggctcgacccggacaccgccccgaaccgcgtcttcatcttccgcggcgagctccacatcctgccgccgtcgctcttccccgggacgccctccctcgacgccgcgctcgccgccgtccatgatgacgccgtcgacacccgcgcccccgacgccgtccaggccgccatacagcgccgcatcgccgggctgcctgagaaggcctcggagaacctccacaccgtgcgcgtcattgtcccggtgcccgtggcgaaggtgctgaaggaggagccttgcttgatcgcccgcgccgtcgaggggttctatgaccgggacatagacaccatgaaacacgcggcgaggatagagaaattcctcaggggacctggcggaaagggggttgagatggtgaggacatcggtgcgcatgacgcgggcaatgtacgcgcagcttgtgcagcagaactttcaggcaccgaggggttaccccatgccgaggagggaggaggggccggagaagtggatggaggcagaagttggggatgaaaaatgcttgtgggtttgagatgatgtatcacgagaggcggcgggagggggaggaaggg

SEQ ID NO: 78354 - DNA, 9660 bp, Oryza sativa
  unsure (1)..(9660): unsure at all n locations
tgggggggggtctctttncccccaaaaataatattttaccccccccgggggggcttattggggctacatattccgcgggcgggacaacacgggggcactatcccctggcgcgatnggggcttcctcccgggtcgggcacttccggggggggtcggatatggnggatcacttccctgaggagtggtcgggtgtctccttcttctgcggggctcaccggcgcgattcctgagcttcnctgtgcggcgcgtgggctaccgcgggaggattcttcttcatcgggcctgctttggcgctcctncggtggctcgaccgggctctgctcctgacctgcgtcttcatcttccggggcgagctcccaatcctgccgctgtcgatcttccccgggacgccatccatngacgctgcgctcgctgctgtccatgatgacgccgtcgacacccgcgcccccgacgccgtccaggccgccatacagcgccgcatcgccgggctgcttaagaaggcctcggagaacctccacaccgtgcgcgtcattgtcccggtgcccgtggcgaaggtgctgaaggaggagcccttgcttgatcgcccgcgccgtcgaggggttctatgaccgggacatagacaccatgaaacacgcggcgaggatagagaaattcctcaggggacctggcggagagggggttgagatggtgaggacatcggtgcgcatgacgcgggcaatgtacgcgcagctcgtgcagcagaactttcaggcaccgaggggttaccccatgccgaggagggaggaggggccggagaagtggatggaggcagagttggggatgaaaattgcttgtgggtttgagatgatgtatcaggagaggcggcgggagggggaggaagggaaggggagcacatgggaggtttacaggaagagcttggaggcgacagggtgcttcaatggtctgcttcctgggtcaaaagagtacaagagggttatggaggatgcaatgcagtattacaaaagctcgagtttgttttcacgaacaaggtaattttggtatatcttttttaatcttgtgaaattagttctctagtactagtaaattgtcatgtgcgagcatagttggcaaccagttcaaacagaattaatttgctttcagttctcaactttcaaacttgaaaaaaccatgtataattgatgccttgatggtcagttgttaatttctgtgaggtacaatgttacaatcaacaatttaacctgctcaccattagggatgattgttcaattctatcagtagtcagtaaccatgtccatgtgaaatgttagttctaggagtgttctaataatgccatgtgaaattagctgtctagtagtaaattgtcatgttagagcatagtttgcaaccatttcaaacactagctgaatgtccgcgtgttgcaacggaaattttaaaaagaatatcttattatacacattttagaagccccaaacaaattatctctatcctttttctctaatcatctaagctgcttttgcccactttcatatgggaatttggaaggcacatacaccctgacaacaaggacccccacttgtcaaggggttagtggtggtgggtggcagactcaccactcactaccaccattgtagtcttttaaaattgtatagatataaatatagatgtatagataaataatttgctttcagttctcaactttcaaacttgccttgatgatcagttgttaatttctgtgtgaagtacaatgttaaaatcaacaatttaacttgctctcaattctttcagtagtcagtaactatgtcatgtgaaatgttaattctaggagtgttctaataatgtttgtggtatgctagggagatactaagtgctcctgtgcgtcgaattgatgaaatccttgccatgccatactcggctgaggaatttgaaggcagtgaccttcctccgagcgacgatgactcttggttgtataatggggaggatgagttagctgcggaactctgtgcaaggcagcaggaaatggaagagtatgaaactgcaaaacaatacagaaaaagtcaaaggaaaaatgtctcaggcagttctagctcgcagtcaaacgagtttaatcttggagagattacagagtccatgcaagaatttgttcgcaaaatgtcaagctttgagggagctgaagttcctgcaaacaggttttcttctagacttatttaatacctctgtttcatgtgcagtttttcttctattctgttaaatcgaggattgtctacatcagtgattcagttttaattgtccgttggtcttgttcttagataatttaacataagtgacacatttttttctaatattttccattatggataattttccttttgcacttcaatttgaacacaagtcgaaaaagtctaaaccaccatcagagtaaggataggtatgtgatgaagtctgcttaacatgaagtgttcacgttcatttgtcaacaatcaagatgcactaatataacttatcaagtcctataatcatgaatctaaactggctataccatgtaatggtgtatgatacctggaaagtggaagcctaaaacttctgtaattctcttactccaattttagtgcacctttataacttagattttgtccttgttcaactgattgagtgaattaccttattgctatttgatctgaatttttttccctgtttggaaccctcttcacgtttttgtatgctggttgtattggatgcatttcttatatacaaatttcagagcttgcacctgaggattgacatttgactttatcacacaatgttagcctaagatctgcctgtgctaacagtaacccgcattttgtggtccatctctagtttaaacagttgcagctttccatcttgggttttgtatagcatgtttcttatggaatctcagttacctgagcattttagtaaaggaaaaaatagaaggaaaaaatacatactcgaacattggctacttcagggatggcaataggactttgttgtgtaaaagaattccgcacaataacactttatgtgactatcttgtgatacacctgagacatgtcctactgagatgtctgcatctttgaatactcatcaagtcatttttgttcatgtaggaaagacatggaatcagtggatctggatgtcaaccagttcttcaaggccatggaatctgtgctaggtcgttcaaaagatgaacctggcaatgaagccgggtttgatggaaaatcttcatcatctgacatagaccttggtatttcttttcttcatgtcatgcaaatgctatttcattttactgcagttttctgctaggtgctaactcacatggtcagctatttagtattggttcgcccgatactacctcatgaacaaagtgtactttttttgttcatctttcttgggggtttgttttttgggccgtgagctgtgagttcatatgattcaaggagtatgactgatttcaagaactgaagcaatagatattaacatcattattttcctttattttcttggttggggtttcctggttggagatcattatgaggcgcattgaaatcttctgcttcttcattgcacatttcgtaccaaatactctggtcaaatcgatctcattctaatcctatgtctttttgctcgactatatggctggtaactggacaaatgtttatgcccttaactgtgtgtaaagggtgatgtagtaatctgtggtctgtttggcatgggtggagcctctttgagatgcagtagtatgaatagttctcttgaaacatcaatatacataaattcacaaattccttcaccgtattagccagtcatttcgtattctggtttggtgtgaactggatcttactaattaagaatgcttttgactgtgcagaagacgattctgattatgggagtgatttcggcgaagaatctggtgagaagggtatggataatgctttcatggaatcatattctgatgcactgaataaagaactcagtatgaccactatagagaaaagtttcgctcgtgcaccgcaccctgataccagcaatgaggtaattctgtcccattctatctcatgattatgtttagcacagatcgcttgtgtacttctcaaactatgaatatgaatattgttgtgattcctgaaatttcatagtaagttaagaaaacatacttggaagtgcatggaatgcacatactcttttggtttaaaatcacagtcatggatgattgtttattacttcctgaaactctattaatattgaagcagtaatgacccacaatcttcattttttatttccttgtgggtagtaaaaacatgtaaacttgctactggcaataaatcagttcacatgagttaatgagtagttatggtcaattagttgtccaaactgaagtctatcagtaatctttcttccattgtaaacaagttgggataatgggttttgtatcagattcctgaaagaaacttggttacgatttttcgtagcacacttgttcaatttgactgatcctactctaagaaaattttggtatattttgatttcagggtccatcaggtgctgcagatactgatggggagatgaccccagttgatgtggacctgaaccttgttgagagcttccttaactcttactcctctcaacagggtctcccaggcccagcttccaatctgctgggacttatgggtgtaaaagtacctcctgatggtaaaaagccgtgatctttttgtttgtacccatgcacatcaaatttctggaaccatagcaagaacatacatatgatatttattgcaaaacataggagatcatggtccaagtagttttcttgtatgttcaaacctcaaagaaaggaactggaagtaggacttgtgactttgtgagagctcaagcggccagcttggtctctcaacgggcatcatttggataagtaaaattttggcctgacaagcatgttccgttcctgtattccctgtactgctccggtatcattggaagacgtagggctcactcaacacaggccatgggtgtgggacaactatgtactatgagtctatgagacaactatagtcaaagcagctagcatttatatgtggtagtagctaatactgttgtattatgcaattctgtaacatgtcttttgagatctgacatgtatagcaagcagttgtttatgcagttcttggagtagcatatttgttctgaggcatgaacaaacttcagctacctaacataaactgttctgtactcgtacctactcgtgctgtttgtccagtacagatctggagtgtgttgatctcacattgcagacggtgcattcatctcacacggtggaaaatacagctatcaaacaagcaagtttaacctcatgggggaaaaaattaatcatctcaccgtagaactatgggcctgtttggagagcttaagattctgataagcagctggttggtagctagtttttgagaatctggaaaagttgggtttttcagcttctagcttctagttcattttctgaattctacaattaccacttctcagaatctggactagaagctagactgtttgcgggagtttctgattctggaagaagctgcagcagctagaagcttcccaaacaggccctgtaactagaagctagaagtaacaggtacatatcggtcagcgaaaggcatcctttcacgcattagaaaacaacatttttgcacttactcgaggaacaagtcaattacacgtgcaaaaaactgccagagctttggactaggagtagtgttcaatgcacaaaatctttctgaaatgatctcgtcagacaaaggagaagggaaacagcttcagctagctccctgcctcttggacgtgtcaaaaggatgcagcccatcccaattttctgcagcagccggaaccagagtgacatcttgcttcgttatcaattaaataaaaaccactttttttaaccgtaagtccaacatggcagctatggaaagctgaaagctccatggaaatcagggcatctcaagtcaagaaaattacgagtcaccttctccagtactaccagtccgtgtatacgtcctcatcagatcagatattcgcactgattcctgtcgtcatgtacgcggccacaggcaagtgcatttcccttggacaaacaattgacatttgacagcgcttcaactctttttttttctttaaataaaaaccacaaacttaatgctcataagacttgtatactcaaccctataaactcacaaatagacatcctaccatataaacaaatctcagaagattaggttgatatatcttatctcgttgttgatatacctacgagcacctcggaagactgggttgaggcacctcataagattgggtaagggcacctcagaagactgggttggtatatcctgtctcgttgttgacgtatctacgagcacctcagaagactgttatatcttggctctgtcaatgtacctatgagcacatcggaagactgggttggtatattttgtctcgttatcgacgggtacgtcatctatcactgaaagaacaattagccgtatatgcgagcacccatatcaagtctattactttaacccgtgtggctattactttaacccgggtggattgattccactaaaaaaacttaaccggttaagttacacttacttcgctacaacgcttcagctctttgatttaactgtagaaacaacgtctgggtggatatgtaaagcaaaccgaaccccattcaatctatctagtttatttttttaatcactcttaccaactttactttctttgtggatataattggaaccgtttaattgaacttcggctccaagagaaacgaaaccagagttggagcactgtcaaacatgttctacatatataattagacaagagtaccgtacataccaaaacaacgtataggactagattagtcaggaatgatgtatgctcctttgtactcattgcgtattatacacaccaccaaaccaaactaatcaatcaaatgatccattcatccatcatcctttgccctaaaaaacaaacttagaagagaatatccattttgtaactttctttgcatcctatcatatccatcgtccgtgctggtgaatggtgatgcctcccaagtgccgttgttggatggggttacgtcaacctcacaggtgaatctgacaatacaatattaccttttgtatatgtatattcagtatatttactaaactgcaaaagctgactttgcaactcctacactgatatatatcttagatatctataggagtattctttacccttatatgagtactaaccatgattaaagaaattaattagtaacccaactacggagcagggaagaatatattttcaaaaactaatgaactgttctagggattaagtttgatggcgagcatgctgagttgccaaatccgtatgaatagatttagatcagttaaatagctcaattaatactttaataaagtgtttagagtagccttaaaaaataacagttagatgtagacatactacactactaccactagtagtagaaggcagaaggtcctaggcatcaacctccttcgaaagttcaaattacggcggtagaccacctacatcagtatggccacctgtggaacatgatacaaacgagtgcgcctcactgactgaacaaagggactccattacctagaagccaacgactagtggaatctactcggccaaatccgcatatagattacaattcatcggtgcaacaagaactatatacattagagcatctggaaatgttgagccccacctaaatacaagttcttctcttggctaatagttcaaaacagagtttggatagcagatcgactacaaaagagggggtgggcaaaccagctcctctatcctctttgccgcacttcggctgattcagctttacaccttctagcaaagtgtagaccatccaaaagcatctgggtggaggtgcaaagatgggaaaaaacatatctcaaactgtaataatgggaggattgcacatcgatggaggacttgtgatacaaaattacgcatgcggcccacagcccgaagaaagccttgaaatcagctttggtcgtgtttagttccatttctaatatacggacacatatttgaagtattaaacgtaaactaataacacaacaaattacaggttttgcctgtaaactgcgagacgaatctattaagcctaattaatccgtcattagcaaatatttactatagcactatattgccaaatcatgacataattaggctcaaaagattcgtctcgcaatttacatgcaaactgtgcaattaattttttttccatatttaatgctccatacatatgtccaaacatttgatgtgacggaaaagttggaagtttgaagggaactaaacacagcttttgctagttttactctttctctattctctatcaatatacaaagtggtaaagcttttgcccctccttaaaaacaaaataggactgtaaaaaccaaaagaaaaaaagtacgaattacccccccgaactatcgcggttgtccgaattaccccccccccccccgaaccacaaaaccggacatttttcacccccaactatgaataccggacgaattaccccccctcgacccaatccacggtggttttggtttacttggcgtacacgtggcagtctagtcagcattttttttataaaataattgtgggacccacctatcatacactactctctcttttttttgttactctttttctgttttctattttacttaagaggcgcggctttccccccttcagtcacccacgaggtgcgggtttccctcttccttggttgcgtggggggatgaggagtttgccgccgttcgtgccttgctttgcgccaccttgtctctgtttcttcgtcaccggtagaagaaaaagagagagtgtttcttttacttatagatagatagattactacctggtgatgacgacccatcccgctactagcctctgattagtggtggtttttctgacatcttaactcgtctagtggtgttctcttgcggaagatctttaactgggatgtcgggctcggtaccacttgctcatactgttgcaccttgtgaaggacgtcgtctagtcttgcatgtgtcggggtttgggctaatgtctttgggtgcggcggctcccatatcctggctttatggccatatggaaaagcctgataagggttcttatgtcccttttgactgccttgtaggaagtcttttggagttctcttatgccttttattgcagattgcgaaatatatgttggttgttggcattttgggtagtggctggtttttgatatatgtgttggtttttttcctactggtcacacgttttttacgcattctttctttatataactgtcaccttcggttaactcatctcttgatcccntatgttaatggctattctttttttttttatgtagttacttctgactcttttatattcttatatatatatcgatctcttttatctcttatctttagtgatctgcatctttgtaccgtctctttactttgtttcttgttgttattctttatcattctttaatcatatcatttcgattactgtcgtggacgatctatactggaatcggttactcacgactctgctctaggctggtccatttt

SEQ ID NO: 78355 - DNA, 7586 bp, Oryza sativa
  unsure (1)..(7586): unsure at all n locations
cggctcgcgaatagaacgcgtatatgtagaaaactcgcccctccccnccccacacgcccccataataaacgggagcgatttaatgtgttgtccccaccgcaacacgagacgagtatagacgcggccggccaantagtttaccaccacgcggtgtgtgtgcgccacatatataggcgcgcgcgaattttgtgtgctctttttctacgcgcgccaccagaaagagcaaagattatatgttgccgcgtcttctcccttcttataaagaggtttgtgtgaggaggccccccctatttgtgttatacaaagcggcgtttttgtatntgtttttgagacccaccaatagtaattgtctatatagtttccgctatagaaaagggatatgagcttcccctcccccaccccgttaaccccgtttatgtgcgcgcgttttccgccctttccccaagggtagagggtggaggagttaagtacgcccgtccccccgcttatttacattccctttgcaatcccctttgacgggcctttattcccctttcggaaaaaaaaaaagtaaaaatgttgtgttttttagaccaaaaagaagtttatttgcttccagctttagggttaacccatcccccgttcagtccactgcaaagggaggcctgtcgttgtagccaacccttacgatcggctcctcccccggaaagttcttcagcggggagtccgcgcgccggtcccacgcgcgcaagcagcggcacctcgacgagctccgcgcgcacgcagggcaggggcgggggtaggggcggaggcggctgggggcggcgggcgccgagtccggggctggcgggcgcagaggagaggccggagacgggcgccaaggccgcggctggcgggcgcggaggcgaggccggcggcgggcgccgaggcctcggatggcgggtgcggagacgaggctggcggtgggcgcggaggcaaggccagctacaggacacccggttcggctcctccgccaccggtcgcccggtagcgcgggcaagctccgcctcaacagtcggacgctcgggtgagctccacctctgccgccggccgtcgagcgcatgtgctgcctcctcggcagtcgaccgtccgagcgcgtgagcgtgagagagagagagcgtccgttgccgctaccactcctaccgccatcgccaactgccaccgccgtcgtcaactcggttcggagagagatagagctcaacaccttctccacctcaacacctcttggatcttggaggtggagggatcgatgagcgcgctgcgggcggctcaacctctccgagctcggggacaggcagtggctcgtcgtcgtcaccctcattcccccccgccggcgactaccgccgtgcgcgtgagagagactaagagagtgaggatgagtgagagagagagtgagtgagagagaggggggaatagtggaatatgagtatgacaggtgggtcccataatttttttataaagagaatgctgactggactgcaacgtgtacggcacgtagatcaaaaccaccgcggattaagtcgagggaggtaattcggtcagtattcatagttgggggtgaagaatatccggttttggggttcgggggggggggcaattcggacgaccgtgatagttccgggggaggggggttattcgtactttttccaaactgaaaaccggggtacactattcagatctcccctgtcgtttttcctcccggctgctcctgcacctgcacctgcacggacggaaccacgtttccgcatgcgcaccgacgacttttcgccgcatgaaaaccccttctcaggctcccaggcaatgggagaaatcgcctcccaacaataggaggaaagcaacaaccacctgacccaagcccccagtccaggtaggaggagtccactacacagtagtagtacacactaatagctgcttgctcgggccggcgtacgtgcgtgctcgcgacgaagcttcgttggggcggacaaattcgttcacctcactgtcttctcttctcggcggagatggagatgggcttgtaaaataataataataataaaattctccgggtctatcgtttttaacgactaataggctgtatttgagaaggagatagagaagattgaaaagatacgcaaaacgaggtgagctattagtgcatgattaattgaatattaactattttaaacttcaaaaatagattaatatgatttttaagcaactttcctatagatttttttaaaaaaagtaccgtttagtagtttgggaagtgtgcgcccggaaaacgaaacaaacaatatcacaatcacccagcgccgaacgcagcctaaagacggggacgtagaaacaacgagctttccggggacagcaacgcaggggccatcaggcgatggatgaatcgatcgatcgattgttgggacccattcatacatggcgccactataatgtgattgttgttcgctagttaatctatagcgagctagtcgctgcaacttgcattgaatctcgtatcgatcgtagtacagtattagcaacttgcttctcctgcaatggcgatgcataatttggttggtgcgtgatataccctgctcccctccggcccgtaattgtcacacctgacgtcatcccatcttttccaaatgtgcaaattttcctacttgaaccttattaaaacatactccctcctttcccgccgttgatttttttaaatatgtttgactgtttgtcttatttaaaaacttttatgaaatgtgtaaaactatatgtatacataaaagtatatttaacaataaatcaaatgataggaaaaggattaataattacttaaattttttgagtaagacgaacggttaaatatttttaaaaaagtcaacggcgtcaaacaatttgagatggaaggagtatattactaccacactatccactaatttcacctcacttcgtggtgagccagtggaggatattcggggggacctttttttggctgcatatatacttgcaagtatgctcacattgcaagaggtcaaatttccatctagtggtgaacattgaaggttaagattatgttgtcataattctctattccgttgtacgattttacgatcctaatcaaaggacctatggttttattattatttatttatatgatttgcggatcctacctagagatctctaattctaacatgtacacttgattaaaattaacatgcatttaagttaatccctttttatatattctcaccaacttgggcttttgagattgagctgattagtgcatgccacttaattaatagtgttgatgcctcttgttttttacctttttttttgtatgactgaagtgaaattaacgctctttttctattttctatattagtatagtttttttttgaaaagaactatattagtatagtagattcttctaattaaaaaataaattgttggcacgttgacttgttggaattattatttttcagatttcctatgtaatgagaaatgcataggggttttccggctagctccacaaggtggtaggctagatgatctgggttcaaagtctcactctttctaattatttgatattagttttagatttcctagctatgtgatctcggctgacatctctgatcttttttaccatcggggccttgcgattgtaatttcctagcagctgcagcgaacattcggtaaacttacccttacctcgcacataattggataagcatttcttaatcaagaagcattggactgttacggaatagcagatgacaataagagttgcaaatatgcaaagtttttttttattgttttgcttttatgcaatgattcttgcttacataatcgatgatattagccaagatcttttgattccttttggctgcttacatgtgggcttgttgcccaatgctccgtttactcgcgctagcgagcttcacaaagcaaattgctcgtagtgggtatcgatagtatgtctccctgcatgtgggtcccgtctcagagatgctgctgccattttcgaaaagggaaaaaaaacctaatattctactagtttaatatatcaagaactaattttggatcaaacaaggttaagctcatggtattaaacaaaagctgtggttgaaaaaacggaagcacacaaattaatttagagcatcaaacaagtcgtagcagcaaggtcggttcagctcacagttatttaaacagaataaattatattatgttcaaatgctcaacgcatacatatccaggtcacaacagtgtagtgaagtgagacttagcaaaacaaatttatattgtccaatgagtaaccatttttaaaataatttaacaacgggagtctagataacaggatgatgaaggataatagaataggaagcataaggtggccggcaggcatcagcatcggcaaagcccctccatcctaaaaatgaaaaggacaaaagtttcaatctaattgttatggcactaattaaacagggtttatatcagtgtgaagagacgctcccaatggatgctagctccttaatcaggaaaggccaggcgctccattaatagaagctatatggttctatcaccaacaatccatgtgtaaaataaactcacgcagtacaaaaatacgctcttttttaaaggacagggcaatagcactgtgttaataaccaaatttgataatctgagtatcggagatgaagatagaaacggggtggaattcaagatgaaaatcattccggaaatagagcaaggatcggctaaattccgaatcggctgcgaccagaatcggcaaagtccgagttggacaaggttagccgattgagccaaatccgataatatgacacggcatacattgtcgggttgagttaatgtgtttcatgaggattgccacgcatggatagagtcctgagaaggcaattgtatctgttaattaggatatttcatgtaatttccttagagatatgtttgggcaaaattctgccacaaagacttatggtatcttagagtttgttagagataagagtcgtatccgacacggacttgttttgtaatctcgggtataaatagaccccgagccccatgtaattaaacaacacacgttcaatacaatctcggcgcatcgccacccttttacttttgttttgtttcgatgagttcttgcttttggcttgagctgcatcagtttcgatcttcaactagaggtaaaacttgttatggcggcttgcgttctcgggattagtgcttccatatttatgatactctaatcttgtttatgtaattcatcgaattattatatgttttatataatctctggcaatattgctatctaactttcaatcggctaacgtctgtcattagaaggcagccgattaggttaaataccgacgttgacttagattatataggatatctaccactctatcaaacatccaacggcttgattgtctagatattgtccttttttttcatacttatagctgcatcagatgttcgaccttataagtcgtgattagaatctcgatctctagccttcttttggttgccgattagggtagcatcggggtttcagccgatcttacctgatttaactatatttatcttatatgcttgattgacatgttaaatctgccctttatattaagatcttgttgcatttaagtatattaggctctcgtttgatatattctacttgctttgatatcttaatatagagtggtatcggagtattagccgatacatgctagatctatctgatcggctatgctatgaacatatatagtcttgttgttaatatatatttcgatctaagtgatttatactgtctcggcatggcgactgatctatcccaatcacttgatttaagtatatattgacataaggatcatatattgttaatatctacagccgatcgagtagatttagttctttcttactcattcatgattgccgatcgatttacatatgacatcggcttaaagataaatgatatgtcatcggcaattagccgatcggctatcgtttatggatttaaccgcggtttctttgtctttatttcttgttgattgcaggatcaaatcaactggcacgctcacgaatctaaaggcaagcttttggacctgcacaggagttaagcagatctcctaggcctcgtgtttttacatcaacacactgccaatcaaattgtgaacagtgaacttagattcaacatgcgtttggttgaagggattgaatagaataaattcggattatccgttttttacggtggttggtttggaaacaggtgagatgagatgatcgctaacgggcagatccaggcctcgagtcacttgcgctgtggcctgaggccaatgattgttcacccactatgcccaacaagatttcacaatgtaactcaaagtatagctaaaagcctaatgggttgacccatactttgagcctattctagatccgcaataatcacttagggcttgtttggttaatcctttcacactaggattgaggaggtttagaggaaaataattcctcatttattagggtgtataattaatcctccttgatacttttgttcggttaatctcaaaagaaaggaattggaggagattgtgaaagatgattaaccgaacaagatctaaagggaaatattctcctaaggtgtgaattagcttcatatctcaaaaactgatgtaccaatccaactcacttcctctctcttattgacatgtgggccacatccttccatcccttaaaaacaaggattattacatccctcatgccaaacaggtagtgggatcacccattttgaaaaacatgatgtacctaacacattccatctcattttcaaactaaacaaacgtggttttaatcttttatcttatgagactccttggttacctttgtagtaaaaaatctctatgtaaatagcagtggcgtagcaaggatttaaaggaaaggcggcccatctatatatactaggtcaattaaaaggtggtccactatacaatttttattatattaactagtacatatactatagttttaatcttgatcaatttttaggtggtccatggaccacaacgccacctagctagctacgccactggtaaatagatactccattcaaaagtattagacatatcactaagatataggaaaaaaataacttataacgaagaccaaaaagtgtatgcatgtatacaacaaataagaattaagatagttgttctagttcaacttttagtggaccatttaattcatctcttcccatcttatttgaaaaactataaaataaaatatgtttaacacttttggatgaagagtgcactactacttccatatgcggctaggggtagaaaaaaaaactcgaaactcatgacctaactcaactcgtgtaaaactcggctcgactcaactcgactcgggtagttaatgagttgagttgattttgaacttttactcattttcttaatgagccaactcgagctagctcgttgagctcatgatgtattaagacggaaattaattgtctatatatttacaggtgtaaaggtcgtgttaactcataattattcattgtagcacaatcctatgagtcatgatataca

SEQ ID NO: 78356 - DNA, 12575 bp, Oryza sativa
cggaaaaattgacggaagtgctaaaaatgggaatagggtgaactttgatgctactaaagtgaaccggtaactttcggtgctataaaaccaaaaacgtgaactttcgatgctatataaccaattttgccaaaaaaaaaatatgtacggaatagaagtgagtagtgaatagtgagtagtgagaagtgaatatatatttgcttctgatctttgttagaagtatacaagtgaagggaaaaaaaatcaaaggaagatattcatcacagaagtcatgcccaacttcagagttcagactaatgtactaggacagtagcacaatgcaaagtataagaatttcatacagcttcaaatagctagatggataacttctctcttctttttcttttttacttttcgagatcaattcattcctgacaaaatttttattcttccatatgtttgtttgtttgcttggatcaacttgttttctcatgatttttcatataataaatgattgtattagaaaactatcaagaaacgatatacatagtatcaataaaactatcacttattcaaacgataacatatttatgcattatgaatctatggtgcttcagatcgaacaaattgatcatacaaggatcagatcatgttacaaagattaaggcttcatcataacattgttaatatgaaaagcttaaacagttagcacccccatcaagttctgtttgaatccacagtggaggttttaccttaaaacatatcaacttgctgcaagtaacttgacactttcagtttgctgcagctgatgcaatgcctctttcagaacacccaacacattctgtagcagttgtgcttgccacagctgatccaaattaacaattctcacactatcacattcaaagatagcaacattgaccatggatcggtagcgcaggtttgaattgaatttcttctcctacatgtcactgaaaaaatatttagttcctgcaacgaaacaaaaacgatggaaatctttacaaaataaactgctgatttgcaatatatgataaagaataagaagaccattgaccaaaccaagggttgcttgttgcatgatttaattcttgacaaaactgcatttaaaagtcagattcttatttgtcgaaagcgcgtttttgttttcttggaagaagagagacgaatccctcagtttcagatagttaaaccaaaacaaaattgcatgaaagtcactgtacatgtttgcttacgctgatcccatatatatgaacatgcttggaaacatctctacatataactaaatccaactagtattatactccaaatttgcattgacttgggtggcaagaaatgaccaagataaaccagtattatcctgttgatttaagactgagcctgtgaggtatatatgcaattttaatattccctaaaaaataggtataaatatgcagttttcataccagtacactgagtaaatggcaaagccagtgaccacaaagcacccagccatgcaagaagcattagtccttgcaatgaaggtcataccaagcatcatcttcctcgcagtggcagtgcaggatgcagcttcttctgggtacagtctgtcgttgccaggatgccctgataagtgcggaaatgtttccatcccctacccttttggcgtcggccccagctgtgctgcaaccagcatcagcagctacttcaatctcacctgcagcaacaccttcaacccaccacggcctatggttggggactctgaagcactcgtcgaggtcactgacatctcactggagcacggcgagatgcgggtgctcagccctgtctactacatctgcttcacggcaaataccacgttcaccaagttcaccgaagggtatgagctgaagcacacacccttcctcccctccccgtcgcgcaaccgcttcacagtcatcggttgcaacaccctggggctcatcggtggctacaagggaaccgtgagccactatgtgactggttgctactcctattgtgagagcatcaacagcacatctgatggggcgccatgtgcagggatgggctgctgcgaggccgccataccgactgacctcaccgcctggggggcgatgtttgagatgaaccagagcaaggtatggagcttcaacccgtgtttctatgccatggtcagtgaggttgggtggtacagcttccagcagaaggaccttgttggccaccttgggttcatagatgacagagctcagaggggagcacctgttgtggctgattgggccattaggaatggctcatgcccggaagaggggaaaggcatacctggtgattatgcgtgcatcagcgcaaacagctactgcatggacgcgaacaatggtccagggtacttatgccagtgctccaaagggtatgagggcaacccttatcttctgaacggctgccaaggttaggttcatacttaaactggtagaattctataccatgcacagtgttaattcaggtagagtttgtaagctatacttctacaaaatcatatgaacattcatcaatagacagcaattctacatggtttccaccataattcagcatgggactggaaaaagaaacagtcagcttcatttgtggggtagatttttaattacaaagtgaaaaggtcattttggaacaagtattgaaaggggagttatagcattcttaagtaaattggctggttgactttagcttacctatgataacgaaattaatatagattatatagttcatacaaatttggtctgaattttatgaatggatgtttttgttgctatcttcagacgtggatgagtgcgcattgcgtaagcaagatcccaagtatgaggatatgtatccatgcagaaaaggaatctgccacaacacaccaggaggatacttatgcaaatgcaagttagggaaaagatctgatggtacaaattatggatgccggcctctgcgcactacagccgagaaagtggttattggtaaggtcacatctgcagattttacttctgtttcacctacattaggatgttcttctactcaaagtaacactaatactatggcaagaagaatactaattttgaacactacctagaattgtcaataaaaaataaatttaagaagttagtagcagaaaattattagtatcaatattctgacagagataattttaaaggcaccagtgtttcggccattgcgctaatgtctttggcatgcgtgttggccatgcaagtacaaaggaaaaggcataagaaggacaaagatgagtacttcaagcaaaatggaggtctaaagctatatgatgagatgagatcaaggaaggtagacacaatccgcatactcactgaaaaagatataaaaaaggccactgacaactacagtgaagatcgagttcttggaattggaggtcacggaatggtctacagaggaattttggatgacaacaaagaggtagccataaagaagtccaaagtaattaacgacgaatggagggaagaatttgtcaatgagataataatcttgtcacagatcaaccacagaaacattgtgaggttgataggatgttgcctggatgtacatgtccccatgttggtctatgagtttgtatccaatgggaccttgtctgagttcctccatggcactgatcgtagatcatcaatccccttggacattcgcctgaaaatagccacacaatcagcagaagctctagcatacctgcattcatcaacgtctcgcgcgatccttcatggagatttcaaatcggccaatattcttttggacgatcagcacaatgcaaaggttgcagattttggggcatcagcactgaagtccatgaacgaaagtgagttcatcatgtttgtccaaggaactttgggttaccttgacccggagagcttcattagccaccgtctaactgacaaaagcgacgtctacagttttggggtggttctgctggagctgatgacaagaaagagggcaatctatgccaatagcatcaatgaaaaggaatcattgtcctattcttttctcctgatgtttgatcagaacattcaccggaatatgctggacagagaaattatggataaagaaaccatggttgtgctcgagaaactttccattcttgccgccaactgcctgcgaccaagaggagatgaccggccaacaatgaaggaagttttagagtgcctacagatgataaggagacacccaatgcacggcgctagtgatcacaaaggagacagctatgcacatcacaactatgaaggatcgccatcaatggttgttcacttgaatgagaccatatacgagagcattgaaacgtccagattggttgatgatcttgtgagatgatgaagaagcttgtaccagcacgttaattcttgtgttggcgaatgccatagtaaatactacttggtttagccaactgctgtaattattgtttaagcaatttgttccttgtttgtggcaataatgatctcttctattctgaataaatattcaattgtatacagccaagttgatcagatttcagaagcaaagttacctgaaaaataaaatgcttcgatttgctccccttagcctgcagccacgatgctttgatcttgtaagataatgaagacgaataactaatcttggggatcatgaattgatgccattctgaatagaacgaataaataaataaaaatattcagttgtgcagtccgatttgattcagaactagagtagagttacctgataacctcgcctgaggtcgcaatgctttggagctggagcgccccgtgtcctctcccaccccatgacgcggcggcgtctcttcctcccgccgccgattcaaactgcgaccgccgccaccaatcccgactgccaagaaatgctagtcctccggcgatctccgccgccgccacctgaggcacgccaccggacccatgtccgtggcttcgtcttggaagggccggaccggggggccgctttccgccggcggcgactccgcctctccacgccgccgcggtgtgtggccggcgatgtgggcgagagactccattccgtcacccgagcggattacgagaatagcctgggcgtattctagttttcaaaacgtaatctaatttgacgctttcaacaggcccaacgaaaatgggcctcaatgacgagccatgggcaatttggggcctcatcggttactaacggtttatttattagcgataaaaataatttatacgaaaatttttatatacatgtattcttagcgaattaaagtcaataaaaaactatgttaaaatattttaaaatcatcttctaaattgaattttaaaatataaatttggcataatttgtcttaattctttttaggtgttgttcttttttcttgaagatgaagttttttatgcaaaacgaggtggtataaacgtatgattgattaagttttaattattacaaacttgaaaaatagattaatataatattttagagcaactttcatatagaaaattttcgcacaaaacgaaccgtttagcagtttaaaaagtgtgccacgaaaatcttaatattcatccagcccttgttagagaaaagaacgggaccttagtacaaccgatggggctcctgaagttatcaagacttctaaactccacggtaggacaatgtcaatgtggagtactggagtccaagagcctcatccgttccatcctgaaaagcaacttcaaatcggatcagtttaacaaaccccattgagtaatttttgattcagtaaaacattttaacttgctgcaaatagctttgagttcccacttccaatttgctgcagctgatgcaaatgcctctctcagaacttaccagtggtggttgcaacaattcacccaaattatcagtcagattatgcttgctgtagctgattcctatttaacaattcacacctcctacctaaaatatgtgattagagagcacgtagactactgctactgcttgattagttgcgactatgctaaatgttctagaaaggcatcacctgtcctctcccaggataagttactttttggtccgtttaaatttctagaatttttatggttttcttcctaattaacttcttcaaactgtgctagaactatgtatttgagatggcacttcacacatctcccatctgagtgagacatgtttaacgcggttggttatgagagtttctgattaagttcacattgaaaaccacatcgattctcaacgtgattctaatagaaaggttgcactaatactccacatattgtaagcttgtattctcgccgttacacaaaatgaaatctaaatttatgtataaatactaagaaaaaaattgagaagtaaaaatatattaaacatacatttttaataacttaactcaaaattcaggtattaatatgatatgataacttccactcctcctaaaattcaggtattaatatgaacatctagatctccttaacgggataaaggaacaacttccaccccttcagaattagagtacgtctgattcaggtattaatatgaccatctagatctaacaacttccacttccacttccactcctccttaacgggataaaggaacaacttccaccccttcagaattagagtaagtctgattagagtgataatgtcctcccaattgaaacatggtgctactttgcatttctccaatgtctccaaacaactaaataactatttacattgtctgaaaaacaactaaataattattgatctcattagttgattgatcctttatgtttacttatttacttcgatttactatttatatataagcataggctgaacagaaattaaacgctgcaatatagtttcagcgagaggtcatccagattttgttcttccatatcatcccgattgcatgtaagtggccgagatgacctttcagaaagagtagagagatggacacgactagaaatgattatattcttggtcatgcatatatgatgggcaacggtttttccaaacaaaaaatgctactgtgtccttcactttttcgcaatacttagcactaagctgttgagatgattcctgtcatgttataagtgttttactgaaccttacgatctcctggcagcatggattagcaggcttgcagcacctgattctaacttacaaatccaccttctcatattgaaaattagactgcattaatcatagaggagtagtttcccgcgtcgactttttatttcagtgtttaatcaactagtacaatacatgtcaaagttaggtactaaaactttacacatatatgcggagtggattttgatccctcgatgggatatcccctcgttgtttgcatgtcactcaaattgttatgaaaaaatttaagaagatgtattaacatgtgatatatcactccacaaacatgcaagtttaaattcaacttctacatcttgcaacgaaaaaaaaaacaaattaatggataaacaaattcaacttcataaatatagaaatttacgtaccatttcagaaaaaataaaaaaaatatatggcaaaatttatcccagaacaacaaaatttgtgtaattggctaggagacatcgtaaaatcgtgtcgctgctgatggacaccacaaaattcgtatgatttgttataggacactcgagacaatattttatcatttccaggcaaaaataggagagataaaattcaaaaaacacaattgtccagccctatctaacccccattggcacgaatggtggcggtagcggcggtggcttggacggcagctagctagcctggtggcgtttgcgatggtggtcagcaagttcggcagtggcaacagctttgacggcgacgataagccctgcgacagcttcaacggcaattggcaagctccacgacgacagctttgacggtgactagcaaacctggcggcgatggctggcaaacccagtgtcggtggcttcgacggtgactggtaagcccacaacggcttcaacgacagctggcaagcccggtggcggcggcttcgactgtggctggcagcggctttgacaacggcaggtgagccctgcggcggcggcttctatggcggttagcgagcggcactgtaaagcaggtgatgtcaccgaggatgaagtcacctgtcacctgtggggattagatagggtttagggcgattttgtcttttttaaatttctttcttctcttttttacccagaaatgataaaatattgccttgatgtcctataacaaattatatgattttgtggtgttcatcagtaataacgctgccactttaacaaattttgggtgttttgtggtaaattttgcaaaaaaaaaaatcgtttctaaccatttctgatccttttcatccctatttggatgagtctcatatgcaagctgcaatagggaaagaaacaaaactacaatttagtttcaccaagagctcatcgaatttgtgcagctttgtttcttccatgtcaatccatttcgtaggccgctctctgtttaggggagagagagagagaggggacaggaggcaagaacataagagattgttcatgtatatgttgtgatgtgcttgttatttatttatagatctcgcaccgtgatctaatttcattcgtttcttcatcagaagactcgtttgttttagtgtgctctactccaggtagttggtaccaggttgattaatgagcagtgagtaacttacggaagtaagaggaccaaattcgaatccatggctcgtaattcaaactaagaaattcacatcaagctcttgatcactaccagaagtataatatgcatatggagacagaaaaagaaattatcagaagtggatatatatcttagaatttgcgccatatatgaatgtttaggttgcaggttatatttttgcacattgcagcatcgtgcacgggtagaaaagagagatgtaaatcaaagaaaagaaccaccattgttttgttctcattctaaattcaaaagggaaaaatatttgaatatgagggaaagcaagtatagttgccttatgtctcagatgtatattggcataatcctgctaatatgtttgttatactcttattctcttcttaactagtgtaaaagggaaaaatatttgaatatgagggaaagcaagtatagttgccttatgtctcatatgtatattgccataatcccgctaatatgtttgttatactcttattctcttcttaactagtgtaaacaaattttaaaaaactagaacacaaccctaacataataactgtttttattatgccaacctaacataataactcttactatgcatggcaagaaatagatcagttcaaaaacagaaaataaactggttttattgcttctgattcgacttttttggattagacaagagagaatttgaagccacactagcccacaccaagttacactagaattgagtagaaaaacagttagaaaaataataatgttacatttggttttctccaatccctcgaaaaacttaacgtatatttatttgcttccatgtactatagtaccatgccatttatatgcctaggtcgaacaggctgcatatgtatctatctaaatattaaagtttcagtaaggtcatcaacgttgtgcagcttgatttcttccatgtcagcccatatgcatgtttaaaccacagagatcgagtcatgcacttgttatatatttccaaacgttctagtgtgatttaatttcatctatccgtagttcagacttcagaagcctcatttttagtgtgctgcactccagatagtcagatcaggtacctggtacaggttgatttctattattaattagtgactacttgttgtgccgcatatagtacgagcatcaaattcaaatccatggctagtaatccaaagtaagaaatttacagtgctcctgatcactgttagaagtataatctataaattacaagtggaggaaaaaattcagaggaagatatacacctcagaactcatacccaatttcagagttcatacactaattgtctgggatattcaggcatcggtgttaattggagtcggacaatgactatttgtggaaatgaaattttctttctgatccaatacaaataatgtggtatacattggaaaaacaacggaaccttaaaatttcgaaacttcggtaaccatagtgtgggttggctttatatgtgctcagaatttaggagctgattaattagctgaagctttcatcgttttccccttaactaagtcagccttacatagagcatcagtggttccaacttccaagacaacttcatgtgtagggagctgggaagaacctatatatcaaagtgaaattataagtactaaaaagatcatgcaaaagtaaaagagaattcacaattcattcagccatgataagaatgtaagattgtgctacagctaatgcaaagaatcatcagataagttcatagaataactcttgacacaacacacaacatagcggaaggaagagaactgattgattagtcaccacaccacagtgccacacacgtagtctaaagtctagcaaattcaggtcaaggatatcaaatttagtcaagagttgacttcaactacatacaagaaaagaaaaccttaacatcacctttgaaatcactcaaataaacatcaactttcttgccggctaaggaaccaaaatgtctgatttactaagcttttaaacacaaaatgatgtagtagtacttaccaaccgcaccagctgagcttttcaatccaggtgaatgaataaatttttcacattaagggaaatgtacggggtaattgttgcctgcatagcttttttaatccgaaaacgtacgggaagtattttcagttgcagaatgcacttcttaattaaagcaaaacagaatgcaaggtaaagtttcctgtcaaatgctgatctcaccaaagctagttaagtaacaatcgttgaaatcaactcatatgtaacaatatccatttgatcagcattagaaacacaacatctgcaatggaataaaggagttgaccttacttctttaaaaccctattacctgtctcaatctagtatagataatcacataataaagcaacgtggaagttgcataagcatgaacgttattacatgtccaagtctagtatagttaatcacataatagagatacatggaagttgcagtagcatgagctagtatcacctgtcccagtctagtactctagtatataatcacataataaagagacatggaagatgcagaagtacgaacaagtaggttcaaaaatagtgccacagcaactagcaagtgatcaccatacctccaactccgcaaccatgcaagaagcatccgttctcctcatgctcatcgtcttccatgcaatggcgatatcaaccaccacctctgaacctgcaatttcattgccaggctgccctggcaagtgcggaaatgtatccatcccttacccatttggcatcggcgctggttgttctgcgaccagcctgagcagctacttcaccatcacctgcaacgacaccttccagccaccacggcctatggttagagacctcctatcagaaacagaggtcatcgacatctccctggagcgtggcgaggtgcgcgtttacggtccagtcagttacatctgtttctcatcaaacaccaccataccagagaaccataccacagggttcaccctggagggtacgccgttcgtcccttccaccacccgcaaccgcttcatggccatcggatgccataccctcggcatcattggtggctacatgcacagcaactctaatctatatgtggctggctgctactcctactgccagagcatcaacagcacatccaacggtgctccctgcactgggatgggctgctgcgagaccaccatcatcccagacctgaaggacttcgcagcgatcttggtgatgaaccagagcgcggtgtgggaattcaacccatgcttctacgccatgcttgtggaggccggatggtacagcttcaggcagcaagacctcgttgggcacctcaggtttgtcaatgggagggccaacagaggtgttcctgtcatccatgactgggccatcaggaatggctcctgcccagaggggaagaaggtgcccaaagactatgcctgtgtcagttcaaacagcaagtgtgtgcaagcaagtaatagccaagggtacctgtgcaaatgctctgaaggatatgaagggaatccttatcttcccaaaggctgtcaaggtaacatacatataaactttctctagattatatttggagaccaagataaacaactccaggaataacaacataaccagaacataattatagccagttttaatgctgctgcgtaatatttattctttttgttactccctccatcccagaatataagtagttttagagttagacacggttattaagaaagtgtgtagaattaaataggaagaggttgtaattggttgaaaagtggaggtaggtgggaaaagtgaatggtggagggttgtgattggttgggaatggaatgttggtgaagaagttgctatattttgtaacaaatcctaagtgctaaaagttgttatattttgggacggagggagtacctttttttcagcttccgtaacaagccaaaatagt

SEQ ID NO: 78357 - DNA, 22970 bp, Oryza sativa
  unsure (1)..(22970): unsure at all n locations
tgctacagagagaatcaaaggagatttgagtcattgtcatagtatgttcagagtttgacagccaagagtggccatctatatgagccattgtcatcgccaaaaccaaaggagatttcggacagttgaaaggagacgaggagcactcacggaccaagatgcagctaagccagagcaagcactgtagatgctgctggtctcgctcctttcatgttttgacatgatcatcagccctctgcctctctgcagtctgcatgcatgcttcacaaagcaaatgctttcttcctgttgattatctgctgctactgtaacctgaaactctgacgaaacaaaaggaaatcctcccctgcattgtgatttgtgaacgaaaatacacagaagacaaacatatgcattgcatgcatcaacatggatggatgcaggtagccagccagaaaggcaattcttccaagggtcaggtatggctacagtgcatgcaacatgtcaatacacaatacacacacatcacttggaagtgacctgtctaggttatatagtactcctaggctttactaggttactgcagtggcacatctcctggcctggttttggtctgtgaggatcttgactaccacttcaaaggcatgaagaaagttggaaggaggagcagcagctgtagcctgtagcagactggaatcagtccatgtttttgactgcattttgaatggaccaagttcaaaggagtgagcatccactcaaaaatgatggtgctatcatcatcttgttcatcatcatcatgaagtgttgctgtggtcatgaatcatgatggcagtcacagaaggcactccacaaagcagcacctgctgctccttgagaacttcttctatccttgagcaaactgggcacctgtaaagcccaagaaaaacacagtcataggacatgtctttgnaaatcaagagagcatcttggcncagcncagtatgtatatatcacaaatgtactatgtacacatgctatatgcattctttcaatgcacaaggccaaaaggaagagcacactgtatcagcagtaaacaagggagaagcctagtgctgacatatttatcagctggaggccaccagcaagcccaaaaaaaagtaagatgtgatgtactaatactcttgcactttgtattagcagtggcaaaatgatacatctcagtgagtatcaatacaaaattttgatgatttagcagggcacccagcactaacaaaatgggcataataaagcaatttcatgttcctcctgaattcgccacacacgcagcattccctccagttcattctttctgaaggctgatcatcatgtaaacgatggcaagaatggtaaactgtgagcgactcgcaaaattgaagcgatcactcgtcatctgaatcgttgaacttgattgagtgggtttgtaaatcgatctgcccacccctgtaggttccacgcttcttcttggtcttctcatgtctaaagcccctgcaaaggcaaaattgaacaatgatgaaattatgttcggcactaagatgatcacaagtgggaaagaacaaatgactcgattagcaaggagtatgaaggtcagaaggaaagaagagcatctaaccttcctctaacttgcccaagaacctcttgtgcctttgcaccatacccagagtctgcaccaccctgtcataagataggttcaccactcggttattgtcaagaacagttgaaatttctacatattactagctaaatgcccgtgtgacgtgtgttgtaacagagttctaaaagagaacatctttctaaaatcattccccattgtctactcccgagactatacttgcatcaatcaaattctattggttagctggcatcatgtacaaaatgatttctaatcatgatcataatctaaggtgatattaatttttcttatggattttttttactttcatagcctagctatatttacataaatacgaaaaggacatgtaaaatatctaagtaatttttcttaaaaatcaaacgttaatctaataaagttgtgcagatacgactgttgctcctaatgaagaatggacaaagatcaaagaacatctttttaccagctagtccaaacaaatttttctttattttgtcctttattataagaccattgactgtatgtgggcccatataacagtgggtaggtgccaccaccaccattggtgtcttttataggagtatagatatggtcagtgcaacgcaaaagaaatgtacattaccttagcccaatatgagttatcctgaagcctatcatcagcaaatttaacatcctctagtttcacccgttgaaatgcattcacagttttgggctgcagtggacagagatggcatggacaatcagattacaagcatttcccagacatcaaagatatccataaccgagacatctataaaactattatcagaagtgaatgctaaatagtaagatcaaaatgatgttattgttagtcaatatacaagacatggaaatgataaaccaccttaatgtcagggcatcaccagaacgtatgaggaaatcaccatcgcaatgatagtaacaaactaactacaaatatccactgtccgatacaacattatttggttattctgaaatactagtaaatgtcagaaaagaaagaagttgatccatgactaacacaaaacatatacttactgatcatgtcatagtttgcctaaaatttctagatgacaggctttgtggttcataaacataacaggaacaaattgcactaaagtaggaaataacacaaggcaacgaaagaaacagactataacatacttcagatgattttttctgccttttattcggtttggcaccatcatcctctgaagaaccattgctgagcttctggctagctgtgttatcttctttagcagggaggttgcttccttcgacttcttctagtttccgctttttgccaactaccgcattatcacttggaggcattccattttcccccttctcagtctccattccactattgttctcatcatttgatttaggagctgaatctttccctgcaacttctttgttttcaaccacctcaacgttttccttggacttcttcagcttctttttacttttcttttcattggtgtctttctccatctctgcagcatcaccctttcccttggcacaatcagccccagcatctgtacttcctgtgtcaaccttatctgatgtctcaggagttgattttcctttcttctttttcttccctttctccacaggagcaacatcaaccaaaccattcttgctatcctccttcaatgtgtccacggtctcaaatttgttaatgatagccgattctgccttttccagcctagcttcgacatcctcgtcgttttcttgtttcttgcttttcttcttctgtttcttttctttggtctcgacatccgcattttcactgggcttttccacggcagaaggctcagccaccttgttctcagcttcactcactttcgtgtcactgcctttctttttcttcttcttgccagcatcttccgcgacaacggcggctgttttctctgcacacgattaagcttcaaatcagcgccaattacgcgagcctacgccaaatcattacgcgacgtaataatgaacatcgacgctaaccgtgctcgatactcccattgatgctggctcctggagcataattgctgcattccacaaccaaattccaataagaaaccaatcatggcacagggatatggatcacctacgaaatctatcttaagttcttaacacgagatttgagcatcgtgccgttgattctaagtaggagtacctcgagtcctccaagaatccggaaaccaactcttccaggctcaccggcgacgaccgccaagaacccgcctgcgaacgcgcaaaaatcctcattcacccactccaacacaaccgaaaatccgaaatgacaagcacatcacgagccaattgcggggccgttacctcgaggttggcctcggactggagcgcggcgagcgcgcgggggaagccgctggactcgaggaaggcggcgaccgcggccaccacggcggccctcctcgcgtcggggacggcggcggcggaggacgccgccttggtcttggccttcttctccttcctcgactcctccttggccatggcggcggcggcggcggcggcggagagggcgagttggcgcgggaggaagagcataaagagggggggaggctagggtttggaggggtcggggtttatacgccgcgaggggcgggctacggtaagaaggtgggtggatgggtggatgacatgtggggccgggtgtgtggtggggcccggttgtcagtggcggtgtgggtgttgactgttcgtctgggcgtggaagcttctggaaggggaagaaggaaggtgctagaagacgactgattgatggactgatcggccccagactcctagtgtcagtgtctgcggtatagtggtgtcaaacgttaaaattgggtacgattcgctagtggattcggttaagaaaataagctgattggtagataagagcttatctagatcaagctaaatttaaagaggaatcatgaagacctcgataatgtatactcccccgtcccaaaaagaatcaacctacgacaatatatgtggacataggggtgtccacatacatcaacttaggagaggtcctcgcatcccctcctagtttgattctttttgggacggagggagtagatccatatattagcttatgctgatgatgcttatcagcataagcagcctgatgcttatcagcataagcatttccatcaggtgtagaaaggtgtccggaaagattgtgtccactaccaatggctaatgcttattcagcccaacaagctaattgatgggcttttgctgaaaatagcctcagcaacagcaaatcggtgaggctgacaaggatgacagttaaagtattctcatgtccgatcaggacttttatcaacccgagggtataaatatatatttcccgggatatttgtaatctatctttcgactaatacataactttcggtacatcgctaccatctattccggagagttcatagtttcgagcgacgctgcattagttaagttcgatcttcggcgagaattaagttccgctaacttcgcttgtattagcgtggctagaactttatcagtgaattccaatattctattcaagttaatgcatgggttgtctatctaatatatagattttgtccttaactgcatcattgtttagagtcgtattagcttagttacgactttctcggttaggtttgctatcctgactaagtgatatttctataaatcacattattgttttagactgaccgatatatctatcacgtttgtgtagatctatcggctaaataggtttttcctattatcttcaatcatatattgtcacagttgatctattagatcatgtataataatattgattcagtcggcaacaagaatcactgcatgggtattgtcatacgtggaggatggaggaaacatgagaaataacagagcaagtgattctgcaagtgccggacgatgatacggtaaactaggcaagatgaaatattttagtttagtttagttgatcttttgtacatatgcatactgtgtggctccatgcacggattattttcatgcttaggcaggatgggccacttagatggagtctagttttgatcacatatgcatgcaacaattaaacccattcatgcttccctaaagccaatatttcgtactacttactttcgctattgactttgctcttagattgttactaaaaagtttatttatatgctgttagttgtaggatcgaactaatgggcacgctcgattgataggaactttattggagctccacgaatctcccaggccttcgcgtgaacgacgaatttcacgtcaacaagttgtatagtctaaaatgttcgatcaaatacttaaacaatgtctgcccgaagccattttgaacccaagaattggaatttcatatggctgttttaaaactttaagtgaacttcatattcaattgctatgtttagatagcatattcaatagaatggcccccactgtttggtatattggagaaaaaaccgtaatgtcaattttgcaaatgaaatattctatgaataaaagttttatatacgtattcttaacgttataaacgtactgactgaaaaataaactacggtgaattttttttccaaaatcacctctaaatttaaaagttgaaaaatttaaatttggatgataattataatcgaaaagatgaggaggacggaggacggctggccatcggcgtgggtcccgcccccccctctctctcaccctctccccatccctccccgcccaacgccgccgtcgacccgtcgtcgtactcccgcccacccagcgccgccgccgccgccgccgtcctcccaggccgcccgcccagcaccgccgtccatcgtcgccttccccgtcctccccatccccccgctcgagttgcgggtgaagaggggctcgaagcggctgctccgccaagcccctcctctcgccctcctcccctctcgccgagcttgccgtcgccgccgtcatcctgctgcatcctggtgaggaggatccgcatctgtttccgattcatctctctctctatcgagtagttttgtctcgaatttgcttgctcgcgtgaaccctagcttctcttgtagatctgtggaagtaacaaacagttcgtttgtctgtttccccgtaaaattccccaagctggacccgcccctggaagaagaagaagtagcttagtgttgatttgagcataatatgggtgccccgaagcagaaatggaccgcggaggaggagtccgccctcaaggccgggatcgcaaagcacggggctgggaaatggcgcaccatactcaaagacccagacttcagcaacgtcctgcgctaccgctccaatgttgacctcaaggtttattacagctgaatgagtccggttgcttcagggaaacgaagttttatagtaacttgttcctgatggattgattggttttggttgcaggacaaatggcggaacatgaacgtaaccgtgaacgcgtccggtgcccgcgacagggtgaaagcgcccgtcgttaagaagccaagatccgctcctaagcatgaaggccactctacctctacagctattgccgcggtaacttcagatggtgatgatgatgttgcggagcctgtgcctcttgcaacgtctacttcatccaagagatccctctcgaggtaaatgcccccaatgctctggtactggcctcagtctaatgtatggataatggtggtatttccttctttttgttaagccagttcgtttactttcgtgtggcattcctgcaggctagacaatatcatagtagaggcagtaaggagcttgaatgagcctacagggtcatacaagacagccatagctaattacatagaggtctgttttcatcttataagtttttctgtgtattatgattgtgaggtaccaataataacccatcattggaaattcctttcatcctttgcgcaacgttctgccgaaccaacatttcatttgtgtatacatgtctaaagtcagttattgttatcctgttgatccacacactcttctacggtactatattgcgtagaattggagacttaaattgatgagcacaatgcattgatattcaggtattttgcatcaagtgcatatgagattctgtgataatgatagccttgaaatgatctcatgaaaaccagtgggttctatttcaatatagctgagtttcacttgatctaatttgctgttcgacctccttaacctttgtaggagcaatactggcctcctgctgattttgatcatgtcctgtcttcaaaactgaatgatctgacagcatctgggaaattgataaaggttataatcccttctgtttgggcatgttttattatgcatttcgagtaatggcagctgatacaattttcatgcaaagaggtgaaccaggatgttgtgctctgatacggtagcaaattcagtaaaatgttaccaattatcattgctatgacatgttaaacttttgttgtgtactaaaatataatgcgccctccaactaacacattctagcaggctagcagcaattcctccttcattcattctttcagtgttgtaacatatctactgcacctgtggatgcagcagttgaatccaaaatgccatcccatattttgtagaaaaatattcttttgtacttgttaagttgttgttagtcctttttggtgtctcatggcgtattctcaatccttaaattcttgtcttgtccgccttcaaattccccggcttacaggctttgttctaaatgaaaactgtagaaaaaagtattatggattttgttggcatgtaagggccaagatggataatctttctttattatttaagcattgacacgtatagctaggcgctaggatcctaggactaccattacacacatcatgactttatagcattatggcacgcaactcattactcatgttcaactattttaggtgaatcgaaagtacaggatagcccctagttcatctttgtcagaagggcgaagctccaaagtagtgctgctcgaagatataaaaaaagaaccaacaaagttagatagggaagatgttgcagtcctcactaaatctcaaatcgatgctgaattagctcggatgagaaccatgactgcagaagaggctgctgctgctgctgctcgtgcagttgcagaggcagaagctatcatggctgaagccgaagctgcagtaagagaagcagaggctgcagaagctgatgctgtagctgcacaagctttcgcggaggcagcaatggcaacatttaaaaacagaagttcagcaaaattggtaattgctctaagtacctcagttctagtttcaaatggttcaaacgttttacttttgcatatttgcactttaaattccttgcttcctcattttgtatatttcaaactcaacaagtcattcactttgaccgtacactgtctatacctgccttaaagatccctctacaaatagttagtccttcatactaatgaaaggtatagatgtacatagactatgagcattccaggtagacacttctcatcaagaaagttatctaggaatggggaagtggagaactgtaggactatctgtcttatttctttctgcaaattctgaatgcctccattcgcttgcagatcattcgagcttgaagctacctgtgggagctggtgcagcatcagtttcctccgaccttgttgtatgtacacttgtcccgcgttccaatgcaatgcaattgctactccagttgggctagggacgaccctattccatccttaacttatgcaagcttattacagaaccaaattgcccaaagccccaaactggaattgcaccgcatctgctgaatttgccaacaattttgttacgcctggatctgcacaggcattgcggctacggcatcttttgactcgctcatggtagtaacccacatatgctgggataatcagggagtgaccagtagaagtacatcatggttatccccattcctccttgggtgattgtaattcaccttgtaatcggttttggcatcaaataatcagagtattgcgttgttgttgcatgtacagatgtaacagtgtgtgtctggttgactggttcacttcattgtgtatatcaactggcttttttttttaagctctttctcatggataatatggtaatgctgcagcgtgatgtattcaatcttgtttggctcctgtttaactcaaaatcgttgaaaggaccgtgcatcctactttttgggtgcagaagtagtactaggattggtacgcatgcctttgaccaaaaggagggagaggaatcaatggtggatgtacaaaaagatgaacaaatttcggcaggtctgtcgaaatcatcatccatggcggcaaaaatgtgaacactggtctgctgcaacaagtgtctttctgtcggtggatgctgcaagtgtccatcctagtactccataattctgacctagtatactcctatgtttatagggtttataaaaccaaccaaaaccggacatcccttggttttccagttaggttttaaaaaaaccaagctaaaattaaaaggcctctttgaattgcagggttagaaaaaatggaggaatatgaaaaacataggattctgataggaattgaagtgtaaaacagaggattgcaaaacacaggaaaaacacatgaatggtcgtttgattggagcgcagaaaaaacgtaggaataagatgagaaagatagactcaaaggaaatttcccaagaggttagagctcttgctacattttctctacaattcacatgcaatgtgccattccataggaattttataggatttggaaagtttcaatcctttaaatcaaaaggccaaataggaaaatttcctataggatttaaatcctatgaaatttctacataaatcctttgattcaaagggccctaaattgttgacaaaatctgaccggaagtcaacgtttttcatgaaaactgagaaattttttgtcccgttttgctgcctctaacactgcaagtctgcaaccccaaagcttcaaccatgtggccatggcagatgctggcttcactccctgtactacttccatgtactcacaagtcgcagcagcagcagcaattcaccaaatctctctccaagagtagtagtgctccctctcccaaagtagattttgctcatgtaacctcgtagacatttttttatatattttaggactaatagagtactacaataaataagagcatgcttagtagggttttatcaaatttaactctagcaagttgggtctggagtgaaaatggagcagcataaacacattttcacccctctaatgtattttgtgagaactccaaccaattcactctgaatggagctggatttgggctctagttccattgagctgtgccaaagaggtcctaactcctaagggaagagaaagaagctgctaattactcccttttcataatgagcaaagttaactactagaacaggattcagatttaagcataaataatactgtggaactgtactgtactgtatgcagtaatgcactgtccttgctcctgcacaagtgcacaggtcccccacactctcactcagctcagccactctccatgatttcatttcactcccatggtgaaatactgagaaatgaaaaccaggataggactagtagagaggataggagtaggagaggatctctgtgcacttggccccagatttccagaacacacacacacacacacagagctttttgagcttttgagctttgagcccctacaagaaccggccacactctcactttcagtttttttttttcttctcttcaccctctctgcatgcggacaaatcttgcaggctctcgtcgtcgtcgccactcgccgtcactctcttgtccccagttagtctttttcttgcaagtcgctggctttcggtttcttggcaaagcaaaccccccttttcattgcgttttgttgccttctccattgctgccgcatttgagtcacaaccctccaaattgcagtcaagaacacactgccaagaatgcagctaagctgctagcccgaatcttaggagatttctactaacttgttttttcttttttttttttactgagttcattcattcattcacagagaggaagctagggctttgttgttcatcagcaagagagcccccacaccagtttggtcttctcttctgtctctggaccccattgaaatgatggtgtcttcttggctgctccggggagattgattagatggccagggggggtggccattgctgagctttggagtgaagtgaagtggagtgtactctgttcttgtgtgctctcttggtgtgtgtgtgtgtggtggctcttcctcttctcctctccggagagagagagagagagagaggcagcctagatccatttgcaggatgggttccatgaagctaagctccaagccggatgcattcacaaggcgagggcaagcatggtacgggttttctctttgctctctctctctctctgagacaggttcagttttggtttttgtttagggttagtgtcatgtatggatgcttcttggccggataaagaattggtaaatttgatggtcttgtcttcttcttcttgttgtggttagtttgttgggggtgaattaaggaaaaagaacacatttttatggggatttgggaggatagaaatggaaggttgtttccccccttgtttcttgatctagtttatgtgtctaatctggtgtgagtgagcagcttatgctgcttcaatgtgcacattgtgatacttgccaaacaatttgtttgtgttgcttttgaaagctatggggatttcccattctacttttgtgcatttttcctgtcattggtttaccactttagtacctattgtgtccatgagggaggagctcaagatctttggagtaattcaaatctacttactgaaatttgcttgtcaaaattagtttttataggtgtgttggaagttacagatgccatacatgatacatttgcgcgaatgtttgtcaaatgtgaccctctagttgttttaaaaaagacgcttcagtgaataaactgctaaattttaggcataaggacattgtgaagctccagaatttacgagcaatacttatgtcgcatcttgttcacaagtcagatgcctcaagactcatgcctatgctcacctacatacttttttttcgataatggaagctttggggcacctacatactaatcactgatgaactgtgtggttaatattaaatgtaagaaggatttaactattccatcaataacgaagataaggttgactgttttgagtatgtagtgttaaaatgcttggggagggttcctttgtgtctcttgtgcatcatattagtcaaagattctggattttcaaactaatctatcggttcaagttgcattatactcacatgtgccagccaataagctagtatgctggtaggctgatagcacatatttcggtatggtgcatgaaaaatatagtaatatacacgtgacatgatacctcactctgatctcaattggatggttgtacattttttgttgggaaaagatagtgcaagtatctcagtttgaatagtttattgttagcctgcagcaatgttctgattctaatctactggcttatgcaggagctgtactggtttgtttaattaattcatcagcaatctgtatcaaaatatttagcacaatcactctgttttccttttttttttaacaatctatagtttcttaaaagaatctttacaccactgtagcaaatgcattttctcacttggttaacttagactgtatgaggtaaacgattaatgattcgttttactaatcgtcttcttcttgtgatcatcataggtactgcacaacagggcttcccagcgatgttcttgttgaggttggggagatgtctttccaccttcacaaggtaaattgctacacattgtaaatttgtagatgcatgaagcaatatgtacaactttgcttgtgattatggagaattttgaagaaatgagctttaatgaacaaccacaacttactttttgcacccccagttactcaagaaactttgatgaaagttattcttacagtcacagttactggctgattctcaagaggggcaaaaatgcttttataagtgatttttttcctctgtacttggtatgaacttgagatttgaaaatttgtcctttcctctaattgttctttatctgcttgcagttccccctgctttcaaagagtgccatcctgggaagattgattgaggagaattcagacagcgatgaatgtgtcatcatattgtctgacatccctggtggcgcaaaatcattcgagttagtggcaaggttctgttatgggctgaagatagagctgtcttcagaaaatgtcgtctacctacgctgcgctgctgaacatcttgagatgacagaagaaacatctggggataatctgattaatcagacagagtcattctttaaccaagtagtcctccgaagctggaaagattccctggaagcgcttcggacatgtgatggccttctccctcatgctgaagaccttcacattgtgaagagatgcatcgaatcattggctggcaaagctagcatcgatccggacctcttcggctggccagtctcggaacatagtaccatgcaaagccccgggggaagtgtcttgtggaatggcataagcacgggtgcgaaggttaggaactgcagttcggactggtggtatgatgatgcttcctccctgagcttccctacatacaagaggcttatttcttccatggagtcaagaggcatcaaacaggagatcattgcgggttcgctcacatactacgccaagaagtttctcccagggttgaataggcgtcaaagcaccggaccaatgcccctgccggctgctaccctgtctgatgaagaacagaggcgcctgcttgaagagattgataggatgttgccacttcagagaggtttaatatccacaaatgttttgctctggctgctccggaccgccatgatcctgaaagtcgaccgcgcttgcatttcaaacttggagaaaagggtcgggatgcagctggacgaagccacattggaggatctactgctgccaaacttctcatacaccatggacacgctctacaacgtcgagtgcgttcacaggattctcgaccacttcttggcaatggatcagaccatgggtggcggtggcgcctccccatgcttggatgatgtgatggcatctccttcgttggcaccgatcaccgctgtcgcgaagctgattgatggctaccttgcagagattgcacctgatatcaacctaaagccactgaaattccagtctctggcagctgttttacctgaatatgctcggccactggatgacggtctttaccgcgccattgatgtatacctgaaggtacactttcgagccgctattcttgcataaaaaatgccattgcgcgatttcatcctcttcatatgaatgaaagctatagtttctgaatctgatacttctccagtagtccagtgacaaaatgacactctatgtcactgtgtatactatcatcgaattcgcgatagaagttcttgagctgacaattgatcatatcatcataccgaaaagccatgtgccaagtgctaacatgagttcttcagacaagtcatcatttgcacttgtttccattctttcatacctgaaacccacatgaaaattgccatcctcactgtcttgattcttgaacaacgatggcgctgatgtgttcgcttcctctttttttttttttggcagtcgcatccttctgagcccgctattcttgtgtcaaaaacgctattacatggtttcctcctctttatatgaatgaaagctatatctcttgaatccgatacttttctccaaaggcaaaaaatgacactctatatcactatgtgtatactattaccgaattcgcgatagaggttcttgattacagttgatcatatcatatcatactgaaagccatgtgctaagtgctaacataaattcttcagacaagtcatcatttgcatttgtttacacctgaaactagccacacacacaaattgtcagtttgtcatccacactgtcttgattctggatttcttgaacaacaatggcgctgatgttgtttgcttccatttttttttgttggcagtcgcatccgacgctgcctgaagctgaacgggagcagctatgccggctgatcgactgccagaagctgtcgctggaggcgtgcacccacgccgcgcagaacgagcggctgccgctgcgggtggtggtgcaggtgctcttcttcgagcagctgcagctgaggacgtcggtggccggctgcctgctcgtctccgacaacctggaggcctcgtcgaggacgctccgcggcggcggcgcggtggcggcgtccggcgaggccgggtgctgggccacggccgccgtgagggagaaccaggcgctccgggtcggcatggacagcatgcggctgcggctgatggagctcgagcgggagtgctccgacatgcgccaggacatccgcaagctcggccgcggccgccgccgcctccgtggcggtggtggcatcgtcgccggtggcaaggacggcggcgggtgggcagcgcgggtgcagcggatgctgacgccgaggatgatgaagctgcagatgtgcagcgcgcagcatgacgccgccgagcagcagcggatgaacaatgagcacaagaaggtggagaaggtggccaagaacaagaagcagctgtccatggacgacggtgacgacgaggaggaggcctgaaacctgaaagatttcttcttcttcttgttgttgctgcgccatgatcgtgttggtcaaggtgaagtgtcactgagccgaagagggaagagattgatggcgtcatcagtttgtagttagtaaaagtataagtaactctttgagttgactaagtgactagtgagagcgagtgatttacctgtgagactgtgaatgacttctcatctctcaatctttgactctttttctcctgaaagcgtgcatgcagggagtacacagttcttcatttcgaatgactcccattcttattctcccaaattcagatactgcagtatccaatcttatactaagtttttactcccttcaggttaataatattagtcgttttaaacaagggtaaagtcaaactttaaaatatttgactataaataattcctaaaataatatcttaagaatatgaaaactatacgtgtagactagttttaaaaaatacttcaatcatatttgtcaaagttactctttggagaccgtgctcttgtctaaaacgacaagtattattaatctggagggagtatattttaacgtaacaagtagcatgtttacttattatttactcttgtttgttccgataaataggctccctccggtctaaaataagacgtattcaattttttttccgtccatgccaattgcaagagttgggccgagtttagtttcaaactttttcttcaaacttccaactttttcatcacatcaaaaatctactacacacgtaaacttccaacttttccgtcacatcgttccaatttcaatcgaacttccaattttagcgtgaactaaacatacccttggctagattaggccagtcttaacacttcatctcagctagtatccatagcattaaatccactgctacataagtaaaaatctgatgtggtaagagaattaatgagaagaggagtaaatagataaagaaatcatttctcatgcaataacccatctatacacaaaaagtaagaattaaaacaaggtaatatgtaaaaaaatgaaagagaaaagaggtgattgataataatttaatttgatgacactatccatacatagtgctatatgacttagcaagtatggaaactatttcaaagtttatgagttaggattggccttagaaagttatgaaataatgttctaaacattttggagctactagtagccaactatactactactatcttagtcccaaagtaattataattttgtttagcatatattaagttttggaagaaagactatggtgcccctcactaaatggtgtatagataagagtggaaaggtggttgaggatatatcatagaaagttttgaatgagaagtgattaatgtgataattaatacttcactgtgacagctattttaggataaatttgaatcatagaaaattaattatatgagacagagatagtattaaacttgctcttagtagcacaactgcaaaactgtacaaaatcagagaagcctcatcagactttggctttgcttggaagcttaatattacgataatctgctggttggtagttagtttctgaaaatataaaaaagatgggtttttcaacttatggtttctattcattttatggatactatcactatggattattagaatctaaactatctaagagagcctctgattttagaataagctgtagctagcagaaactctccaaatagatccattgttgccttgtatagaactcctactactagaggccagatcgaatccgttggggtggcaatggacggtggatgcagcgcgaaccgcacgccaatcaaagacacacatacatccaagagtcgcgaacccgagaagagagagagagagaggctcatcgccaatccgaccaacgcaaccactccaacccaccggcggcggcggcggcggcggtggggcgcggcgacccggcaccacgcgaccccggcgtcgccatgccgcactcgcgctccgattcggtaagctccccctctctcccctcccacactctccggccggctcgtcgtcggcgtgttagagatagattctagggttcatcggagctcttagatccgcgggttgattggttcttcaccctaagaagaggaggaggtggaggaggaggagatctgctggtactgacgcgatgattttgtttttgcgggtattgtcggtgttcaggggtcgggttcccgcggcgctgacccttgccgtgggaggaagcgcgggaggctgttgatgctcgaggaggaggaggaggaggaggagtcggggatggaggggtgctcggcgccagcatgcggcgatgtgcggggggatttcgttggatggtacagccttcactgatcctttccttatctgattcgtcatcagttttacagttgatcgaccgatattttggccttcgccatctcacatggttggttgtgttgctcaggtgttcggaccggcatcaggtggcttcctgcagcggcgaccagacgcaaagcgccagcatgtttgccgcgatgcaggagaacgcctgctccatcgatagcaaaggtgtggtgtgtccgcagtccgggctagggtattcagctggccagaacgggacgcacggtggtggcgggtctatgctgcatcagaatttggaaggctgcatgtatatgaatcagcttgggcagatgtgcggcccttatccacctgaacaactgtacgatggattatccactggtttcttgcatcgagaccttgctatttatgccgtttttggtgggaaaatggccaaccctgtttccttaggttccctgaaacagtttctttcacaatggagttctgattctgtggtcgccacaagagacgaatcggtggagaataagaaaatggcccctgttaacaaattgattcttcctgatgtatggcttttatttctttccatattagcacatcatcctcttgcttgtctaccttccttatttgtgtgattcatgttctctctgccagaatctttcaagtgaagaatcatgttggatgtttgaggacgcagaaggccgcaggcatgggccacattctcttgctgaactttcttattggcatcacagtagctatctacatgacctttcaatggtaagaaaagcatcagtcgaaaccatgtgttctggatccactcttacgctttgcttgcaaatgttctattttattggactgttaatgtgattaatgtgacgtgcatagtgtttttaaacaagtaatgaaatggctgttgtagaataaattgaagatattgtttcaatttggccctaactaaccactacatgtagaatatcaggctgttacaatgctcttatgtactagatgataaaatagtacaggagatttttacggtgcaccaaattagagtgctgcttggtttggctgtttttctccacaatccattgacactgcaacttgattaagttataatttatttggtttgcgtacactagtattggatactgcagtatacaatacgggcccaatacaatctcgttaccactgaatatcgagtgcatttggaaagtgttactgcaaaagcgatcgcccactcaatccaaacaatatttgttattcctcatcccgtttccattagctgtcagcttaattggaaaatgttacggtgtttcaaccaaacatctatattgagccatccattctatgagatctaatggttagtattactattactatctataagaggtaataaagagtattactattaccatctataagaggtaataaagactttctgaccgcaccataaataatgaaatacatgtaatctttagctggtggaatcatttaagtgatggataataaatgttggtttaacttttatgattcaatttaattatttgacatttaggactagattcgatttgttgtcttcttttttttaaaaaaacctcttgaaacataattcatttattggttttggtagatagcatcacaaaaagaatatttgatgtgattgttcttatacatattgtgattgttcttatacatatctttttccctcctggtggaggaatttttttaaggtatctcaattaagttggaataaatcaataaattaataggctatgtgctgtatggaaatcatttaggttcacccaacttatgggtaaaggctaatatatgattatggtggaacttctgttggttaggtttttttgagtatcttcttgtaacaggatgacagatcagttataacgtgttatgtacacagctcccccaattccagtggatttacatttgtgaattattcttggttcacactagtacatgatctgaacaataacacttctttttttaacagatttaccatgttgatagcaagtttggcccatttacacttgtatcactaattgattggtggagtggaggcacagagcattcagaatcttcagccaatgattctgggtcactgaacgctttaatggatgatgtagttgaagatatcagccatcagctgcatgctggaattatgaaatcagcccgcaaagtttttattgatgaaatatttagcagcgtacttccagaaatgattgcttgcaggaagacagagaagcaaatggctgcaaaacgtaagagccaagctgctaaggtgtgttttatctgtcatggtttttgggacatgaacttcttttgtattacctacccatttgcaaattttaatcctgtccaagatggttttatttttccagactgacaatgtgagtaacaagaatgctttggtacttaagggcaagggtgatggaacatctactcgtccaaaaagcctaaactcgtataataataaagtaccggaagatccttctgtggctgttcaatcaactgcaatgcagtatgaatttgctgatatattatcggcagtttgggaaacaatttataacaaatccatgaagagtatctgggatgaagtactgtatgatcctgtcatggactactgtgatgcatggcttaaaagaaaaaatgagtcgaatcttctctctacagttgttcctggagcctctgataaccaaaagatgcaagacacagatgaaatgtcaccaaaggtttctccaataggactaaacacatttctttctttgaaagatgggtttaacatttaagatgtaaatccttctttcgctgcagatatgattttctgacagtttcatggtttgcaggcaatttgtgattcagatgctcctgaaagtgacatggatttccctccaggatttggaccaaatcaggaatctgctgagcattcccactctgcgtgtgttgagtatgttactgaaaaaacagatgggaggtctggatcaagtatcacgttgttttctggccccttaggacgagttcaggtaatgctggcaaatgaactatatgtggcagcaaaggaagctttgttccagcattttgaggaggtcatttcagaggagataacaaactgtttgtgcattggatttgaagatgatattaatcaagtgagatgacaataataactactttttattgatagctgttaatatttcagaatttgcatgatttttacatctaagtgttgtattgcaggaacgaattcgtacgcctgttcacgcaccagaaccatccagtcctcctggaatatctgtgcatgaaacgcccagtcctgctgaaatgcctcgagatgaaatttcggatatggctgaaatggctcgagatgaaatttcagatatggctgtagatacaataccctgccctgctgatatggcggcatctggaacatcaactgttcctgaagtgacaacagacaaactgatcattccttacggtaaatgaataacatcttctgttgcattgccttacctgagcaacattaaattattctaattccttaatttggatgcagtggaacatcaatcgccctctgcatctcatgcaagtatatttgaaaagttggatgcacatgaagaagctgaattggatgacagttttgatgaggtgccttctggaacagaggctggcttagcttcattggtgattatggagaaaaacaaataccagccctcaaaatcagtagactcagtgcttgacatttatagatatactagttgggcattcttcaggcaaatactgcatgagagtgtaatgaaagagtgggcatctctcttctcaggtgctctcagcaattgttttgactcatggtatgccaggaaaaatattgtggctaaaaccatggatgatacattgagacccaaagaatatacttactacaggaagaggaaactgaggaaaaactgtgaagcatcatcatcagaaaaaccaatggatgagcagctctccagacctcttcgtgatcttgttgaatgcaaggttaatatgaaaaatatccatcgatcaagcaaggctgggatttcgcagagagtttctgttgtggagaagccctccaaaaagcgtgccaaaccttcacataatgataatattaatctgaatatccagcaggacttgaaactcctttccgacaaggtgccaaagagtgagtcattcagtcctcatctccatctcctttttaatataaatacatttcacagagtt

SEQ ID NO: 78358 - DNA, 23166 bp, Oryza sativa
  unsure (1)..(23166): unsure at all n locations
acgtcactatatatcagaatggaacgatcatatggtgacgacactgttgacgaattaatgaaacgagtgctggaataaccaatcaaggttgtcagtatcccgattcgtatcctagtatcttacgatactatgatcctaccaagtcgaaatgataccgatcgtatctagtatcctaattttcatagtatctcgatcctactattcattactacaattactacatgatcctacgaaatcttaggtagtatcccgattctatgattcatacgatactacaaaatattatttaaaataagatggtttaaaaataatgtaaataaatatgcttaagtttatataaaaatcagttaaatatatccaaaccaacgtggtttctcttgataaatgtctctatttgcatgacatatattattactgcatttttatatagactggctatatgtaattaatataaatattaattaaacttaaaaaataaaatctcatagtatcctgatactacgatacgatactactttgagcaaaacgatactacctagtatcccgatcctaacaaccttggaaccaatgcacctgttggctaaactgattttgattttttaaaaatttaatatattaattaggattaattttagagacattcttagtcacttcctttgcatggttcacttttcatgattgctaagaagatgagggaaaactctacctacaattatttctaaatataaaactttaaaattcaaaattgttttatccgaatggcagggcgaaagtagttgagtcaacaagtaggtgtgtgtcacaagactcagtttactcgtatatataaggccttgtttaagtgtctaattttcttgcaataagaagtccactttatgtcactatatatggatcgagtttcattcacatttctcaaccgaaaaaaataggtacaaaagcatccccaaggccccaactgtcttaattgtcaaaatcggtacaaatcaagctagtttaaggcaccattggggtcaacaagccacatagacgctgagtaaactaatacccctcaatgctgccaaggtacttgatttgcattggtattataagttggggaagttccatacctaattttgtgtttgaaggtgcaaatgaagtttattaactcatagttgaggggcaaaagtggaattttcatttccttgctcatacttgtaggctgtagacaacccttgatttttggcttgtcaaatactagtaaagacaggtatccgtctttatatgctatagttcgaaggagaaattcttcaattgcnnnnnnnnnnnnnnnnnnnnnnnnnnnngtttcttttagaaaagctttagtaggtcagaatcaatcaatagaatcttttttcatattgcttctagttctagtttagtttgtccatctttgtcgatttgcgccgtaaatcatccgccgccgctgcgagagtgcgacacctctttgtaggtttgtcctgaaaaccttccgttttgcccacgagacaggtagttatctacggtttcatctagatcggctccgctagccggtttagtttatcaaaacccatcttgatctagtgcttactagattagggtggttgacgactctactattaccgcaaagcgttaggtgctgcgatcgtgcttgtcaacttgtcacaaaaagttgccaacactctttatcttgtgttggcgtttacgagtttgtgttcgctttatgtttggaagagtttttttttaagttctctttaagttgtactcgttttgagtgatttcgtgtaataattggctgtaactcgtttgagcaaaggccgggatgaattactattctattatcttaaaaaaaagatgaagtccaaaggatggttaggcacttaggtcgaagaaaaatggcctaggtttgtggattaaggcccatagaactccgcatctttttgaactcttggttggaccatgcacgcatgcatgggccttttgaatggattaggtccatgaatagacgaaccttcgaaactgcacgacacctttcccacaaaagatattcccatgtgctaacaatatagaagagtatacatttatatgtcttatatagttgctttgcactaactttgccagttccattaatttgaaaaacaaaatgattttaccagaaaagatctaacaatgcaacaactgttgagttaagatcaaatccacttaccaaagtgacacatggaaaaaaattacatccaactattataaaacaactggcaacaaaataagatgtcccctcgttttgtgcatatcgtttaaaaagtcatcaaagaatttggtaagagattaaaatagaggagagttaagggacgacacagaaggggacgctggcaacagatgaagcttgtggcctgacggttcccgaccgggatgaccagcctcagcacggtgacaaggaggcatacatgcatgcatactgtacacgcgcacatgcacgtacagatcgtttaaaccaatcaaagtgctggccatgcgccatcccgtgccgagtcctccgtgccgatggtcttcaccgagctctcctgctgtcgtaagcaacatcaacacacgttcgttttctccgacacaacatcaccgatggtcttcatcaacatggaaacacacgccgccgccgactcgtccacatagatggacacctcgcgtcctctgacggattaatctgcaagatgcttcatcgatgacatcgaccgcgtcctctacaacgacaacgaccgcgacactgacggcagcatcgatcacgtcatctacgacgataacgactgcatcaactcggcgtcactattgtgatgaccgctacacggcgcgaaaggaccagccaaaatggtggcctcattgccaacgacgtcctctgacatatgcaagacgtctccaatggcatcctctaacatctacaaggtgcaagatgctaacaattccagtttcgtcttcacaccatggcgtaagtatttttttttcgccttcggctatttgcggctacatcaactaccgcgactacggctactacatgatcggctacatcgacgaacgtctataacaagaatcatctacggcaactccagttaaaacgtccgtgtcatcgctatcgtccatgacactcccgctatgactgcgggaggaaatagaggagagtcaactgacggcagcaggagagctcggtgaagaccatcggcacggaggactcggcacgggatggcgcatggccagcactttgattggtttaaacgatctgtacgtgcatgtgcgcgtgtacagtatgcatgcatgtatgcctccttgtcaccgtgctgaggctggtcatcccggccgggaactgtcaggccgcaagctccttcctgagtagatgcgtcctggtgttgccgtcgctcgggcttcaatacaaggacttggacggtggtgccgtacgcgacggcctcgtcttctgcttgatgatgctggtgagcgacgacaaaatcgtcgtcgtgtttatttggtgtatctaatagaagaatcgatctatggataatctgtagtggctaattgatgcggcgccccagggaaattataggattgatatcatctccccagggcgacgcggggatcgaacgacgttggtctctaaggctctgataccatatggaaaatctaatatgttatattttggtattttctccatgtattgcatcgaccctctcatgtggtatatataggagtatatagggatagagacttggagtacaatacaagtaatagtagatttatctctaggattctatctttaggactctatcttatctctaggattctatctctaagatatatcttatctctatatttgtatttgactcttatctctaactaacatattatacttctaacaatcaatatgtgatatattattctataaacatacaagttcaaatgtgacttatacaattagaacaacaataaaaaaaagactgcaaattacgtgttctattcatattcatattcttattttttatttgtataagttaaatttaaacatatatatttgtggagtgacattaatctatcttgctattttttttaaaataaaaggtgatgttttaagtaagtaaaaacaatgcataggatatctccataagggatgaacagagtttcactaagttaacaagatatagtttcttaaacacatatgattttaaccggagaaagcacacgcaggataacatatcttgtgtgagcctggtacgtagaaatagttcagttaatttcctgggaaaattggagcttcaagcctttatttggtgatgagcttgtccagctcggacagcggcagccgcttgtagccgtcagcctcctcctccatctccggccacttgttcttcttctccggcgccacctcgccgccgtcatggggcgccgcgaaggcttgcccgtcgtcgtcgcacaggcgcctgaacaggtgcaggtactgttccaggctgtgcgacgccgacagcgacatggcgacggcggcgtcgtcgacgacgagctcgacgactttctcggtgacctgcacgtaccggtggcccggcggcagccgcggcaccaagtcctgcttgacgacgagggacaccacgtcgacgtggcggcccttgatcagggcgtcgcggaacgccccgtcgccgacgcgcggcgcgccgaaggtcacggcgcggacggggacgtcgtcgtcggccagcgccgccgcgacgtcgtgcgcggccatcagggcgagcgcgccgccgaggctgtgccccgccatggtcacgcggacgccgacgccgggatcttctcgccggaaatggccgaccaatcgcctcacctcctcgacgacctgctcctgtgcgctgagctcgccgcgctgacccttcccggccttgtccttggacgcgtacaccttgtggaagcccttctccacctcgccggcggcagcggcggcggcggcgccgcatccgatccccttatccttcgacgtgtacggcttgaacggcacgagggggaactggatgttcatcgaccagtcggcgacgttcacggagccgcgccacgggacgacgacgtcccagtagccgccgcgccacgcggcggcgacgtaaccgaaccagtagggattgtcgacgccgcggaggacggggagcgccgcctcgagcggcgccgggacggcgtcgatggtggcgtagaggttggtggtggccaagtacaagtagccgccgccgccgtagtagtgaacctccttctcgtcgtcgtcgccggcgaaggccttgtaggcggcctccaccatgtccccgtacatgaggatgtcggctttgtggtcgggatggttgtgatcgatcggcagctgatagtcctcgccaccgccgccgccgccacagatgagctggaggaaggtggcgaagccggcgaggaggctacccttgtcgccggcggccatgtcgtcgtcgatgcttaagagtgtaagatgactcggtacacccatactccaccatgcatatatagggctcgacgtcgtctcttctctggcagtagatgcaggtgcatgtggggagtggattttgatcctcgagagtagtgtttgcaagtcgtttgaatagtaataaaaaaattaagaagatatattattatgtgatatatcattccacaaatatacaaatttaaatttaattaacttatacatcttgcaacgaaaaaacaaatttaattataaatatacgttaactagttgtagtttaatttggttttttttattacgagatgtagaagttaaatttgaacttgtatatttatatagtgatatatcgcatgttaatatatattcttaattttttataattatttaagtgatatgtaaatatctaagagacatcctcgagagataaaaaaaaagtttcttatgcatgtgtgcaataattgtgcatgcttgcagtatggggcggggtagaccaagtcaacgtacgacacacgtacatacaccgaactttcttggggtttggtgtttaacttgactgatctcgtcattattttatctaattacaggactcatatgatgacattattccatctagacgcaggcagggagtacaggttatttgtttttcttgaccagcataggctagaaactggactagacttgactaaccaatcatcctgggcatttgttgagtagtaactgtattttattaagcacttgtttatatatactctcttttttcctaaatgtttgaagccattgacttttttaaacatattcgaccgttcgtcttatttaaaaatttttatgaaatgtgtaaaactatatgcatacataaaagtatatttaacaataaatcaaatgataggaaaagaattaataattacctaaatttttttaataagacgaacggtcaaacatttttaaaaaagtcaacgacgtcaaatattttgggacggagggagtatatatttgcagatgttttcttgactaaccaaatcggtgcatcccttcactgttcattcacgcattgcaccgcattttgtccttctcattgccgctggtcgtcgttgtcctcctcgccaaacttcgctcatcatagtgccgattgccgtccacctctctctcctctagctctatcatcactgttgcccctcgttcgatcatccgttctcgtcgccaactgttggggattaattacatgccatacaaatgtatgaaacgaatgtttctttattttttttctctattataagtgatttagaatatattgaagttatctaaaatttatatttgaaagtttattgggatagttttgaaatttttttggtatgatttcgctgtcattttatgattatcttttaaatttcagtgaaacattgtaatacaacctttttcaacaaaaaatttaagaactctactcaaactttgaaattttcaactcaaatacccatttattgttttactatagaaagtgatgaacatatatataattaatcgtgacactaagcgcgtccgcgagcatgcgcaaactaacccaaaaggactgattcgcgaacgttcgcacacggcgaactcgcaagaataccctacactttccttttttttttggcactgcttggtaagtttacatactgaaagtttatacgtgatagtaattcagattcagattttcttatgtaaagtatataaagtttttatatataaagttttatgtataaagtttctacgtagaagtataatctttggagaccatcgtctcatggtggaccaaacgtgttcacgcaggatgcacgtggacattcacccattaaacttacccaaagtagccttctccaggattttgggcttccaaaatattaggccctaagagatgaggcccaagaggccgtgaacatgcttgggccttgaaaatccatggcttgtcgagtaggattactctacaaggcccataggttcccagcgtccaaagtttttaacccttggagacttttagaccaatgtactgtgttcatctctttgagtacagtatctgataaataattaaattttaccatctcaggaatcattgtatggccgaaatcctggtcaatccagagttaggattttaattcaatttcatggtttatttctttaaaccgggattaggatccaaagaagctgattttttttatttatcgactctcttggaaattgaattgatttactaattactgatcaagtactagcaagcatccacgcatccatgtttctcgccgtcgaatgctgcaattttttgacagtgcacacctagctacgtgcctgtctcaaattaataaacactcagcttagtactccacctctttaattaaattaaattaataatgccctctagctagtactgcatcactcttaacataacataatcacggccataatgtggccactaatgcaacatcatccttctctgaatattataagaatattcagtaatctatacacattttttatattgtactatagtatattttcagtgtactagtgttccagccatgcatgcaaccattgtttacatttatattttcaaaagaaacagcacattgttatataggctcatgtgaaaaattaaacataaataaacaatactataatccatataggagtacttgccctaactaatattagtgtcacccatgtgagcatgtcaatagctggccaggcaagcaagcaagctcgctctgaatgtgtcctgaaacacccagattaattaattaatctaatcaaacaaaagcacagcaaaagaggagaaagctcaagctgagcaacacaagattcgttccttaattagggttccagttcagctcgagacaatggcgatgctttgcttagcggctgtagggttcttaggtgatacggcctctgccactgtccccctcttaatactattgatttaatttcagcgagcagcgccctgtctgtctgatgacaagttaatcagcttcttgtttaattagcttagttttctcttgagattcttcctggtttcttgggctttgaaaccaagaaatgcagtgacgatgcatatgcacacacactgtgattagtttaattaagctgggctttgatcttgctctctagaacaagttgacagtgcatgtgatgcatcgatctgcaggtactggctgtctgtatctagattctggagtctagaacacaaatcaagttaacaattgttacttctagtgtgctacttgtagttcttggaagttgaaacttgtatctgcaggttcagagatgttcttgtataattgtatcttgtccaaactgaacattgtggtccatgctttaactatagtgctaattaatgaagtttcaacgatgtttttgctagtgctacattaagggtcagtatatgtagaatcagcttcattttgatgattaatttactgactgaattgggttttctctgaacagactggactgaactctgccaccggaagagaagaaagaaagaagctctgaacttttgtgaacaaaacaaatgctctgaatatgatggcatgattacctccctcaagagattggcaatcatggctacagttaccagagaggtagtaattcagttacagatgctactgttagcttctaccacatgagcactaatcaaaagtgtaataatcactggccattcatcctacctcaaattcaggttcttcagttcttggacataagagtcattgtatcctctgaactttcctgctactagtaatagtacatacagtatatgatgaagttttgaattattagtactaacaatttgttgctcaacagtaatgatcattcatcaagccctagaacacaaggggacacatgagggccagcatgcataattctgtcctttgcttgttgatgacctactgacccatgggcccggcctgctctgctcagaaagcaaattaaattactattaggtcccaataattaccaactgatactccctgattcacttgcagcttcttatcatcttcagcagcttttcattcccttaccttttatgctgcactagaatttgtccaatgtgttcatctcctccctgaaattaataaagcagtcaaattgaaagaacagacaaagccaatcgatcggttgatccacatggtgattgtgcactataattgaaaattaagagctctaatctttgtttaagaaaaggaaacgagccctaaacatatgtttaatgtttaaagaaatgatctaactgtaccaagctatattcagtagtagcatagattaatcaggtgaaagatacataggtcgtatctttggttgcacaacaagaatcttccagagttaaagaagatggagagaaaataaaaatccaggtgagttcttggagcgacttgggagtacttttggttggcatttgggcagacaaatttgcagcaagagtgttccaactaatgttagtttaattagtttaatcatcctctctagtctacactctgcactgatcactgaagaacagctatctttttaagttaagtgtgcaggtagtcctactttgtcagtttggcactgccgcttgttgctgcaaaatgacaaaatggagcagtaaaaaatggccctaaaattagtactatttctattaagaggatagctgcagattagttaatcacctgaatttgcagagaacactttgcaaaaggaaaagaattacactgaagaacaaatggtactacagttctagtatgtctgaactctgaaatgcacttcagttcttgtagcactactaatttaggcagatatagcatcacctgaatttgcagaaaacacattgaataaaaagagaggagaaaacaacatggaagagaaatagtttgtctgaaatacacttcagttgctgcacttacaattatttgtagaaagatcgtggatagaacatgcaaggggcccatgcatgcttaatttgctccagctttaggaccagtggcgctgattaagctgtcttaatctttccgaacagagattaaagtggggttgtgctaatcgggtagggagaaatcatgagcatcagcaaattagttaaataatcctgaccaaaatcatacacatcagcaaagcaaagccctttgattaattatctgcctttgtatacatcatgcatgcatgggctagcaaaagctaattctgaccgaaatcattagctctaatctctgtcattaagtatccatccatacatgcgtgccatgtagtactatatctatcaagtaagattgcatatatctgcagaaaatcccaaaagttaagaacacaaaagtcatggtgatcccggtttcttctccgagcatcaagatactaactcttacttaattacactctattactcttacttaattactctccaagttaattactattcatgtctgtccgacaataatttggtccggcacatgtggcacgtgatcacaatcttactctccgtttcttcttgattattactatgagaatgcttagagtttaaccttttgacacatagacctctgagtaagcctgcatataagcaaaaggcttgactaattaagccattgccaacttgtggtttcggtaattggagttaatttacagccggtcatgttgacattgtcgcctctacccgacatggttaccaacccactgcataaactaatcactttgcttacgtatcaagcagccttcgtcaacttctgatcataattagtggcgtctaaccttgacaccggttcatactgtgttcttgagcatctcatgcatgcaagaaagtcgtcaagatggcaatgaaagttgaatctttttcgtatatatagtactaccatatgcattgccaaacatggggaacatacttgactcagtttttagggcttgttcggattataggataggaaaaacgtaggatagaaaaagtataggaatgtaaaaggaatctaagtataaaacagagaaatgaaaaacagagaggaatgaaaaacaaaggaatacaaaagttgagagcattcgaatcacaggaaattgattgcttatgatttgcatgcaggaagcaaacaaaagagctcaaggtggatggatttttcctgtacttttcctgtgaaaacagcattaaaggaaactttcctttagatttcctacaaccagtttttatgacccgaatgataggaaagggaaaattttctatgcacagtattcctccaaaaatcctgtgaagttcctctaatccgaataagccctcaatgtcttatacttgtctgaatagtttcagttactgcgcatgcagcatggtttgatgaaaatggcactaaaattgaaacatacgtacattcgccattcgtccacttgttagcttaattaattaccagccacggtaggaattgaaattctaaaactcaactttagttgattttggtttttgttcatcacaatccacttaccagcattggcttttaaactgttaataacaaaaatataaagttttactcataaattattttatttctttgttcattttctcatagtttatcggctgtatctcaaacaattagatttatcgtgtagggacctttgtatggacccttcagaactgaaggaacatcatgggattttttttaggaaagaaaaaggactattttcaaagataactctacaaaactcctatgttcttttcaaggaaaaactgtagagaaggatcctacagtgtatacatatattaatattatataactacatattttcatacaaattatctagccattttgtcatcagaggttgtaaactatttcttgctctatggaaaaccaagccaagttcttttcggaatcagtcttttatgaacataaaagaagaataggtggaaaacaaaactcctgtatttcaaaggagttggcatcgtgcgtagtggtatgtgcgcgtgtcccacccatgtaatattccatgaacaactctagaaaacacatatgagtaaggaaacaacattacatggggtccgaggccgtgcaatattctgtcacaggtgaaggcagcacaattgagcaagttgtcgcctgtggtaccgaacaagcgtccgatctgcatgaaaacagtacacgcactacactctttgcaaacgatggctgaacatgcaaggtttcttggaagaaattcggagaaaactttggtcttgtgcggcaatccacagatctaggatggtgacattgtctcatgtagatgatgcatctccatgacaaaaacaaaatgcactagtgtggcttgcacagtagtggtggactggtggtagagtactcatgtgacaaggccaagaaattccacaagaattgaactatttatgtcagataaatttatatcaccacagcaacattaattcttatttatctggtttgtatagttgaggggataaaatgtctggttttcaaattcaggagagtaatttaatttaattgatcacgatagttgagggggtaattcgtatttttttccttaactcaatgttactactactttttgaagcatttgttgaagtttgttcagtgcactcgtgctcgtcgcgtgtttttggtggcttatcaacagtaaccaagatttgaattttgaaaagtagaattgattcaggagctttttttatcgtagtctattatctagccttggcttttgaatgcttgtaaacttcgacaatggattaaaaacttttgaagcacaaattatataaaactgataataaattttaaaaaaacgaatgatgtaataaattttttttttgttacaatggatgtttttcttcagattgttagccgtgagcccgtgactcaacttatatcgaagcatatgtcaggtgagaccaaaggataggtcagatttgatcaaactaagcaaatatgttcgaacggatctgaacgtgaaccccatcaaactattgaaattcataaattcagctcgaatttatcgaattttcaattatactatcgatttaaactaagtaatgggaattgatgggtagaagcacgagacaacattggagtagaggagaaaagagaccgtagcgtccaacagggcacttttgcctccagtgagcagcagtaaaacccaaaagttactgtcctctcttttttcaccctgatgtcacagccacagcagcagtagtacaaaagttgcagtaaaaaaaaaagtctacggcgccgtagaatgacggatctacccctacccaaccaggagacaagctcacgagcctatgcggatcccgcacacgcctcctccccccgccacacactatttacgattctgccactcatccccgccacgtggcaccgccacgtgtcagatgacgtggcctctccccgccggtataaatcgcccgggaaaccgctcctgccacttcaccaccgcacagcgagctcgccgcggagagctttcgccggagaggtagacgacgacggcgacgacagtgtcacgtgctcacgttcatggtggcggcggtgcgcgcgccggtgaagccggagatggtggagctctcgccggcggcgatggagaggtactcctccgacgccgacacgacggcgccgaactcgagccttagctcggcggcgagcagcacggggagcctcgcgcggtgctcgagcctgtcgcgcctgtcgttcgactgctcgccgtcggccgccgtggcggcggcggcgacgtcgtgctcgccgccgcgggcgtcggtgctgttgcggccgcacaggtccggcgacgtcgcgtgggcggccatccgcgcggcttcgacgacctccgcggcgccgctaggcccgcgggacttcaagctcgtgcggcgcatcggcggcggcgacatcgggacggtgtacctgtgccgcctccggagctcgccggagagggagagcccgtgcatgtacgcgatgaaggtggtggaccggagggcggtggcgaggaagcagaagctggggcgcgcggcggcggagaagcggatcctgcggcagctggaccaccccttcctccccaccctcttcgccgacttcgacgccacgccgcacttctcctgcgccgtcatggagttctgccccggcggcgacctccactccctccgccaccgcatgccgtcccgccgcttcccgctcccctccgcccgcttctacgccgccgaggtgctcctcgccatcgagtacctccacatgatgggcatcgtctaccgcgacctcaagcccgagaacgtcctcatccgcgccgacggccacatcatgctcaccgacttcgacctctcgctgcagtccaccacctcgccgtctctcgacggcgacaccgacaccgacgacgaggccagcggtggcgcgtcctgcttcccggaccacctcctccggttcaagcggcggcggaacgccgtggcggcgccgcgtccgcggttcgtggcggagccggtggatgcgaggtcgtgctcgttcgtggggacgcacgagtacgtggcccccgaggtggcgagcggcggcgcgcatggcgcggccgtggactggtgggcgtacggggtgttcctctacgagctcatctacggccgtacgccgttcgccggcgctacaaacgaggcgacgctccgcaacatcgtccgccgcccgctcgccttcccctccggctccggctcgtgcggtcccgccgacgccgacgcgcgcgacctcatcgcccgcctcctcgccaaggaccccgccgcccgcctcggctcccgccgcggcgccgccgacgtcaagtcccaccccttcttcaagtccctcaacctcgccctcctccgttcgtcgcgcccgcccgtcgtccccggcgccggcgccggcgccgcgccgctacaccggtcgcagtcgtgcaaggcggcgccgacaacgccgccgccgccgacgacgacgaagccggcgaacgccaccgcgcggttcgacctcttctgagcatattgaccgttgctgtctgctactacctacccgcgtcgtcgccgacatcgccggcgggagacacgctccggccaccgtgacattaatttctcgttgacccttagctaccgcgttgaatgtacacactgttaattaattactactcctagttaatcactgctaatcaccttgctgttagtactactaaactaatataatctagtggcttaattaatcagcttgctttgagtgatatgatcactggtgatgattgcaactgtttctgaatcaactgagcatccattttctaccacttcttcggtcctaaatactacgaatctggatacgatgtttatttaaatttataatattatatattctattcaactaaaattttttatatttttaattgaagggagtaacaaacataggagtaaatagaagtaattaaataattatgggggtgggtaatgttggtcgggtggtaattaagcaggggatcacatggatgctggaattgggtgggatgcaggttagcgcggttcatggattagggggttatggttggtgattacattaatggtcggagttgacctgtctcgtctccttgtctgctctgctctcatcttctcgtcttcttttcttccaaatagtggagtggttttggttgctgggaagagaggtgacattccagccaggttgatgtccattttaatatttatttttggatgcattgcattttgcaaacaatagcgtagggtgaggataaaaacggtcggaagagatgtatggtactagtatttcttttatatttcttatcacagaaatgtagaaatgtttttggtatggtaggatatttttttataatttttgaatttaactatttagtggtggcattgatacgacgctgacatgacagaaattaagataaactgaattttatatacagctaggaacgaaaagggcagaaacgatatactagtaaattttgttctactttaggggggaaacggatcgatacaatcgggaaattgattaaaaatgtttaaaagttctttgaaaaaaaaaactccaacgttgttattctttacacaaacctgcatcgtttatgagattttgaagcacaccccgtaataatccattagcaagttaagtagtataaccgctgaacacatgtgtataatgtttcatttggaaaatatctgacacgtgtatatctgctacgaacatttatgttgtgttctttattccttctgaactcatacaccctcgttttctgaatcactaaacggtatatatatttttaaaaatatttagagtttgctttataaattatattaatatatttttctagttttttaatctaacatttaactaagaatatgctaatccctccttccaaactcaatcttactctctctgtagttgtcccataaaaaattaacctaataccagatgttatacatcttactactatgaatttggatatacatatgttcagattccagattcgtagtattagaatatattctattcggttttaaatttattttccatgggacagggagtatttgtttacacttgatgcacggaagacgtgcagtatataaaagtactgcttgaactctcaatagagtatgcccttttataatttcgaacatttcaatgtagggtatgcccttttaaaagcagaaccgcaaaattaagattcaaaacatctccttgcattgcatggcattgcattgctgggacacgaaatcatgatgatgaaggtgtcgagctttggtgtttgaccaggaggtcccacaaggcaggcagagatcgatcgagacggtggctgccatgggttgggccatgcacgcgtgctgctgtttctttgttcgttcgttgtcgttgctctccatcaccttccttctcgtagattagattggtagctagccttgctatggatcggggatcatggctggaggagcatgcaaactcacgggatcgccagctactctagctttaacttggaccagccagtgtctttcaagtttaattgtttagttgaccccagagtttacattaccggttgaccactaaatttcgagtcctatcattatcacggttttcgataaattttgacttaattttgatcaaatctattgtttaaccttcgaaattccaatcgaaacttaatcccaagccgtgtcaaaacattgaaatttcacgaaattcgaccagtttttatcgaaattgtgaaccctgttgacccaatgacaaagctagaattttttttgggccgaacaaacttcaatataattagtagtatttgttatagaaattttatcaccaattcataaatgtcgagctcgggtggtggctccgctactaagctgaccttaaactttgcaatttgagaagatatactacaatacgtacaccatgtgtgtacgaaacctggtttatttttcctatatacctatacaattcatccccgctaactctaattctctcatctcacagcttgccacgtcactctaaattagtctgaccattagatttgcaatggatgtcttagattttcactgattaggatctgcagcaaaaacatctagctctacttgagtacctccacgtctcccaagcgctttatctttcgaaactgccaattttattacccactatgattacttcttaatgtctgatgtgttcacagaatcaactggtagcatttgtttcctcttttcttgcttttcctttgcctcttccgatcgttctcctttctactcctaatcttggtttccttcgggatatgtttcccctcgctaacactcttcagatgaatgcagaaatcttctcgattcaagattgaatggtgaactctcgagcatgagaaaaaagcccataaaggatagttctactaatctctttgtttattaattttgcattgttttagacatggtaagcgtaatataggtctatccatgttctcattttcttcaagtcctatttgataaaatagacatactttatcatcttacctgttttagaagagctcttcaaacaaaccgaaaagagaaaatcccttgtgtgcccatgaaaactcatccaatcccttagatgccctcgaattttactcgatctcctctgtacccctcaaatttcgctttgatcccttccatgcccctcccgttaggtttccttcatttggcagttaagtgtggttccaaatgtccaaaatacccttctgcaatagggtgagcaatgtgtatcttccgtatgagcgacagctagattgaaaaaaataaaacaaatggtgactgaacaatgtgtattttgaggctaaatgagtgtataacaaatttattgtggtactgaaaaatgtaatatatctttttgtttaggaaaaataataggatgaggaaaagcaacatgcatgagtttcctctatagaagaaattggatcctctgtacaagaaaatgattctaatacaataagagcatcaatagcttcatacataactatagaaacatacaaaaaatcctttccatacataacagttcatatcatgcacacacaattccatttccatacccagtagtgcaggaaccaaaccaacttttcattccatacatcaggagcacaatggcataaggtccataatagtatgtccataacagggacattttatgagaaagcaatccttacaatagcgaaatgagatatcaactatgactagagcactttgcagggcatcacaacaacaaaacccagcagcctccacaagagaaatggcagtaccaaaataaaacctaatcagtaagccatatatatgatttagtccataagctttcttttgctcctagtgcccattgcaggactcttatttttgctccttgtgcacatagctgggctatcaggagtaccagaacgtgatggctttccctttgttttgctcttcgccttttttggtgcaacggtaggtgttttatctccaatacatggcaaggctacaacatgttagatggctcaggttgattagagccagtaagtgatcttgatctagaaaagagagttgagaataaattgtatagaacaacataatgccagcaaattgacataattgatctatgtctcttgatctaattacttacctaattgatatacttgaacatgagctattgttccatgtactattgtcctcagtgaaatgaaagttttgactgtggaaaataaattgttatatacctaactgatctaaatccatgtagaatgaaataaagaaatttgcctaacctaggagagtatgccattattggtgtaactattggagcagccatgataattaaaaaaaagggctcgctaaagcactaaatcattcgatagtttaacacattaggggaaaaaacgctgctcttgtcgtctcggctgttgttagcttcagctactggctgtagcgctgctcttgccaaggcaatgcgagtgaccaaaatttgtcgatgctagaaacagcacaagcttgcaacaaacagcgcggggaatgcatgggaaattccaaatagaggttggacaatgtcgctgaactcctagtaataaagtgccctaggcctaggcagtgttgttggtctccaagcgcttgcaaggaagctccaggagaggcagatcattgggatactcacgcgtcgattaggtatggtagatccacccccaataagaagtgcaacaaaccaacaggaaaagaagatgattaacttaccggctagatgatccccaactgataagatccccaacttcctttggggtttctcctcctgctccagggagggcggtggccggcggcccgtgtggcgggaagaagacagctggacgacgacgtgcgcggcggggagggcggcgcgcgcggtgggagggcgacgcccgcgcggcaggaagaagacggctggacgacgacgcgcgtagcgggagggcggcgggacagctggacgacgacgcgcgcggcgggagggcgacgcccgcgtggcaggaagaagacggctggacgaccacgcgtgaggcgggagggtggcgtgtgcggccgaaggggtacggaacagcagcgctagctactgcaagccggcggcgcgggaggccgctcgagtcgagtggataagaggtaggttgaccaaaaaggggataagacttagggttggaggggcattttggcattttttaaaaatactgacaatactacacacggtttgattaccatttctaacggaaacctaacaggaggggcatggaagggatgaaagcgaaatttgaggggtacagaggagattgagtaaaattcgagggcatggaagggattggatgagttttcatgggtatacaagggattttctcaaggaaaaaagactactaaaggtaactccttgcctggcttcatgaaatttctgctttccctagaatctcactttgggataattacgtctacgcatcaacatgtaaatcaggccattagtattaaattacattcatatatgtgccacgtgttgctatattatttcttaaatgtatcgtctgattccatagattctgttaacactgacacttcgatgcaaatgatagtacaaagtgaccgttattttgcgtgcttttgctatataacacattctcttcggatgaatatgtgttaggctttgtctaatatttttagataatgctataggcaaatcatcgaactgagagatacaagcaccatatttaatcttgagtcaatatatgtttaatgtttagaacagagcatgagagcatcaactatttggatattcatgcagcacattcacaacaaactagcatctacgtcaaagagcaattgccagaccgtacttttttttttaatatacgacgctgttgactttttaaatatgtttggttatttgttttattaaaaaattacgtagttatcatttattttttatggcttgatttatcattaaatgttttgtaagcatgacttatattttaatatgtttgcacaaacaaattgaataaaatgagtagtgaaacgcatataaaaagtcaaatgtgtcatatatttaaaaacatatatagttatttttagcacattagtatttttcttctgtaatttagttaataagccatcttacattttcataagttcccgctgcaacgcgcggggtatttttctagttttaatatggaaggagtaccacatattatatttagactactaattttgtttataacatgatatcaacaactagtactatgaaattaacatagtgtgatattaatttctttcaaacacggatataatgatatagctaggagtaatatgcatgcagggggtgaaaacggttggaatcggttgcatctctttgaaaataacactcgatcagtcattgatcattggccatatttatcatttaaactattcagtgttgatattaatacgacgtagaaagaaattagaataaatggaatttatgtatagccaaaatcgataacttaataaccatgctataaatttaattatttgggtggcagtaaattatggtggcagctataacctggcatgctgctaggtgtgaaaatggtcacgaaaattccggatcgagtgagtatcattttcgtataaagggtaacgttttccaacagttaccattttagctatatataattttttttatttcgttttctcaaaaaaatcacatcgaatctttaacacatgcatagagcattaaatataaataaaaacaaaaactaattgcacagtttgtatggaaatcacgagacgaatcctttgagcctaattagtccatgattagctataagtgctgcagtaacccacatgtgctaatgacggcttaattaggcttaaaagattcgtctcgcagtttctagattagttatgaaattagttttttcattcgtgtccgaaaacccctttcgatatccggtcaaatatccgatgtataacacaatttttttttcgcgaaccaaacacacccaaaggcacatatggtatacagtacccaggccctgcaggctgcaagtagagacaacagtttactcgtactccctccgggaaaaaagacaaatcctgggtttccgtgtctaacgtttgaccgtccgtcttatttaaaaaattataaaaaaaaataaaaagacaagtcatgcataaagtattaatcatgttttatcatctaacaataataaaaatactaattataaaaaaatttcatataagacacacagctaaacattggacacggaaatcagggtttgtttttttacggtgggacctctgtggatcggcaccgtcgattctggatccaacgggcctgcagtcagcaatggcgtcatcacaggcgcggtacgtggagatcgaggtgaaaagggttgacgttgatctgaccgtcgggcaggcaggggtaggcatacacggcaagtcagcgtctgtctcaatccctcaaagctgacactcgccggccggcgtttgcactggaacccaaatttcccaatggaaactgcatctctgcgtgcattcgatcacctcaactcaccatcagtatctttccaattaaggctctcatcggatggcctattcagaaaaaaataattaaaatttaaatttttaaatttaattttgatattaattttgagatattttcaatgtagtttctttttcagcattggcttttaaatcaccaagaatatatatataaaagttttacctataaatttatttttattctctaataaaccgttttggcttattagaaaaaagacaa

SEQ ID NO: 78359 - DNA, 33935 bp, Oryza sativa
  unsure (1)..(33935): unsure at all n locations
aaagtttttatgttttttctacaaatcaaagagacatgcttcttaatttgagtcttttttttggataataataggtgataaaaatagacgcttgtttgagcctatttggctatggcttgtttgagcgttttagttgcagcttaattataagctaaaggattcattacgtaacaaaaattaaaaatgtaacttgtataccacgtattcttagaggttttaaaccaaaagttccatgatgagttaaaaccatgtaaaaaattaatggattaattataattcaaaattattttctactagggcaaaagttatagatccaatccaaagaaggccttaattaatatatacttacttcgatacttgcaacacatgatggaagtcttccattagagccagcgaggagatacctgatcgacctcttaattagcacacacaaaggcgcgcatatatttactacttctctccgtagatatatatcatacgcctattaatataccatgatgactaattaactaataattatataaaattaaggtccttcacctaacactttgtaagagcaccatcaacaggtcactcaaatactaaatcccaaaattccatttaagaatttctaatatgcattttggattttagaaaaaaaactttaatccaatagactgcctagaatattaactctctaagacaaaacaagtgaggttactccgatcatctattagagcaggtacaatagcatgctataaaccaaccataataaacatatttaaaggagataaaagatgtagtcagccataataaacatatttaaatgagataaaagatatagcacggactacaagaaccataataaacatatttaaaggagataaaagatgtagcacatctattagagcaggtacaatagcatgctataaaccaaccataataaacatatttaagggagataaaagatgtagtcagccataataaacatatttaaatgagataaaagatgtagcacggactacaagaaccataataaacatatttaaaggagataaaagatgtagcacggactacaagatgtatgtgttgtatgtgtgctgtaacaggcctctctctagaactatgtagccaaggagataaaagatgtagcactgtaacaggcctctctctagaactatgtagccaaggagataaaagatgtagcacggactacaagatgcatgtgtgatgtaacactctctctagaactatgtagccaaggagtgtagccaaggagataaaagatgtagcactgtaacaggcctctctctagaactatgtagccaaggagataaaagatgtagcacggactacaagatgcatgtgtgatgtaacactctctctagaactatgtagccaaaagatgtagcacggactacaagatgcatgtgtgatgtaacactctctctagaactatgtagccaaggagtgtagccaaggagataaaagatgtagcactggaacaggcctctctctagaactatgtagccaaggagataaaagatgtagcacggactacaagatgcatgtgtgatgtaacactctctctagaactatgtagccaaggagataaaagatgtagcactgtaacaggcctctctctagaactatgtagcaaaggagataaaagatgtagcacagactacaagatgcatgtgtgatgtaacagacctccctccagaactgtgtagccagcccatctaacgggctctgacaggtggacccacttacacacaccaccctgtttacactttcgtcttcgcttcgtgtaaaagagttaacctgtgagtgacatggttggagggatgaggccttataaattggttccacccttactagactagcaaggtggtactaaacatgcgcacacagtttacatgggccacacatgcctcattctaattgggccaggatgtcatatatatgtgtatgagaggtgggagcaggtattgattgtgtactatatgtttataggtaattattgtatgaattggctataaaattgactatagatgatttgaagctggtagttggctatactattaaacttgctcttaggagttgctgcaagctcccgagctgtggggagtatggatatgaaatttataaattttggacaattaattaggaattgttgagatttgtttgaggggacagtgcatcataccacagttgttaggtaggtgtttgtttctctgccacaccttactaacttaggcttaccatactttcttatactttgggctcacaaatcattcactcttttatttttcaaaccacatgccacgtactgcacatttgtggcttactaattcatgactgcacttttatatcatattgtcatgccacactttagctaataaggttagttgtggcaaagttagttactgcaaccaaacagccgctaagtgcttattagctccctatatatatctctattgcggtgtggcatcatatcacacgcaaaactaattaagatcgagattgtccgtcccagcgtacctcgacatggtcggcggtgagcagagccaaatccaaggcaacggcggaaatggctgcagcggtaaggtggtacatcagcggcgcctagtgatcaacctcgaggataagaaccaccgggccgatctcctcaggtacgcggtcatggtggacgccgcctacaagacgttcgatgaggtgaagaagcaccccggcgagtcctacgagaccgtcttgtccagccgcctcgccaccaatgctgggtacgtcgtcaccgcccacctctacgccaccgtcgagccactaccactcccgccatgggttgtcgactcgttgccggccgccatcgccggcctgaacaagccgtactggttcggctacatcgccgtcggcgccggcaagcagcagggcgacgactgctgggacgacatcgtcgtcgtgctgcgcggctcggcgacggtcgccgacttcatgatggacatccatgtcgaacgcgtggcgttccaagggttggacggcgaacccgccggcggtgaggtagccgaggggttccacaaggtgtacaggtccaacgacgcggacaaggagcacggcgagctcagcgtgcagcagcaggtcgtcgaggaggtgaagcggctggcgaggcatctccgccggaagcagcagcagcccggaaaactgatccgcgtcaccatcaccggccacagcctcggcggcgcgctcgccctgatggcggcgcacgacgccgcggtggcgctggcagacgaggaccgccaccgccgcagcagcgagccgttgatcggagtccgagccgtgacgttcggcgcgccgcgcgtcggcgacgacgcgttccacggcgccctcgccgcgcgccgcgtccaagtgtcccgcgtcgtcgtcaaacaggacatagtgcccaagctgccggcgaacaatgtgcttgacggcgactacaacatcgagctcgacgaccatgatgccagcaagtcgccgcgggagctgatcaaggcacacagcctggacatgtacatgcacctcatcctgatgaccttgccgaacaccgactactactccaccatgttcaagatcaacgagaccagtaccgatcaggcgccggaggcggatggcgaggccgacgacaagcccaagtggatcaaaatgcgagaagacaatggtgacggcttcatgcgtctgccagtctcagatctggacgacgctttattatagactgtcggtactggtagcaatttttaaactttggctttttaaaatgggacaccttcttcttttatataaaatatgtcgacaacggcccgacggtttgaaaaaaaaacttttttccaaactttggccatatatatgcttccaccgattcacctgcaaaaagtactgatctatttttcatgctttcatactatttttattacccggcctctcaatcataatggcgcatatcgctatttaaaatgtacttttatatgatttccggtgatgttatcttttttcgagcgaataatttccagtgatgttttctgtaataaagttaaatgtgaccataccatgtcaatgacagtctgacaataaaattgcatgcatttctcagtggctgaagattaaccatttcccttgctaacagacacagaagaatagaagaatatattaatgttctcattacccatttcccctcagagaaatgcatttctagatatatattatccaacactgttaatgccaaccagaatcctgatctcaaagtgtaccacgcctaatcttaaatttcacagttgggagtcatcgacaagtgttcctacaaccatttggccagttaacaaaagaattgcgcaataaatgaagtggtttagttccttttttacgagttacatgttccccatgatcgacgctgcaagaccaacatatatagctgcaggcaagacgcttccgaaacagcttcaactgtcaaggagatgtttttataaaatttagtcatctacgttagttcatgattgtagctacctatcaaggagatgttcttttaccttcaggcgatgtcccctcattcttagttgtcatccgaataattatatttttttaaaagaaaatcacaatatagattaatatgtaatatatcacttcataaaatgtaagtataaattcaattcagctattcagttaattaaaaaaagaaacgaatgtgattataaatagtgcatgtactagttcagcttttttttcaacttatcgtaggacatatttaaacttacatatgatgatatatcaatttttttatctaagttgtcaatttctttcaaaagcttttaatatataacagtttggatttcataccagaaatgagggtgtaaaatcaaagcgttttttattgttattctgtgatgaacaattgacatctgtgtttattggttttgatatttggagattattggcgaagtggttttggagatgactgattttttcaggtgataaacagggttactgtttcttgtcaggtccggtcagaccaggcagtggttgcctgtcagaccggcgctatgcgagcggtcagaccggtttagcccacggtctgaccggccgactctgtgtcggttttagtttcagtttgtttgtttggatatccgtgattgtttcgggtttatgacttctagatggatactatgtgtatgtaatactgttgtttgctactaatgagtcaagttggagatagcttggtctcggaatatggtttctttgtttgattcatgtgtaggtgacttgatgcctcgggagagtattgccggtgatggatcgggagttgacttggggataaggcgacgtccgtgacggtcagatatcatatgggatacttaggctagagttcaatgcacgtggttggtgaagattccatatagcatacgatggaggtattgtgtgccccgagtttgtaaagtttgtttcttgtacggaaaggtttcctaggtggattagaacttctagtatgagtttggttcgtggctttaggctgcctacctcatgtataaatagagagggagcgtgaggtttcccggtatcgcttttgagagcattgagttgtgagtttagttagggtttcgagtttagtcgagattttcgtgaggagtgctgttgttgcactttgtaaacacagagagaagtaaaaaagttgtcatctactttgagagttcttcgatttatgttttctcgagttcggcggtctaaccggcgaaacaccggcgatcagactggcggcattgcggcggtcagaccggcggcagctatacaagcgacatcggttgatctcgcggtttgaccgaaggttcaacctcggtcagacggtggtatccatgcggtcagaccggtgcgactacttcggtcagactacgatccgtcaaatttgagggtaacttttaattccgcaaaaagtttgggtttttgggtataccaaccattcatccctctctaattggcttagttcttgtgtttttatcctacaaagggtacatccccttgatcattcatgattttccactatcatgaatatccgtgtttagttattcttaatctgattcaccgttacttgatcaaccttgatagctcacacgcatgtacattgtgtccatgcatggtgatgacttacaatatttatataaataggcatggtacggtggactgtttggccagacagtttcaactatatataccttagaaaagaagcggaacgggttacaatgctcttacaaaataaattagaaaagtggaattgatttcaggttactttactccatatctaactcttaaaattaaatttagaagttaaacccctgccacctgatcntaagatggtcactcgataccaaaccaaacccaaccaatatgagtacttaacttagtatgtgagttaaactttggcttggtatgctccttttatgttggacctatgcttaatgggacaattagttcttaccactattttaacttgtaattttaccctcattcttgaactgcaatttgtgtttgcccactcctatttcgatcagacttcacggtgttaaaactcatctatatatgtctttgcagatttaccactacttccctaagaactttgtgactttgcccttgttttgacattaaaaattttgagatgaactttggccctactttaatagcaatattcacttattcaagataaggacaagtataagcttgacatgaactttgcccctgttttaacatgaattttaacaccattaaattcccctaatgcaataagggcaagtacaagcttcgtcaaaatcataaagttggaaaaacatgaggaaaatcataatttgaattcaaaacatgataataacgcaaataccccatgcttaatttgctccgaatttaggcttcgtttagttcagcttatcagttgattagctagtaaatgaatataaggatcaattaaatatataaattataaagttaacaaataggttagaaaaaagttatctgcgcaatgctgatgaatttttttttttgaagaaatcgtaattataaaagcatgacacagataatagatatgcctccattagttaaaaagaaaggttattgtttagttattagttaattcatgatttttcttgaggaaaagttaattgacaattgaattaattaagggaatatcttcaaaaaaaaactgccacaagttttttttagtcaaaaattttcaaatgtaactatagtataattgaaatataattacattataactatattgtaactacacttcctgacccaatatgcatactcacatctctagcaatggtggcaatgtatataagatccccataaaaaatgtggctacatctaatcaatggactagtggtttcaaaacaaccaaattatttcccaaccattaccactagctcggtagttgcattggatcttgccaagaaagcatattttgcaccttggaagattaaataggaagacaggaaaaagtgactacgaattcctctttttgtttgtgaatccctgtttgtatcctttgagcgatattagataagtatagaaaaatcaatttaaaactgcaagtgcatgtgcacctacaccctttatcattattttctttaagatatatgtatgtaagtatagatttcaataaagtttaattatcattatattcctctttttgatatagcatgaatcacaataaagcatccaatgactcggtatgtaatgtaggtgcatatgcattgcgttgtaaaaatcttcttctaataagtagaacataattttatattactacaacaaatgcaaatggcagtgtgagagcatcaactcacgattgccctgtcatcacaaattttcaatatgaagattccttgtgcatgagttcatatatacacatcccgaaatgcttttttatatccaatggatggtttccattttagtaaagtacatgggcatgcataaaaaaataagattaggatgttaataattagggtcgtcaaacatccttagccaatcaacacaacttatagatgagacaacatctaagttggggaacaagacagagtagatcactagggaaataatttcaacaatattcccaacataaacagagagtcataacctctggctgcctccgccaacccagcaagcaccacgccacgcgaaggggagaaaaaattaaaatcacaggagtagaaaaaatagagaagcatgtagaaatgtggacgagaaacaaaagattaaaaaacataaaaaaactgaaaaaaaaacaatcgttcggatagggcataagaaaaactcatgaatcttgattctttattagaaggtataacgtggtagcatatgttatctatttttttgtgcttagagcacctcaagtataatgctaaaaatcgaactatgcgtaagaaaaaccgaactgaccacacagtgagaaagctctaagctagctgcatccgaataatgatgaactaatgcatgcatggttccatatactccctccatcccaaaatgtttgatgccgttgactttttaaaaatgtttgaccgttcgtcttattcaaaaaatttaagtaattattaattctttttctatcatttgatttattgttaaatatatttttatgtacacatatagttttacacatttcacaaaattttttgaataagacgaacggtcaaacatattttaaaaagtcaacagtgtcaaacatttagggaaggagggagtatataattatatattcttctccatcttatccattccaatgacaaattgacaatgaatctcagatccacatgtatatatgcacgaaaaaactatacacacatgtggttgtgtccagtgcggagccagggatgcagccgtccacctaattctgggatgttgatgagtggatcttgccaggagtaagcctgaaattagaacggttagataagaagaaataggtactagtaagtactattacttaatccaacaaatgcatgtgatgacgactgattaatcaattataagtcaatacaatgttacttaaaaaaagaacaacaatcgatttttcactagatacatgcatgtgctaggcagcttaattacacatggaacatgctaacatttttttaggcaaaaatctaaatagtgtgtaggcgatgttttgcttaactattgcacggttttttcagttaatggttttgacaacctatatcaaggtaatatttttatgatccaattatatcactatattcattacaattaaatatttataacatgatctgatctcatatgattatattccgatgaaagaatttctagaaaaaagtataatggtgaaagaatttacttttatcatatatgtaaattagttttggaattgaattaattacttcttagacatttatgaaaataacttcaataaaacttaaaagtaatttatacaattttaaaagtaacttaacaaaaaaaagttataacggcaataaaagtaaatcctttgtgggattaatagtatactcacacggagaacgaagaagtggccgttctgatgctgattaaaatttagcctaaagacttaatgatcactatcatgtactcaacaacaaaagtaggagatgtataccatttttattattaaaaaaaactccattactttatactcgctccatttcatattataagtcgtttgacttttttcttagttataactactttacgtttgatcgagtttgtagaaaataatagactaatattttcaatacaaaacaaacatattatcaaaatatatttaacactaaatttaatgaaactaatttggtgttgtagatgtttctattttttctataaacttgatcaaacctaaagaactttaacttaaaaacaatcaaacaaaacggagggagtactttagcaaggtcggaccggctatatataatgcatgctgcattgcagtgtgtttacacacacactccaagcctttgccttgcgttgccatgggcagcgtcaaccagagcagcctcctccatggcatggcgggaaagctcagggcctctttggttgccgccaaatgcagcaatcgattcgttcgtttgcctgcagcagcagcagcagtcgactctgctcatcacacgagatcaagatttctttcgtcgcaggttgccacgagtaaggtgtacgagcatccatcatcatcatggcgaaagccggccaggacgtcgaggatgatctcctccgccatggccgccggcgccgacgacggcgacagagacgagctcctcggctacgggctcatggtggacgccgcctacctgacctacgacgccgtcacgaagcagcagcccggcggcggcgagcgctacgaagccgtcttgtccggcgagctcgacaagctcatcgccaccgccgatgccagccgccgccgccgccggcacgtcgtcaccgcccacttcttcgccaccattgagccgctccaggcggtgctcgacgctctgcccgtcgtcggcggcgtggacaagacgtactggttcggctacgtcgccgtcgccaggcgcggcgactgctgggacgtcgtcgtcgcgtggcgcggctcgtcgacgctcgccgactggatgatggacatgcatgtcatgaatctcgtcgacttcggcggcggcgccggcaccgccggccatgtggcggaggggttctacaacgtgtacacgtccaaggacgtgaaggtgaagcacggcacggtcagcgccaaggagcaggccgtcatggaggtgaagcggctggtagaccatctccgacggcgttccggcgccgccggcgagaagcccgtcaaggtgcgggtgaccgtgacggggcacagcctcggcggcgcggtggccgtgatgaccgcccacgacgtcgcggcggcgctggccgccgacgccgacgccgagggcgttcgtgtccgcgccgtgacgttcggcgcgccgcgcgtcggcgacgacgcgttccgccgcgccgtcgccgcgcgcggcgtggaggtgttccgcgtcatcgtcaagcaggacatcgtgccgaagctgccgatggggaaggagtacgtcgacgccagcgacggcgactacgacatcatcaagctcgacgacggcggcaactggttgtcgccgctggagctgatcagggcgcacagcctgaacctgtacctgcaactcatcaccctgcgtaaccccgccatcacttccgtgctcagcaattcgaacagcgatgcgccgccgccgccgccggcggtgagagaggagtgggtgaatatgaaggaggaggagggatacatgcggctgccgctggagaagctagaagaggagctggacaagctagagggcccaagcccaagaaagtgaccaaagtttgaagcccatgactgaaatttccctaacttgggccatgcttcgaacgacttctgcagaaactattacttttgtaatttgtatttgcgttcatcctattttgtttactcctcctgttttgtttaatctccagataaataaaatggcatatatcgctgtttaaatatttgcatttaaatggtttgtagtgatctttttccataataacgttataaattccagcatcacgtcagtgacaatctgacgacaagatgtttacacgacagaacaagaaaatggatatgggttgtacaaaataaatcattgcatttctcaatggctgcaaaattaacaatcttccttgataacagatagaagtatatagaagaattagtttttttttctgaatacaagttaatttctcattcccctccgacaaacgcatttctagatctatccaacactgttaatgctaaccagaaacctgatctgaaatagtctacgcctaatctccagaaatttcaagttgggagtcatcgacaagtgttcctacaaccatttggccaggaaacaaaagaattgcacaataaagtgggttagtccctattttacgagttacatgttccccaggatcgacgctgcaaaaccaacataaatagcaggcaagacgtgttcttctgaaacagcttcaactaaatatatattcatggtatctgcaccatccacataaagtaagtattagacagttgggtgtgatgaaaattcaaagaaagtgaacactgatttgcaaattgcaaaatgttgccgtcaaacatagtagattgattttcatatggcagttgatattatgtatgtatgtatgtatgtatgtatgtattacaacaacagctctgtcatacgcttgaatatttcaagaacagataactaaagatttgcaaatgatgctggatgttttgcaaagaaacaacattaagcatgcagtgtgctgcaagaaagtatttttatgatacattactacatttctgcatcaaagtcttcctctgttatgatctaaacagaaagcagcattgatttctttctctttctagaatagcatcaggtaaattgaagatggtctacaactctacagttacagtatggtttgccactttatcgtgtgaaaaggaagacagaaatttgtcgaggtccaaaattgacttcccacaaagaaaaaatcagggcaaatacatctacacataattactttactatgatgtggataataaatacaaaatgagactattgtttagggagccaagcaaaaggcagtatgtcttattctcttcattgactaatacttcgaattatttattaattaatcatttaatatttaaaaaaagtagatattctgcctgacacattactaaatttgttggtgttaattcacttctttttcatagattggcaagattgttgttcatgcatccacaacccatcactagatctatgggaagtacagaagatatttgaatgctgcaaacaaaaaaagttcaagtagcactaaccactactgcggtgggttttgatgacagaaaccttctgagcctcctttttaaggacatatgacatggattgacaatcgaactaaggaaagtgtagctaactaagtccattccctgtgtcatctgttctggaactcttgtgctgacatacacaagccatgttaacaaacaaaaacgaattactctatgaggaaatttgcaataccagcaaggatcataatggctgtgtgtgctaccttacttttcttgtgcttatgcacatcggctgaatcctccattccctcatgcttccttttctgaaagatgtccaaagcccagcatatggaaagatggttagctatagaagttttcaacatacgaaatttcctacattaaatggacaaaccttctcatgatgtttctttgaatgatcgccaccagaatcatgatgcccacttttatcctttttcttgtccttatccttgtctttgtctttgtctttactcctatctttatgccgatgtttgtgcttcttatgctccttgtctttgtccctgtctttgtctttgtgctttttatgcttcttctctttgtctttggactcacttttcagtttaccagatatagtcggtatacccttttcagcctgatgaatggttcaatgttgtaaagaggacaatgagcaaatgaacactgtgatagcagaagtaggaggataaatggatcttacagagggcaaatctactggagccgtttctcgaagctgaaatgcttgccccagtgtttccatgtcaaacggctggatataagcaggcttgtccctcaagtatgcgttctgaaccagctgatctagctccattccttctcctttacgaatttcagtgtccccaacaacattgtcaagataatgtgtatctgatattgccaatggcaaaggcttcttgcaaaagaaatcatggtgggcaagcaatttatagtggcttattaaatcaacagcaccagtgagctccctagggcctgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcagaatccatcaggttgaatcttagcctaagcacagtgcatattcacctgaaattcaattgaacaaaattttacaactagcgtacaaaagcaaagtcaataggtcacagtatgaacttacactgtggcttaatcgatccctgttcccggaaacagaatatctaccaaaacaaaattgattttcatttcccaaaagcagacccatttattgaaaacaatttatcacatttcaaattagatcatctattatccatctatatattcaaccacataatgccatgactgcaatactgcgtaaatattaataaacagattgataagctaaactccaccaatcctggaagacacttacaataaatattctcatattatggaacatatatcttagttttcttgaacttcttagtacttactgtcgaactgtcaaagtatcacaacgaggaaacttaagtggctctatgagttttaaaactggttttctttcacaatttttacgatactggaaaactgaagattgtgtacatttctatactgacaacataattctcttgttccacatagtatcaaagtaataacagagtagtaacaaagttgggagatggatctctaactctctatttctttgttgaacatgaatgaagcagtaacatagcccaagattgatacagtaaaactggagagacataaggacgtggagcatgcatccaaaaacatctcttggttagcagacagaacctttgtgtgatctactttctagcagatccaagcaacattttgtaaataatctaaagttctactcacaaactttgacattgaccccaaagtctagaagattaatgtgcccaacacaactctgggttagcgggtagagcgttggtggcttggtatgctctatttctaacggaccaagccataaaccgtatgaaccctacaacctttacctacattgtttgaaatcagctcaaatctccaagagcccactactagaaactgaaagattaatgctcgccagaccagaggaacaaatttatcttctccctacaaaaaaagagcaacagtttttactcctcctttcccttttggagttaaaagtcacacaaaacatttttctagcacgccattcttgttgtgggggaaaatgcacagcatatggcggcatgtttctatcgtcactaaattgatgatcatgcgaactgcgctagagttcggcacataacaaaaaaaacgcactcctctgctactgcaagtgtgcaatgaacccagcagagcatagtatattcaactcgaaaaccctagttccacagctcccccatcaaaccctcaactggaattacaccgattggacgtggcagcgccccgggaaagattcggaatcgggttcaattgctcgcagcaacagcgagagaagcaactcagattaggtcaaactttagaaccaagtaaccaaacccaccccaccccacccgcccacccaagcaaaagctagggcttcctcaccggataagggggggaaagaaccggcccgccgggtcgtgtgtgtgtctccgctccacccccgccgagctccgggcccgaagaggagcggggagggaggagaggaggcgtcgagtctcgtcggcggcggcggcggcggcggcgggattcggggagaggcgaggcgagtccgaccgaccgtcggcccgcacccgggtgggggggctccttatgatgcggtgcgacgcgacccggcgaccgagcccctcccgtttcgcacacggagaggggcagtatggtaaataggcgagataacaatggggagataaaaaaattgaatatttaactatttgtcactcttaatatatgacaattaataatttgtcacttgttgtctatgacatgtgggcccagtgacgtaagagtggaaaatagttaattattttataaaaggggatttttgggaaaaatataaaatcgaaaccaaacagtataccttggttcagtttttatttaagaaaaaggaaataaaaattcgctgtagtacctttgtcctataataattatatttctaagatttaaatttgttccaaaataattatcacatataatactaatggtctcattaatcacttctcattcagatttcttcttattttacactcaactatctttctacccttatataaacaggaattactttgataaggggattcgccgaaaccaaattcatattcaattataaacagtaattgagtcgattatataaagtccatgctcgttttagaccgtggaggatggacggtagaatattctgattttgtgtcgattatataagaacaccaacgaatgaattaaaaatcaatgtttaaaaatttaaaaatggaatttgaaaagtacgccatccattttattttgtttaacgttgattatttcaaaattagacaggtcatacatttgaaaatagaggtagtacttttttcaaaaatcacaccgtataggagatttggtactaggaccagtgacataataaatttggacaagaaaaaaaatagcagttttcgttgatagctcgttctttagtccgtcgaattctatggtcaggctacctggctgacacatcagtacatcacacaagaaactcaacgctatattttaaacagaagcaataatgcaatatatccaaggataacgtctgcgtgaaattcaatcttttttctaccgagcatgcattactaatttcaggacataattgacttctctgttttttttttctttcaaacctttgcactgctatagagttggcacattcaaagaaccagcacatactggcatacaaccaacaaaagaaatgatataatctcatccaaaactgtccacctccagttagtgcataaatagcagacaagaaaatgctttgcccctgtaccgtacttctagcagctaaaatgcaaatgtgatttctgtccctgcctcaggctttcatttccccacccacattcgcattcacctcaatcacccaaacacagctgtatggtactcctagatatataccacatgagctccgggaggtgaagcagtaaatatcccaccgatataatacttatcttggcgtagaagagctcctgtgaaatggtatccgctgtcagtcgagcaagacgaattcaggtcaagcaaatggagaccctggtccatgtatgcgcggcacaaaatattgccttcatggggggatcgatcgatgttgcctgctgtcagttgtgaaatcgaaggagtggatgagtgagcgtcatctgtagttacagcagtgtgctcggcctgatgacagtttgttccagaggcacagcatttgccaaggtgactggtaatgcgccgtgaagtagttatgcacgcagccgaactggcagaacctccagctgtgaatgtactgaactggcgcggtggtgttgaagtcttcgacccacatgcccatgctcacatcttccatcttgaacaactgcagtgccagtcaggtgacaatcagatagcattaacggtatgtgcagggaaaaatgggtgcaatgaagtttcagaataagcctcacccttagggagtgatttgcatggcgtgatacgatgtctcttgcaatgtcgattgaaataacatagcctggtccattggcatatggaggatacacaaattctggccattcctgttggtacccgccatgtttaaagtaaccaaatacatgtcaatccagaaagtttacattttacaaaagtgaacatacctcgtacgtcacagcccatttaccatgccggagaggtctgtgtaacaggtttaggttacccatataaagaggcatggttctgttgtagacggagatctgtttcaatactacatccagcctcacaaaggtgtcatcatcacatttcatgatatactctgcggttacattttgcacctacacacatattgcaatagtatctacttgaggaaaaacatgcatgctgtcagaaacattgttcggagctattttgagatgtatatgacttaccccaaattcacatattgcgactgttttcagaaccaccagctcatatcggtcaataaatggcagaatgacaacatctccaaaataatctgcttctgtcttaagtgctgcatttatctcttttctatgactctacagaagcataatggtcacagacttctgttattgttattttgggaaactattttgaatgagatatgcagaaattatgtataacagcatttgcagcaaatacctaataaatgtgtagaaaattatgagacgccacaccacccaacgtgggggggcgattatatttatatagctaaatacaatagagattacaacaaactcttaaataagatatatatacatatacgagagatacttagactatacaaatctaatctaattctaataaaatgtactataatcttaagttaaaaaaatgcaaaaatagcaattatcctcaaatctaaaattgtatatattgctgcatgcgataaaccaaccacccagctacatatacacgtgaagcgcatgcaatgtcatacaaaacaccttgtaaagaacacatatgtctgcatatatctagccacaaaagatctactagagtgaaagatgagtgtaaaacaaaccattgcccccaaggccccaactactcctaagtcctcatgtaatagtaaacatgtggaggattacaaatttacaatgtagcacgacataccatacattaacaaatgcgaccaaaaaccattgccaaatcatgaaagttatcttaccagtgcaacaaagaaccgagcaaccacatttcccagttggatggcagggaactgcatccagctttttcttatagccatgcgctcagcaaaatggtttgtagcagagattatgccaataaaaacctgaattggttcctctggtactgggcgagccttccacctatcagacatttccaagacctgctggagagagaaactaggatggacctttggaagagaggttgcatatatagagtgaacgtctacgccgcctgtcacagctaaacctgtggcatcttcaagagagaatccctgataaacatttgtaatcaagacagtagttactcagtattttcactcgaagaagctagagttctgtacaaggtaacataatattggccaaagtaacagaaaatttaccatcctatgaggaaatgaggcaacatgacggcctcccacgctaacgtgatatccttcgataccagcttggatggtaagaacaaacatcttcccctctgaaaatgggtatggccatctcatttctggtttctttgctcggccgatgaacctgttcaaccatgagcctgtctttgtttcttttgaatcaacactgtctctccgatcccatttctcacatttaattaatccatccactacaaagttaagggagatcaaacataaatacaggcaaggaatcggcagtgttttaactagaagacagcattattttgggtcagatttgcacaaaagaaaccatcaaccatgaaactgcacatttggcttgcaaggcaattccatttataaatgcgggacagtttcaacttttcaccttacaatgtgcattcactaaataccctaacaacatccagagtcaccaaatacaggatagcaaaccccactaggaattagctcaccagataaaaaaaaaattggtgactggttaaaaatcatgtgaaatgtaatcaaatgccagcaatgctatcttgatccacaaatactactattagttacttccaacttcccaacacctagcaatcttcttttattagatcaaagagttagcaatcttgcttacttgtaacttgtgagcaatgtctgaagcatcaattcagcaactaagcaagcttgagcacgactaattgcaatgcaatttgaaaatcaactgtaaagagtggatagtataagggatgtaccctggtcgtcatccttggaggggttgccatcgcagcggtgcgcctttccccactgcatgcggaagcaggtgttcatctccagcacggggcggtggctccagtcgccgcgcagccgcgggttgaggtggaggatcctgggcggctcctccccctcgacggcgcggaggccgcggagctcgacggcgaactgcgccaccatcaccgtcccgttccctttcccgcgccgttccagcgccttcacgtactccggccgcgccggccgcgccgttcccaccaccgtcaccggggaacccacggcgagcccgcaggggaggaacgccaccgtctcgccgtcgccgccgccgatgttgatcgacgcggggcacttggtctcgcccccgccgtcgcgggagaggatggagtccacgtcgcccgtgaacgcgcacgcctcctcccacgccttgccgcccagctcccacgcctcgtcggccatcctctcgagctcggagaagttcccgccttgtccccaccgcctccgccccctccctccagcttcccaccgccgccgaaggatctctccagtgatgcgaccgtaccccgcgacggcgacaccatccccatcaccccgcgcgcggggcgccggatcctcgagccgccgcggcatcaccacctctcccgcgccgccgctcgccgggcgggtgacagccgccgggtcggcgatgccggcgaggccggagagcttgaatgacacgaacaggaggtacacgaaggccaccgcggcgagcagaggcgccacgcggcggcgcgcgcgcccgcggccgcccaggaagacctcggagcttcgcgccctcttcatggcggcgtcaccggcggcggcgctcgccggcgaggagtgggcggtgggtgggattccgggtccggaaagcgggtcgggatccggaatggaggtgagtaggtgggtgggtggggtggcggtttccgggtttgggattcggaaagggaggggtaaccttagcgattaattaatgggattggtgctgacgtggcagttacttataagggcacccacaatggttatctataggctctctataagagatccatgtcagcatattttcctacttggaagagattaaatgaagagagagagcaaaactatctactaacctgaagatagtctatagagaaaaacgagacaatatattagagagctatagatacccatgtagacatactattgagatggtttactattaatttagtctattgctgagatgtacatgttttatagatagcaccttactttatcattttgggtgatctaagatgttaattgctcgtgtggttaatgcagttatgcttgtgtttggagttatctctgcttttttagtaaagtggagtagtttggatgttactactagtgctaccgttattaatgctgctagtagtgatgtcttttgatgttactctgatcaatttaaagtttatttaagtaatgagttcatatgtcattactttcaatgttattataggccctatttaatttacaccaaacttcctctaaactcttaacttttcatcacatctaatcacatctaaaacgttcctactcatttaaactcctaactttttttccaaactaccaacttttcccaaacttattcccaatttcagaaactaagatgttagtgttttttttcattcaaacaatataaaattacacaaaatgagtcaaaagtattttctatgtctaaaatatagcagcccaatactccgttggtcgcaatctaatactacactattattatatttttggtacggatgaagtaagatataaacaagttgatggttggctcttgccctacatcaaacttgttcgaactttgctaggtttgagacggtgattttttttctttcaaatgtttgcaagaattcatgtggaatttatatacatatctatactgtgaagtttatactttatagggattattaaaatgaaatagacatgggcatgaattcttcaagaaaaattagaaagaaaaacatcactcgcgtgcaaagtacaatatcaatccagttggaaaataaaataaatacaagttggaccatcatgtggatcaaaagtgcagaatgccgtttatttaattaatcaaacgagtcctaaactatataaatgactaagtataaattcaataatgcattcactgttaattactgggaacagaattttgtgattgcatagcagcaaacaactacaaacaaacatgcagcataatttgtgctgcttgtactgtcgcggtagccacagccagcttaaatttcttgcagcgaaaactagtgatcgaattgcatttgaaagattgtatacatgaaaacgtgtttttttagttgaactatagaagatgatgtcattagtgtccacctgccgggctctctaaacacgagttaaggatgtacttcctctgtctcaaaatgttgatatctaggacagcatgtaaaatctcatctagatagcaacgttttggtacggaggtagtattaatggttgtgtgagtgtgttacgtgaactaattagggcccctttgaatcgcaggattgagaaaatagaggaataggaaaaacgtaggaattgaattcctatgggattttgaaacacaggaaagtcttcaaactgtcgtttgattagcacacaggaaaaacgcaggaaccttagacacatgaaaaggaaaacatgaggtgagacctcgtgctttttttcctccaaaattgctctagtaaggttcattccataggaatttcaaagaaattgataggaaacaatcctttgtttcaaaggactctatagaattatttcccataggataaggcccctttgaatcaaaagatttatgtaggaatttcatagaattcaaatactataggaaattttcctatttggccctttgattcaaaggattgaagctttccaaatcctatgaaattcctatggaatggcacattgcgggcccctttgaatcaaagaatttatgtgggaatttcataggattcaaatcctataggaaattttcctatttggccatttgattcaaaggattgaagttttccaaatcctatgaaatttctatggaatggcacattgcatatggattttggaggaaatttagcaagagctccaacctcttggaaaatttcctttgagtctatctctctcatccgattcctgcgtttttcctgcactccaataaaacgaccattcctgtgtttttcctatgttttgcaatcctctgttttacacttcaattcctgtcagaatcgtgtatttttcctattcctccgttttttctaccatacgattcaaaggggccctgcaagtggatcttggaggaaatttagcaagagctccaaactcttggaaaatttcctttgagtctatctctctcatctgattcctgcgtttttcctgcgctccaatcaaacgaccattgtgttttgcaatcctctgttttacacttcaattcctgtcagaatcctgtgtttttcctactcctccattttttctaccctgcaattcaaaggggctctaaaatcttctagaattcctatggtttttctttgattcaaaagggggcttaaagaaaatactgatgatacggtgatagtagtatgaattgcaatttgcgaccttgtcctttcctagccagcaaatgggatccagccacgtgtccacgacaactggcagttgccttccctctcatcagagcaagtttaatagtatagccaactattggctccaattcatctatagccaatctaatagttcattcatacaatagttatatactgcactattgatacttggccccacctattatacacatactgcgtcttggagttcatgctacagctggctataaatctatagctcgctatcattctctctccttatttatctcattaaaaatatatttacagctagcttatagcctactattgtacctgctctcatcacgcatcgctgttccacctcatcagagcaccagaaaggccacgcttgggccgggcccaccgatactttcagcccggcccacacatgcgaagaaggcccccacccctgcacgacacgtcacctcggtccagtgggccccacgcgtcagtgggacccgcgctggcagtcgggccgaccaccacaacacgagccgtcccgtcgagggggtggggcccacgcgcatcggacggcccggccgccgtgcgctccgtcaggtcccatcgtgtcggcgccgaaccaagcggcatcgcggggccggggggggggggggtgtggttgccggcggtggtaaaaccgtaaaaaggtgaaaggaaaaaataaattgaaaaggccttggagcgtgtggtaaaaaagaaagggaggtcggcagggggtgaaactgcaaggctatgttataaggggaaatgagaggttagattgagattgaaaaataaataaagggttaggattaaatgaaagagaaaaaaataaatggttaggatttaaagatgtcttttggtggatgggaaattatttttctaacccattagtcaacaaggcctaaaagataaaaggctcccatcctaatcagccaaaagaaaaagacaaatttaaattttcaaacttaattttaagattaattttgagatattttcaacgtagtttcttttttttagctttagcttttaagtcacaataacacatatataaaaattttacctataaatctatgtttattttctaataagttgttttggcttattaggaaaaaaagacaaaaggccgaaaaaactgaacagccatgcatgcatgggctggttgtactgggaggagtgtactgtagttcagagcattttgctatcaggtgccagctgaagattttgactacctctgctcttaaattggagtgctcggcctctaatcatctgcttgattttattagctacagcccaaaatttaaatttaaatttcaaatttaatgatgaggttttattatagattattttcttgcattagcttttccgtagtaataactgctaagagaacatgctacgcatataaaagtttgcctataatctattttggtaaaatttactacgtggcacttaaatgtacggtctttgttaagagacactgcaccaacatgaatttacccgaagacactgttgttgtgatgtctcctaacaaaatcagtatttctaagtgttccctgacaaattttgccaaattattttatgtgtttactttatctttccatgacttatgatgtagatcaatcaatagtaataagttcttttagttttgactgctcgtccttttttaaaaaagaaatagtatatacttaaaaggttgttacatattagcaatatgtgtcatgtcataaatacaacttttgtcaacaataacaaattaatcgtataaaagttactcctactaatgagtaaggttaagatatcgatggtaaacagtgataggtaaacgagacagcgcaactaattgaaagataagcctagagagtgactggctgcactgctgctgctcagtacaaataggattactactgtacttcggagtacaaaatgtagtagcactagtcatgactactcctacatacttagatgtgtttagttcacattaaaattaaaagtttgatagaaattgaaataatataacggaaaagttgaaagtttacgtgtgtagaaaaattttgatgtaataaaaaagttaaaagtttgaagaaaaaattgagatctaaacccaggccttgggagtactatacagtcgaaggatttggcaggaacagttgaggaaatcaataacacaagaagtccttgtcattagtgacattgaagaactgtcttttcgaggtaattaaatggtgagatttgggaggacgcaacaaaccttccatatggtgtgcactgtacagtactcattagtatttgcgaatagggggttatactgtggcaggacgtcctcgatcgtccaaagcgtgaaacttgcatggagaggtctaatgcaagtttgacttgatcgtttgatgataagccatggtgtgtacaacatttgaacaatggtgttattcgtttatactgaaaatgaaaatgaagataaagttaaagcaaatttaaaaaatattagtataaaattaattaagttttaattattatttacttgagaaatagaattatctgttttttttaaaacaacttctgtacaaaaagttttacataaaatatcagtttgaaaagcatgctagaaatatatgttaatcaaaataaaatagaccaacgtaaatcaaaggcacaaggctgatttcgtttaggggcaacgtttatgtttgaaaacggtaagtactaactgcacatatatatatatatatatatatacatgtatatatatatatatatatacatgtatatatatatatacatgtatatatatatatacatgtatatatacatatatacatgtatacacatgtatatgtacatatatatatatatacatatacatatatatatatatacatatatatatatatataaactacctccgttttaaaatatatcaatttttaactttgtatttagatataattttatcaacgtatgtaatcgtaagttgttttttaagcgtaatcagaagtatgaacagctgaaaattgaaatcagacaccacaagcgaactgcacggagtagaaagctcgcacctgttgcgcagagctacagaggcgatccacgccgtccatctcccgatcggacggtcggcatactccccgagacacgggcgcgaggaccgcattaaatcgtggtccacgcgcggcatggtggtgggccccacactccggtggggaaagaaagggacgaatcctcgtacgccgagaaacgcacgggggtgggggaaaagaccctgctgcccctgcacgtgcccaccccgccagcttgggcctcgggatggctcgagccgtctgggccgtccgattgtactgcggtggtgttggttccacggatctcgaggcggagcgtcgagactgccgcccaagggtggggtggtaatttggtggagtactacttcaacgtcacttgtacaggaggagcgtggcgtgtggtgggttctttggcttgcatcttaggtaggttttttatttgcgaatgagtccttggatacctcgcacacatcgagggcatgtttggcacagcttcagctcagccaaacaatttcagcttcacctaaaatgaaagtggggctgggtgaagctctctcacaaaatgaactatagaggtggagctggatttatacagctcacaacttcactctagacctaactcctaaagcaaatttaggagttggagctctaccaaataaactatgacttgttactctaaacagtactacagaacattaatttcgctatggtagtagagaagcactcgagtgaattttttaaatttttcaagcggtagataaaattttttgtgtatatatcccgagtgacttaaaaaccaatgttgaacaaaattatactacagaacattaaaatcaactccagaatcaattgtccaaatcaaattttggcaacgtcttataagccatagggcaaacgatgaggtcctatgttttgtcgaaacaaactactcgttgtaaaattgttgtgttaattttaaaactgtggcggtaggacctccgttagcacagatgatacttcaagtaaaaaacatgtgataacaaatcgtgtctagagtattagttgacactatctcaatttctttcagaattaacatttgaagcaaagtaccccttggccaattgcaccgcatgctagtttcatctgttttggaatataggataattagagaaatcttggagaattgaaatagtacatgaatgggtcaagtgacttttactaaatattttaaaattcctatgcaaattttagccgtccgtccctcccattcgtcaacctctctccccgaaaaaaacaaaaaagtacccatagagaaaaactaaaaaacactttgagcaccattgacccataaacatataaaatcattgacccatcatctcccgatggacatgtccttggttagcggaaaattagcaagtattcccttcgtttcagattacaaaattgctttaaatttgactaaatttatagaaaaaatagtaacatttttaacccataacaaaattattatgaaaatatattcaattattgatttgatgaaactaatttggtattataaatattactacatccatattttaatgtataacgccgttgactttttttccaacatttaaccattcgtcttataaaaaaattatataattatcatttattttattatgacttgattcgttatcaaatgttctttaagcatgacagaaatatttttatatttgcacaagaattttgaataaaacgaatggtcaaacattggtcaaaaagttaacggcgtcatacattacaatacggagggagtactatatttgtctataaatttagtcaaacttaaaacaatttaactttaatcaaagtcaaaatgtcttataacttgaaacagggtgagtagtaagattttatcgttgtctagtttttatattagtgtaatcaaacaataattttaaaatttcctatgaattcactccacacataatttaaacgacgcatgacctacggggctgtttggttggtggcctcagtttgccacaccaaactttaagcgtgccacaattttttagactagtgtttggttgcgtgccgcagttgagtcaagccacactttattaacacattggcccaagcgtcatactctcatttgctagccaaagtttgccatagttatggttaacaaattgttggccacactttgtgtggcttgccacaattatagtaaatagagttatggcaaagttagcctccatccaaacagcgtttccaaggaacccaactccaaagaatctagtcaaagataccacaacccgaaaacaaaaataacccatttcaaaaggggcgacttgtaatttgtagcagtggtaagaaataaatctgacctttttcttttcatcagatttgttttactacctccaagaagctctctctccgtttttcttctcttcctactaaacccctcaaaacggaaagaaaaaaagaagaaaaaaaaaactcgaccaccacctccaccactcacacctcgatccggccatggcggcctagccctagcacctagggttcgcgcccccaccaccctccccgccgtctcggagaccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtggaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcggcggatatgccgcaggccttgccggagaacgacggtatatatccttgctcacaatttcgacattgtttcagttctgcactttctcagcttgtgttgatgcctgcattgtaaagtggattatggatcatggagctttgtgattctgcactttgagttgtttgtgcatgattacataatgcataaatgagtctccattgctgccttgcacacactccgcacatacacacacaaagaaaaaagaaagaaaaaaaaagaactactcctacattacttggctctgttcattgccctcatgttataacattatttgatactgactgaacctcctactgtctgtgggcaagtacaaatagtagcttcacatgaacttaactttctggtggtttgctgttcagctcatgtgtgtttggcatgttgcaggggaacaaagatgtctgaactcggagctgtggcatgcatgcgctgggccccttgtgtctttgccagtggtcaggagcagggtcgtctactttccacagggccatagcgagcaggtcagtcacttggtttgtagtctgtgcacatctctttcattatgctaggcatggccggattttgttgactcgaatttactagaatttataaaagaaggtagaacagctctgcttttgcatttgtgcatcagtacataatagggcagaggattgtctttattgtttgctcagtgcatcattaaacttaatatggcagaagaatgaactgaaactgtactgtctaaagtaattttagttctgtgcaggttgcggcatcaactaataaggaagttgatgctcaaatcccaaattatccaaacttacctcctcagttaatctgccagcttcataatgtcaccatgcatgtgagttcactcttaaagaaaccatcatgtagcttcttaataagcagcttatgataattcacctggtgcttttgcaggctgatgcagagacagatgaagtttatgctcagatgacattgcaaccattgagcccggtatttgaccactgctttgcacttctagccttatttcttttaaaagggcaaagatgttacaaggattatgtatttgtcatgtaatcctgttgacaggaagagcaaaaggagcctttccttccaatggagttgggtgctgctagcaagcaacccactaattacttctgcaagacattgactgcaagtgacacgagcactcatggtggtttctctgttccccgccgggcagctgagaaagtcttccctccactagtatgcctttaagctcagtcttttttttggtaggaaatgttcatttgctatgtgttcttcaaattgactcctttagttctctgtaggatttttcacagcagcctccggcacaggagctgattgcaagagatttgcatgataatgaatggaaatttcgccatatatttcgtggtatgtaactatggccgacacacatagaactgattatgagttgtttgtgtacacaaaaaaattgacataaaatcatgtactatgccttttagatagcatttccattagacatgacatctatccgttttgctcttttttctttgttgccaagatctgtttttgcatttttatctggctaagaaattacctggacatgctataatgacaatactgcaactagcctccttctgttcctgccttgcagaattgttgaattatgaaattatattgtgagggtatcttcttctattgaactttcaattggctatgcatttgtcgtgcaggtcagcctaaaaggcatctcctgacaacaggctggagtgtgtttgtgagtgcgaaaagactagtagcaggagactctgttatatttatctggtaccacccactttattccttatttaaattgtatactgttgctagaggttgtactcattgctgagacttaattacctttatcatttttaccaggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccaggtaaatgtactgcaatcttacagcagagcctttaacgttttattttatttccatatttaattgacatgggcattctttttcagggctagcccttctgaatttgtgattccattggccaagtatgtgaaagctgtttaccacacacgtgtatctgttggaatgcgttttagaatgcttttcgagacagaggagtcaagtgtcaggcggtaagctgatattaagcacacagcatgaaccgtgaaagctccattaattcttatatttacctcttactttcagatacatgggtacaatcaccagcataagtgatctagattcagtgcgctggccaaactcacactggcgttctgttaaggtaatatctgctaaatatattttgtggtctctacagaaatgatgttatcttgttccattatctagtagtctgtcaaatctgttatcacatccctcatggatccctttctgtggatatgttttccttgtgatttttttttcattttggatttatggcacattaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtatgctgattgatggccggaacactagcacgcataattctaagagcatactctttaaccacttctttttctgcaggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctctaaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaa

SEQ ID NO: 78360 - DNA, 9291 bp, Oryza sativa
agaaataaaatgttatggttggatttattttttttattaaattttctatattaattacactctttgaaattttgttagaatttacatagcttaattgctaattttgataattagaaacatcatttcagcatttatttaaatggaaatcaaaataaaaatcattttatctctatgggccattttcagcccattttcttcttcagcccgcaagcgaccaaagttcaattattatccccatactcctctcacttttagcctgcaagcgaccaaagtttaattgttatccccatactcctctcacttgctgaactgccggcccacgtgtggctcaagtggtgcggcccatcgctcgatcgatttgagccgttcattttgatagacggctcagatctgttccaaattgatgaaaaccctaaccctaaccctcccctccccctccccgtccccctagccggtcacctcctccgcccccgacgccgcctctcctcctccccctcaccccactggcaccgctccttctcttcccctctctcgcctgtctcaccggcacggcgctgcgacgacggggtgcggcgaagacggccgttcctccccctctccctctccccatcggcctcgacagccgtcccttcctccctctcggcgaaggcgccctcccaaaggcggcatcttcggcaacgatggcatcggcggcgtccgcgctccctcggcgacaaccgtccctatgatggcgtcgacggcgacgacagcgtttgcggtgtctgcgggtggatccatcagcggtggcggcgaccgcgggcggatccagcggcggcggctccctccgccgcctctcttctccctccagtggcagtggtggcgttggcggccaccatttttttttcaatttttccatcgctattactaaccaattcggattgtgaacggacgaaaacacggaggaaaattggatgtgacgaaaggaaaaatacgaatatttatattagttaagattaatttttgaattcacaggtacaaagtttgtatgaacaaaaatatctacttataaagtatgtatgcataaactattttatgtataattttttggggttgggcaaacacgccattgaatttatccaacagttatatgtaaaatttttatgtgcaaaatttatatgtacaaaatgtctatttatcaagtttatatgtataaagtgttgtgtattactaactttctatacgtataaatcatgtgtgtattttttttggacgccagattttttttttgccaaaaatcgggcgttgtttcactaagtaggtcgaaaatgtttcactaaatagataaaaaaatgtctcaatcttttaaaaagctgaaacacaaccaaatcaccccatgaaacatttgatacaacgtatgaaacaacggtttccacaaaatcggacggtttttcaccctatataaaaagaatgtttcagtaaatagcgaaagaatgtttcaattcttaaaaaaaagtaaaacacgatcagatcgctagatgaaataatttggttcaacgtatgtaacaaacgatttaaagccattgcaacacttaaaccccgtgtacattaacaaaccacgtattcatcatgatgaaataattaaacaatatcaaaaatccactacatcatttgcccatatatagtgaaacatcacgagtacactagctgaaacattgttggtggaacaaaaaaaataaaacggatcccccataatagggcgtttccgttatatccgggcggttgttgcaatggggcgcacgtggtggggacacatggtgggcgcgggcgcacgtgttgggggtacgtgggtggcgggcggtgcgggcgcccgattttttttccccatcagacgccgacgcgtaggatttgcgattttgtttggctaggcctatgttgcttgagaaaacgctccccaactcaatccccccgcaccccctaccatccttggccccgggcatatggtaatttttttttacttccgatctcaccccaacattaataaattataagaaacttatagtcgtaaaatattaaactgtatttgaattatattcgaaatgacaaacctggcagcttccatgaaggagatgatggtgacgaaccagaaatccttctgttttatgagggtggagaatccaccgagcaggacgatggtggcccaagcgagtgccaacgccccgaagctgctgatcaacttgtcgatgaacacccagcgcagtatcatccagttcagcttcgcctctggcagcccaagtacttctgcagctacattggtagtggtgctagcagcagttgcatgatccatggccttccctagctgctgcttcaaccacacccgccttaactaattcttgcctgtgtgtgtgtttgtttgtgccgatgtttctctccctgcatgcctacgtgtgtcctgattaaaaccatgccatccatccatgactttataacaagaattattccacaagaccggcaacactcaaagacgatcacttttactttgagtcttactactagctagtgttcccctaaaacggatgatactgttatcttggcaaaatgggcatgcaacatgtaattacgtgcagagaagatacttaaaaattataaggaagaatgtggacatgaaagtctgaaaaattcatgacctgatttgcaggtgaggaatgataaagtaagaggatgcccaacagatatcctatcctattcccaatcccataattttagatttatggggcgaaaatacggagaatgcttgtaatcgaccgtccgaacaagacaggaaaatcggacaccatgccgatgcttcccacgttggagtatctgcaatcaactaactgctaatttcaaccatgcatatgcatgtgtcaattttcaaaatattttttctcctagactacttatccgatctaaaatccgattgcaccattatattcattggaattaaatctttatagcaagatattacatgattatattccgattaaagaaaaacatatgttttaaaccattaatactttatgtttcatacgttatagcaacatgtttcagcatctatttttattgtgtttcataaaattcacggaaatacttgccactaccctcctatctctctccacctcatacatgcatgcatgtatgcatttttgcgagctttaaaatattttttctcatgaactaattatccaaactatgatctgatcacaccgttgtattcgttgtaattaaatttttacaacaagatatcacatgattatattttgataaaagaaaaacatatgtttcaatccgttaatactagttgtttcatatgtggtagcgacatgtttcaacgtgtatcttcattatgtttcataaaatttttaaatgtttcaattgctgattttttgtttcaccatatataatttgatgtttcacttaatggtcaactaggaacatttgaccaaccttttttttaggacatgagacgtcaaatgggaagattcctcatgattgtggagtaaaaaatgaagtgcagcaacatgcacatgcacacacgctcagggtttggatgggcgtccggtatttggtgggatatcggacgtccgagccgtagcgctctccggaaaatactgttcgcaatccctagtgggtccaacactagagagtcctcattcctaatccatggatgagtgcgagggatcgtctgtagggacgggtgatcgggagtattggaaaatcatatttcttttttatagggcccattttttagttttaggaaatccatttaagcatctattggaaagctgaatattcagacctcaaattttgtctaggacttaaaaacaaaattttaaggatatattttttggatatctcttagtgatgctttaaatcagttcagagatgagaaacagatactttcttattaaattttgtttcattgtgtgatatattccacaactatttaccacaaaattgaatgtggcacggtgcttaaaaatcaaattgcatggaacctttcggtgtactaagatgtagaatatctatggaaatcaatagttttacaagaaatttcatagcagtttaaggggaaaaaaataatccaagcgttgagaaaaatttctaatttttttattagccctacaatattcttgttagtacacatctagctgccttaaaatcttaacatcacaacatctgaacattgaacaagtgtatttatcagcctaggtgatttccaaaaaagaaaaataaattagaaatttttaatcatttcaaaggaagtattagaatgtattttatagtgtaaattttggtactcgatacaaatgaggtactataggaggtataacaaattagccctagaagctacagtgcatattatatcttaagaggaagcataaaattaatttagagacaatcttacatgacaaaaaagaactaaaggtgtactgcatgtttggccttttgcaaaagactggattaagggccaagccacatttaattcagttactgcgaagatacttgaaaagaaagcaggtgaccattaaaaatctgaaattcacgcaccactaaaaaaatcgttttctcaggcagccaaaaatcagcccagtcacccgcctgcgaaaattttctcgacgaaaaaaaaatcgccgccaccccaactcgcgcccctacccacctccgaccggatctagggttagggttctaagagggagagggtaatgaaggggaggtgaggggagccgcacggctgctgcaggggcgccgccgccgtcgggggtgggtgccgccgcttccaccgccctccccctccctccggctggatctgggagggaggggaaccgctgccaccaccaccgccctccccctcccccttcggccggatctgggagcgaggggaggggagccgtgcttggggtggatgccgccacccccgcgtgtcgccatcgtcggatctcgccacccccgctaccgaactgcccacgaccgcggagcgccgccgcctcccttccctagcacgaccgctgaggtggataggtgagctaaagaagaggggaggagacttagaaaaaaatctgatctctcccgcgtctatttatatgccacgccaatttttgcaggcagacaacgatctcgtcccacggttgtcattttctcatgcggtcatttagcttcaagatgcctatccatctagaaaaaaaactgctttcgtgcaggggagtgtacaactccacgatcgtgaaatagccaatcagccatgaacagaacggagaaatgatagaacattttgctatccgatacgcgtgtgctctgaagtaacgaatatacgtagctgtaaaatgattaaattgcattatggatataaaagaccgaaatatccgcatttactcacatgtgcacagtccacccggaggacatgattcagaaataatgcagggggttatttgacatgtaacattatcattatttactgatattgtagttacatcagataaaaggaaaacgatacaggtatcaacacaaaactaaaaaaaaatatcatcactttatcaagtcccaatgtaattaattttcacttgatctacttccgatatatttattctctatttttataaacccggatgcaataattacttgaaaataaatttattttatgacaatcaggagaaaacaaatgaactcccaaaagattaagggaagtatctttgaaaattcacggagatcgaagtttcatgcgactgatgtggtagtcttgccaatgtgatcaacaatgtgataaaaatttcacaagcgacacctcaattgataaaaaacgtaccatacgtataaggtggtgtttggttcggatgtggtaacgtaaacgctaatggtattgcctccagccgtaacggataccaatttatccgattacatgattagtttggttgcaggcggtaacgtcatttatttacattactgcgtttggttgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaatttcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatgtagattgtcatggttcaagcaaataaagctgaagtactgaaactaaacatccttaggacataggtagtctccaatccccaaggcctatgcttatatggaattctaataattcaaaaacagataatgaacatcttgtagatcatgcttgacagccagcacatcagtacatcaatttttctttgcctcatctgataacaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttccagttgcatttgcaacactacaagattgatcaagtgaattaccagcaagtattttcagtacgtactccctcctgagagactccggaagagcgagaagcatactcatttgagccggcacttttacaaaagcagctgcagcattgacaacttcagtaccagtcaatccaagcttttgacactcaagaatagcttcgttctgaattttttgtagtgggtcctcctcagccattgccttctcttggatctcagcttcacgttgcatagatgccaccattgctcccacatgctttgtaacatccctcagatcaccttgaacattggcaaagacatccataaaagggtcacttgacaaggtatttttcagtttgttgctgtctttcttcctcttcttagagcttgaagcagttgaatcgatgctctgtcgaggtgtggctgaatcgatgctccgtcgagctgcagctgaatcgatgctccgccgaggcatttctctagacactctctcttcatcctcctcatcttcttcatcttgaatatcttgaacaatttctttctccatattagcaacagcctcaccaagaccctctgcaccttctccagtagcaatgtgtttaccataaattgcagctagtgtatcatagtgagggaatgctacaccatatagaccctttgcctcattgtttttctgtaaaatacaaagaatgacacaaaattaaggtcatggttcagcaagcaaaagagagacctatgcagctacaattgcatgaaaaacacaagagaacatatgtatgagaaagcatactactagaaaaccataatgttgtctttgcaaacatttcagaggaattttacatagccgcttatttggaacaaaatttcataaaatatcttacagtagtttcacatatttcaattcaatgcactcatgaatcaataaataaattttctactccatagttagtttgatgacttaccctgcaatgatcatcgttttgttgtttctcacattgtatcatctttctattgtcatcccaagaaaagccacttttggttagcatcacttcaattgcgccaaacttggtcctaaagtgtcttactctcgactctatgtgcggaacagcagtaaggccagaacttggcaacttcttagcaagcacgttctctagaacttggcagtatccatttttgaaacccccttctgattttcagcttggatccaaagcaatctcgaacaatgccttgatcagctcctcatcctcaaagtacatccaaatcctcttgttcttgcctctcccacgcacaatgcttgagcttccaagatgctccataactgcaatattagaaattcaacagaaaactaacatcagtaagcatccataattgtaccaacatttttttatttctgatttgcaaacaattagaaattccatttaaaacacaaacctcaatgagccctatagctattatacatcccatgagcaagagtgttgcgaaaatttgtccaatcatcagatgtcgaaatagctgagataaactcaggttcggcgagttctccctcaagtatatccaatggtatctcgtcctcatcctcatcctcgtcctcatcctcaaatggatcactagacatcttttgcaaaattaagttgtgcaataaagcacatgccattataattcgacactgagttttgataggaaaatatgatggggacctcaaaatcgcccaacgaccctttagtcttccaaaagacctctctacaatatttctagcacttgcatgcctcatgttaaagtactcctctgcactacgtggtgggttacgtgctgtgaaacggcctaaatgatatctttggcctcggtaaggggctaaaaaaccatctgcgtttgtataaccagcatccacaaggtaatagcaacctttaaaattttaaaaaagaaatgtcagtacaattcaggctgtggagtgtcaaacttcaaaataaattgattggaaaaagactcgccttgagggacacgaagcccgtccggcctgtgaattgcatcacgaaggacacgaccatcatgtgcagaaccctaccaaccaggtagtaagtaaatgaactgcatatcgggtgcacaaacacctaatacatttgtaacaatgtctccttttcttgacctatatcttccttttatcctagttgggacagttacttttatgtgtgtaccatccaatgcacttaggcaattctacaatccagaacaccacatcaataaaatatgg

SEQ ID NO: 78361 - DNA, 12432 bp, Oryza sativa
  unsure (1)..(12432): unsure at all n locations
acaatttttttttaaaaaagttgacttggtaatttaggcgctatttttcgtgcgtgaacgaggtcccaacctgggaagtgacacatcttactgtgatcaagaggtgacttgattaaccaattcgtcaatgcgctagtgaaactacaaaagcagatgcgatattaattgaaaaaaaaatgtctcgaaatgtccaaaaaaaatgtcaacatttgaaatttatagtttttgaggtgttacgaaacaactccatttgaagatataaaatgctctggttcgtagctagaataattatattttagttttttttaaagatttttagtcaggaatcgacgtcatatttactacttataaaaaataatcagatagtttttacaccataaattacttatacttacattgtaattatacattgaattatattgtaagttttagtattcatattatatttttttaagtacgcaatgtataaaaaattgtgatcaaaagtaacatattatataattgaaagaggacatgagagggatattatccggaacaagtagcggaagagcacccattctaatcagcatggacggcttccaaagcttcaatcggcatgtttaggtcaggatgaaaacggtcggaaatgatcggaaacgatattattattttattatttttttgaaacaagtagaaacaataggaaatttttcatatttatgaattgaactatttagtgtcaacttcaatgacactgagggcctgttcactttgatgccattttcaaccttatcaagttttggtaaaattgctaaaaaagtggctacatttagggtatgtttggtttgaaaccctaccaaaatattggtagtaccaaaccttgggcaaattttggtactaccaaatttttgatagtatagatttggctccactctattgatttggcaaaaattggttccaatccaaaatgctaacatgcactattcaaaactaacaaagaattggtagggcaagaattggcaccaaaccaaaatggcccttagtttcctgccaaattttggtaactataaaagaaatcctgccaaaattttggtaagttaccaaaattttggtaactactttggctatgccaaaatttggtaaggttttttttggcatcaaagtgaacaggctctgacagtaatccgaaaaactaaattttgaaaatggtaccggtcggtaaaaatattattattatgacttataatcaaccatatgagaaccttaaactaaatggttaacatcattgttaataccaagagcttagtaataaaaatttagttcttgtagcagatcttttaaaaacgtcaccaacattatgaaatagctaacacaaatgttgtactgtagtaacttcttactactccgtaggcgtacaccggtgagagagacatgcacagtgaaacattgtgaaatggacgtacgagtggaacaaccgatggcaaaatcggttcgacgcagagacagcgccaggcatcaacaacgtaccacaaaaacacctcgaaatttactctgcagaagagaaacaaaaatcaaaacttcgaggaagaaaataatttacaaaaccagcagcagcatcacaaaagttactttgataaggatagggacgcaaggttccaatctaccatccttgtcatgggcaatggacacacgagaaagaggaaaaaaaaaggaaggaaaaaaaataaagaagaggaatcaaatgattaaatctgaagccaacgattgcaagctgcggactactagcccctttgggatcatccgtgaggtgacatgattttgcagccgatacggcgatagcgtcaccttcgtcccgtattctctcattctctacttagctagctgcagcagtgtccactggcttcagatacttgagaaatggtgaaatttcagtgatttggacactccttaggatggtgtgtctggacaaatgtgacacaatcgtagtagtggattatagatatttgttacaagtgtttctcttgctgcaatggtgcttcctttttaggttcagttacatgctctgaacattttacagaaaatatgggtcagtaggttattctgttatgagtggctaatctctcctgtgcggattgcttatggaatgctttcttaattaactgtatcttgcgatctttcggaatgctttctgacctgtatatatatttcgtgctccttgtgtgaggaatgcgaggcaagtaccaaaggaagcaagaagacaagatcaggatcagaaacagagatggggatcgaatatcatggcagttgtacactgaagaaatgaatgcacgatcttccagacagcatggatggaacaagctaaaaggcctaagaacactgcaaagtgcacactataagattcagataagcttacagcctcactgtttcgcttattcgtgaaataaaccaaacagcatatttacaaatgaaaagtaatttatgaatataacttttgtatacatgttcttagcgatctaaaagtaaaggctgaaaaataaatttcgatgccaaaaatctcaaaatcaactccaaatttaaagttgaaaattgaaattttgactgataagtataagcataaacgaaaaaaatgagtcccttatatttcagacttcaaagacaccaacatggtgggcttaccaggcaaagtgccttggggcatcaaacacggtcttcgattcgctcatttggaaagtttgggtgccaggaaaaatgcaaattccacgtatagccagtcatccaaaatagggtctggatctccgaccagttggcgactagagcatgacaaaataatgggatctgccccatctactgtagagaaggcgaaacagttatacatctcgttgtcagctgcagatacacgaaaagaatttgaaacctagtagctgcctgggtggcttaccaatagcttgatcctggacaatgggaggcgacacaggcgacaaaagattggtgggaggctctagcaatcatggtaggagttctaaaaagggattgtgcaccctcattctccttgtcgtctgggagatctagaaggagaggaaccaatgaatctttgagcataatgagaccacgtcattattccttttcaccaaaatcaaggatggagtgcggactgtaggatcgaataaaaagaactaagccaaccagagggggggtgaatgattggtgtacccaaaaacccaaacttttagcggaattaaaagttatcctcaaatcgatgtagatcggtctgactgaggttgatccgccggtctgaccgcgcctgtgccgtcggtagcccggtctgactgccctggaatcgcctctgcctcctgtcgctgtcgccggtctgaccaccgctgacccgccggtctgaccaccgctgacccgccgatctgaccgccgcagtgccgccggtctgaccgccgatgtctcgccagttagaccgctgaacccgagcaaacacaaatcgaagaactcttgatgtagatgacaactttattacttctctctgtgtttacaaagtgcaacaacagcactcctcacgaaaatttcgactacactcgaaaccctaactcaactctcaactctatgctctcaaaagcgatactgggaggcctcaccctccctctctatttatacatgaggtaggcagcctaaagccacaaaccaaactcatacaagaagtcctaatccacctaggaaaccttcctatacaagaaaccaactttacaaactcaaattgtaccaaatttggactcattccaaattcgacttcacatcctatacacacccaatatctctatcgtatgtcatatggaatcttcaccaaccatgtgcattgatctttagcctgaatatcccgcatgatatctgaccatccggacgttgccttatctccaagtcgactcccgatccatcaccggcaatactctcctgaggcatcaagacacctacacataaatcaaacaaagaaatcatattccgagactaagctatctccaacttgactcattgttagcaaacaacagtattacatacgcatagtatccatctagaagccataaacacatattaatcacggatatccaatgaaacaacccgaaaccaaaaccaacacagagtcagccggtcaaactgtgagctggccggtctgaccgctcgcatagcgtcggtctgaccggcaacacctgatcggtctgactggaccagacaaaacagcagcacctgtatatcacctgaaaatccaatcatctccaaaaccactcgccaataatctccaaatatcaaaaccaataatctcatatgccaattgttcatcacagaataagaatcaaacacactttgattttacacggacatgggcgatggtaggagcaaaacgcttacgtgatttttttgccctactctgtatagtgtatagagcttttcttcttttcttacccctagggttatatttttctcatgctatattcaatgaaaagacgcaatctcataccgttttgccttaaaaaaaagaagattttagagacgtcaaagctaggttaggtgccccatgaatattcgtgcaagctatggggcccgtacccctagcccaaaaaattagcccaaagacactcaccctacagtgcaagcaccaatatatgtgtggcttagttggatggagacactgatgaaggaaacgaagcccacagtgggcgtgaccctatgcttttggacacgggtagcggagcaaaatttatttctcacctacccttctctccaacccagcgcgcaggcggatgcctagccctcgaccgcttcgctctctccaacccctcgcggcggcggctggcacggcagccggaggcgtcccaagcggcagtggctggcacggcggtgggatgtgtccccggtggcggtggctggtgaggccgagggaggcatccccggggggagcggctggcgcggcggtgggagacatgaagtccgcggcggtgggctttcgggggtggcgacgcggtctcccgtcaactccggtcgtcaggaggggacacatgcctnncgctccttttccccccacctcctcccgaggcgatagcgagctcgccgccgccccgtcgccgggtgctactttttggggttcttggttcttgaatccacatggaggggcgaacttttcgctgggtgtgttcttgggtttctggggttcttgcttcttgttttctccttggttctcgagttcgtcaaccaaggattgaccggagttgacggggagttcttgcgtacggttcggattggtttgtagattattttcttgatgattgcgtgaatgtagttttgggctacaaattcttgagcttgcaatggatttgtttgattcttgaacaatgaatgcagcaagcatgggaggcgatggagaggccgccatggattgggacttcagggtggcgatggtgaggccggagagagacctacctacgaatccgagggagaaatcgagcgtggcaacgacggaatagggcaagcgtcgaccaaatagttgtggcgggagggcgattttggagggcgaatccgggattccaccttccgtccgccgcgagggcatgcgcgcgtctaggacacgcgctcctcagtgcgcggaacttcacctcgtgacggcgcgcgcggactcgccgagaggaggaagtgcggcgctctgcgtgggggcgaggtgctttgcaggggcgccgcgacaccctccacgtctgcgttttattgagctggcaccgtggagcaccgatccaactcaccgcactgttgaatggccttgctgcacaggcatggagccatggacaacaaggagagagtaggcaggcaggaagagaggagtacggagtgacgtacagtagaaggcaaacgtgggcgattctccatttctcattgcccgggggaacgcaatccgcgggcgcggccgttgattggctccactggctttccctttttggacggtagcactcgctggctggcatgtgggagtgggacggtgggtcggccgcgccaaccatccatccatccaccatcgtccatcgatcgacggcgacaccgcaccccatcgctgtccgccgtgacgccgacgcctcctctccttaaccctgctgcacagacgatccagtgtgactgcacccctcgataggtttactccgatttaaatcaacttctagtacatgcaattctggacgagatttcataaaaaaaaatcaatttttgatcacgaattgattttcgtagttagaaattgattttaatagtgcggagggagcactgcatatgtgcatgctcagatcgatcggtttttccccaccgattttactggccgcaattaaatcgcggttcgatttccttttcggtctgcttgggcacctcgatcagatcaagtaagtagttatagcgacagggctcgactgttgtctgccgatcgatcatatgcaaatggtactctgtctgcctcgatcgaaggcgttcacaatatgcctatggtagatggttttcattttcattttccttagaaacaaagttcaattgcaagtgtccattacgcagacacacatactatgaacttatacacacgcgcacaccgacatattttgggattgatgaattcaccacggatgtcttgctcgacaggtatatcacttatcattgaaagaataattagctgtgaatatgagcacctacgctcacttcgcatgattttcattttctcatgatgagggaagaaaatctcggttggaacaacaaaattttattattttatacatttaaatcctattggattatttttctatatgtagctatctggtttgtactattttgttgaaaaaaattaaatatgtgcgtatgtgcatgcatgctcagatcgatcagtttttctcctgcgatttactggccacaattaaatcacgatttaatttccttttcggtctccttttgggccggcaggctggttcctcgatcgatagagttgcaaacgacactgctcaactgctgtgctatctattgatcgatcatatgcaaattctactgtctgcctcgagctatcatgaatggggtaattttatcattttaaaaagatacaaaagatacatgaaggtatcatatattttagtattttagtgtaaaaatttgataaatatatcaagataaaaaattttaacgtaaaatttaggcacctctatatttttttcttgaaccttaaaattgcccatcatgaattttactggccaatggtaaatgattttctcattactagcctagaacccgtgcgttgcaacggaaaacaaatatattaagtttctagctaattaaatcaattaagaagcacttatttagtctaagtaatactatgattttttttattgaacaaatagatgattttgaattttgggaagccaataatgaagtaggagatgacttgttaaaatatggtgtagtagtatagattgtgagatccggatgttagcgataggggtggtgcgtgaatggataccaccactactaatattttaagtagtatagatggggagaaaaatctcgattggaagaaaagattttattattttaaaccatttacaccctatagtattattttctatacgtagcccttttgtttgtcctactttgttggaaaaattaaatacgaatccttcctatctttcacttcttttttgagaattataagcatgagttctaacctcatagtttagaatccgttcgaacagcccaatacacaatctttctttctctctcctagaataatatgagctcctttggaacagaagaaaagcatacgataaatgaatagtataaatgaaggatttaaattcatatggacacagtcactgtacgtagtagcctttacatggtactggtcgctggaaaaagcaaaggaaataatttccccacatttctgtatttttccaagtcatccaaacacatgttcctctaaattttcaacgttttcaatcttttcgcatggatttctatcctgtttttgtgttttctctggtttcaatatctactagcttataaagtcacacatttgtgtgatttctaaccatcctgttacgtgttttatatactagttgataccccgcgctttgctgcgagatatatggatgaatgtattttatacattatagaaaatgatatatgtatatgtttaaataatgtaaaaataatgcgaagataatgatttgacattgcttgcatattgagttctaaaaatacaacaaaaatgtaaataatatgtcatgtttgcatcatatttaaaatactctagataaatatttgctggtgggtgtgatgatatgatacacttgaatgttgagctttagaagttagtggatattaattttatagtaagatatgatatgaagatatgtagtcaataatagttatgtatgtgaaattttagtattcaaaagacgtgccagctgtatttgtttaattttattgagtgaaattttgaatgtttgttttcattactttgaaatatacgctgggaataattctaatccacgtcatgtatgtatgtgtgtggagatacatcaacaaatctgtcaatcatgtcttatacaacaaagttgatgattatatgggatggtattgagatattggagatggagataagggggaacaggagctgcgagggactgagagtgcggtggagacgtcgctgccggcgaaatcaggacgaaggggattgcggaggcatgttggagagcggacgggagagaagtcggcagacatgtgcacaaatgggagttgtgatgtgatgggactatgggaggcgtcgctggatgcgaaggaggctaattgtgcagatatggagagaagcgcatgtctgcccgttgatcgaaaccgttggatttgatgatcaaacgatccatattccacatgtctgtcaggttggagtcgccgccatcattacgattttttaagtattattatagatatagatatagattaaggagttgctagagagaacttcattagatctaccggtgcctcctctcttcccctatccactcatccagccgatagaggggcggtggtaagaggcggctatcgatatgacaaggccgaagcatggtggctatggtggtgaggtggagcctgaggctaggaagcaccgctgtgatggctgtcattgacggacccagaagaaaggggagatgtgggtgctgatgatttggccctataactttttatgtggagttacctgcacacagatcccatcataaaatatgcttgttctatcccatgcctaagcataaaaaatcatcttgctttgttcttagccttggcatgtgtcaatcctgtattttccatatccatactatcaaatccttaggtttccgaaatattgtaatggaaaaagaattgattcgaattatcactatttgactctgacctgttctaaaaaagtcaaggtacttcgaatgacatggacaaagtaagggagtacaaacaagctgaagcaaagtgggtaacagatcccagtaggccccatatccattttgttttcctgactgtcttgtggacaccatatcagtgaaaaccgtctaagatagtcattttgcaccggtttcatgatatctggtattatgggtgaggtatacaagttagattgatttgatcatgtttttacctttgatgggctatagataaatgggctgacttgctattacttccggcccattgggagtattttgggtctttgacatctctcttctcacaccccgctcaatccccaatccggttgaccatgtccgccattgatttgccgacgggaggcggcgctgggttcccccctccgggttgccacccaaaccggtcgtctaggccgcgtggccatgcgcgcaactttgaggtccacaaacttactatcatttcatttgagcttgtctttcgtgtcccatcgtagttcatatgttttttttatcttagctagaattcactagattgattgtgaatgtgttgtgcaatgtacttatcgcgtggagaaaagtgttttcgtaatctttgagaggtacggtacgaataggtattgctaagctagacttttgtttattgattctacaaatatttcggtatctccaaaggtataccatagataactcctaggaattaattggaagacagttatcaccaacgtaactcactaggtatgcattataacagttggtgagcttaagagaaaccaagatagcaatctaattaatttactagaacattatgtttccctgtagtaaaacatcaacagagagtgcactattgtgaatttagataatctgaatgactacatataatgttgtaatagcatgagaagaaatggttgtaacactacatggtagattacattggattgataatccccacaaccgaaaactgcatgaactttgtcgacgtttgatgtcgcgattccggtatttgcatggtatggggatcgttggtactagggtctacgcgagactgagataaaagagatggagacagggatttttatacaggttcgggcccctgaattatcaggtaataaccctacatcctgttggccgaagccgttgttactctttattcatctggatcacacaagtacaatatgtgggctagcctatctaactgttgtcgacatggcggtctgaaggtctgactcgtagtcgataacagggtagtcttcctcctcgagtatgtgcctggcgagatcagagataacgctttcgtctctcctaacagtatctggagacaccgtaggggactagccgtgcttatccctgaagtcgatatccggcgtcttgtcttggcgtatgttggcttgtatgttgtggcttctatgttgttctgtgtatgttgattcttcccctttcctcctagggggccttgtatttatacccataggtgtccccttgtctaagtagaactagggaaaccaatatggatacaatccgagtagtccttgtcgtttccatgtagaactctggttgtctttccttatccagaactcctcctatatccgcaggttgtttccgtataggacatggtaagtggtgggtcctgccgagatttagtcgactactattatgtatgtggtatccataaccctgacaaacttgttctgcattgttacataattgttttttagtagaaatactaccaggcgccgcccagtagtttaaaaaattaaaataaaagaaaaattacaatctgtataggaaaaaagtccaaaaaaaattacaaagtttgtaaccaggaagaaacaaaatctaacgaagaaccattcatcctacagaaatgtaggagaatatcctgattaaagaatctaaaccaggcttgaacatctgggataatattcctgaaaattagtgcattcctctgtttccaaatatgccaacaagcaatggaaaagatttccataaaacctttccttccgaaactaattttagctaagccaatcatttgctgaaattccaaattataattccactggaaaccattttttctccaacacgcctcagtgaaagggcaactgaaaaacatatgttctctcgtttatcttaaactcaacatacacaaagcacatgataagtcatcattttctttcacacactttcttcaatcaagcatatcccttgtattcagtcgatcacacgaaagcagccacatgaaaacttttattttattgatacacaatgacttccaaacccaggaaaaggatctagaaggagagagactcacaaagttcagggcataaatcttcttcgatgagtagactgaattattacagatgaaagaccaattatctccaatcacatcattcagagagagattatctagttcatcttttagctgtaaaaaatcatcataagcctgtgctgaaagagacaaacgaaaacaatcctcaaattccttgagcattatggccttgacagaatcagatttattaagtgcatgagaataaagaccgccaaactgctgacatctaatttttctattccaaagatcctccccaaaaaaaaaaactgaattcccatagtttacagaacactgagcaatagctctataaacatctgataaacaaattatgtctctgcaccaaaaagagcctttattaaagacatgacgaggaaccttatgccgatagtaagactccctaatcaaccttacccatggtaaattggctgatgtgtaaaatttatgaagatgtttaagaaggagagccgcattctggatatgtaaattgatgacaccaaggcccccttttttctttagagaacagacttgttggagatatgggcccgggggtatgtgaagtaaggggagttaccttcccgtccagccacgtggcccgtcaagctggccccacttacgcacctcgtgagtcgcgaaacccgcgcggggggggggggggggggg

SEQ ID NO: 78362 - DNA, 1846 bp, Oryza sativa
aatacaaattaaacaatcaaaagaatacaatatatgttttctcaaacatacataatagaaggtttaatattaaacacgagttattatatggttaattacaaagccattctagtaaaaataacatcgcaactgtttcattgtttcgaaacattatgagatttatttatccctcgtctagatccattgacatgcatacgaatttggatatatataaatcgtctcttagcggggatacaaagcccttcttaaaaaagataaatgtattcaaaacccaaaacgtcttatagtgggatacaaaggaaggtattcctaatgtacgccttcagaatcaaagcatagacataaaaaatcaaatcatccatcaacatctaatgtttaatctatatctcattttagatagttcattatctactatcggtttcttataaaccataaaaaaatagctattcctatacatatgtcaccaaatagaattttccttctattttatcttgttcacatggcccaaatattattaggaggagcaacaccattattcattgtgcaaatcaacgatcagcagttaattacctggaatattatcctaatcaacaccattaagcttatgaggtatgcaccactatttctggaatactatcataatcaatttgcacacttcttaaatgaagttgattgttgaatcgataatcatgaggcaaacaattcccagaaaatctgtccactcaggaccttggctctgaaaaaaaccagtgaatgaacggatattgaagaaaaccattatgggtttctttggatgaatttagcattgttaacaatcatcgatgtttacatcctatattccaaagaacacaaatcagatcacttacaccaccatttgctaagaccaatgccatcactgttgctgcccaaatcacttaggacaaaggattccacataaagctgaggaacttgatgctcttgttctattccaaaaggaagtaaaaaatatgaggatttcagaacaggaatgtaggtaaacaatgatcagaaaaaggcagataaacttctccaatctgcttgcaccggacagctgcaagcgttctactgcatcttctgatgaaagccccacgtgaaatgtattcagctcctcaaaaaatgtctacaaggagcagattcacctgttattatatatccttacaaagcacagcattaagactatatgtttcagaacccgtcaaagtctacgatatgccaaattatacaaaagtctacaccttgcgtatgtactggtgtctggtcacctgaaatatagatattacatgaagaatattgccagttcagacccatggcaaagtctcagatgcaattaaaaagtttaccctgagatagaaagtagaaaattgttagcacaccgcatcattctgaattttaagtcgaccaaacatatatatgtgacaggaaaaaattgcaaccagttgctatagaaaaatataaatttcgcttaaaatatcttaaaaataatcaaatccaaccaaaggtgcagttgttccaacctatcttttcgaattctcaaagacaagatcacaaaacacatgaggtgcttcaatctgaatgttttggttcaagatacctttcggcggcggaggaacggcggcgtggctccgtataggcggcggttgaggcggaggccgaggaggaggtcgccaaagcagtttgtcggaggagaccggcgatgcgtgacgatttgagtggcggagggacggcggtgatgccggttgagacagtccgaggagacttcagcggccgagggacaacgacgggagaccggatcggcgatgtcggttgaggcggcggcggcaggcagtcg

SEQ ID NO: 78363 - DNA, 923 bp, Oryza sativa
cccgggcaaggacggcaagcccctcggcgccgccggcagcgccatcgtcgccatcgaagcctccaacttcatcgccaatggtgtcgtcttcaaggtcctcccttcaccttctcttcggttccataactcttaaccttttgaataagattctattagtatgtttatttaataaagatactagaataacgtatatagatttgtttacaaagtattataataaaaaagaaaaatatatttatttattatatatattatactctttacatttctggtcaaacttgcacgttgaatatttggctataatttcttttatatactacttcctccgttttacaatataagactttctagcattacccatatttatgtagatgttaatgaatctagacatatatattaacatttatatgaatatgaacaatactagaataacttacaatatgaaacggggggaatagtgggcatttagacagctatcaatgactcgtttttgtttcgcgtgccgataagtagctcggcctaaatgctccagagaattcagccttaaagagtgttttagactaaactactcagcgaaaagagctgatgagggttctgttgcataaaagcatctatcattgctgtagcagagcaatgttgcacattagcataacacaatgcccacagaaattagccacaaaatcaacaagttagaaccgcaagagttattgataaacattatctaaaattcaaagaaccgaataggggaacaccttctggcaggggattatgggagtaagggagcaattttatagattctgtgaaaaaaaggtgggggatggaaagaataccctgttttgggtagataattggattggaaggaagccactggcagagaagttccccagactctacgacatttcctttgtcaaaaggagtaactg

SEQ ID NO: 78364 - DNA, 993 bp, Oryza sativa
catgcatgttttaatttttgttatgaactaagctagaaatatatcatatggtgaagcgtgcaaatggaatgataagtgatggcagaaacaaagattaattgagctgtggacacgcaatgaaatataagttaaattaatctgattgtacatatattagttattttagtcaatgaggagaagccaatatttgagatatgaagatattctctgttcagccctttggagttcatgtgtcgttacagatgggtagtagatgacagaacagccagcaacatgcaaagaaacaaatggaccatgagaggcccaatgataagggaggtacaatagacttggggaatggtaagtgacttggtgcaattagttgttttaatctgggggagggccagaccacggcagctcacatgaccggtaaggtgttcgacgaaatgtttatctccatgccatttcagtttcctttcctcatcttttgcccttcgttgaatcgcatccatcaactgcaaaatactagattatagcaccttgccccaacttctcctttcttcttcttcctcccttttatttctctctcgcaggcaaaggtcgcacgcagctgcgggaggccagcactgattgggccgcgtgcggcggttgggcggtggtctccggtcgcgctgatgaaatatgcagtttgaccaagggcaaaagatgatggaggcaaagtcccaaagttttcaactatatgatttaatttgttaaatgttatatattataaaaaaacaaccaagattccatgccatatcaacatttgcaaacagctagtaacattttctttttgcacgtgcagtatttttcgttgaattatccgtggctggacatatcatcaattgatcaatttcctaaccattgcgattttctcatttttctgaatttttttttggctattcggttgattaacacgtcgccgtcttctgattatcgctcctcgtgagcgcgtttgcaacaggcaaaacgtgg

SEQ ID NO: 78365 - DNA, 1008 bp, Oryza sativa
cgctcattcaggttgcatagattgtacttttgcttcattaaatgtatccactcacattattttattagtatatattctatatattcctgcctaaacctgcttcatggatttctttttcctacttggccttattttgttggtttaaaagcagagcagcgcacttgtcatggtctccttttttactgggggtttgatctcttttgtcagcacaggctctgattttacctcctagacattcaaaataggaactctcttcaattccagttccagatactgttcctcaagaacacaggtactaattgatgaagtatcctctaaaagatacgttgaatatagtgctttttcatgttgccgttcctattttattcattccttgctatgttgtgttctctaggtccaaattccacttaaggttgtgactctctgtgcaagtagagatgtgatttgtcaaatttggaacggcactagtaattgtcttatctcatcatgtttttctgagtgtccaaatttttaaccttttcttttccttcagaaggtaacagactttgcttgtatccaggttaatgtcaaacttcgattccctgttgtattgaattaattcatggaacctacaaatcttccacctgaagattttttgcctgcctggaattctggaaagcattagctgctcagtctctgaaagtttaagatgtggtaaggtttcagttctgttgtggataactagtgagttgtgaaggaatacatttttttcatgaaatgtagaattggataatcttccctcatggttttgcttgttttttcttggtactgatgatttagtgtgtcttgttagattgttactattgccttctagcataatggatatagcaagtatgtttagctggatagtaatgttgtgctctattaaaaacaaaggaacaatggagcggattgcccttaagtttctggtttctccacgtggtcgaggctctgattggcgactttggtgggcaaagcccttctctaata

SEQ ID NO: 78366 - DNA, 18860 bp, Oryza sativa
gaggagtaccttgaaagctgggaggagaatgaccatatggtggatagttgcttggggaacaaaatggatagaaattgtgtaaaaaatgtgggttgaagctttgggtaaactgagattggggaaaattattggggaattgttggggaggggagttgtggctagtcttttctgcatggtttggagagtcttgactaagaagatctatgaatttttggttggatgaatccatctcctgatgaaatgaagagatacaaactgaaatctcttgttggtctgttttataggagcatagagaaggagagccaacacccagcaccaaaggctacttcaacggacacttgctcggctgctcacgccccagcaccaactgctttagattttatattcatttatacacagtgaactcaaaaattactgtattttatttccttgtggcctgcctattctaagaactactttagcaattaatgtcatatggactacctccactgtgtatattgcctgcccttagagctgcatttattgtataatgcctactttagtgatacattgtggatgccctaatgacttaagaacacccttaaagcaacttcgcactgttggagaggatgtatggactgcgtgaggttcctcgttttgggtagcttgcactgtaggtgacataagagcaaatcaagatcctgcaaacgaggagggattcgccgattcggtgcaccggcaggcaggatctctgacgcgacgacagcaaccaatgtttgcgtgtcaatactactggagacgcgagagagatggacgacaggacatcggacgatcgacagcaatgggcaatggcctcctccagagccagcagattctctcgttttctcctgtgaaccatctctctctctctctctctctctctctctctctctcagacgatcaccatctctctctctctcctcccatcagctcatgtcatctctctctctcagacgatcaccatctctctctcctcccatcagctcatgtccggatgtccctttttggtcgttgtttctttggcacgatatttcatcatgtatcctctcttttagatataaaaaaactaaggatgtaattcatttgtctcataaaaatcaccttaatatcatatgtgacacatcttaatactataaatctagatattatcttttcagatttataatcctaagatattatatgtcatattcagaattaaatttgtttttttatgagacgaaggagtatctccctatactacggatacgcacaaattttatttcatagattaaatatatagttttgtgatatatccatgataaatttagatctaaatctttttgagaaagtttgataaataaaatcctaacttagatctgaacttttgaactaatggacgttgggttgcagaaatgaagattggattgctaggaaccatgaagcaatactagttgactaaaaccaccctaaccagtactcactctgtttcacactttaagtcattttgattttgatcaaagttaaattgctctaagtttgatcaagtttatagaaaaaagttaatctagtattagatgtgatacatcctaatactatcactattgaggaacctatctttagttccggttcgcaaccccttaagtctcgggtatgcaaccgggatgcccaatccaggactaaaccggttgtttattttttttcttttttaattgttatttgctacttgcatattaatttcgagccgaactcggcgcacatcgagttgctcctgacatccccagacccccacatcaaaatcatctaatcagacatcacatatcgagttgctacaaatcaaaatcatcacagatcagacaaaatctaatcaaaatcatctaatcgagttgctacaaattagacatcacagatcggccacctcagcaacaaaatcatccacaaaaaatcatactcaacaacaaaattcattcacaaattcacgaatcatctaaaaaatttcgcaaattcacaacaaattcacaaataatgccaacgccgctccacatcgccgcctgccgccaccgtctattgcctcccctcttgctggatccggtagaggggagggcgctgtcgttgcccctcaggcaccttccgccaccaacgctgccgcccgtcaccgtcgtacgtcacaactgaggagggggaggagagaggaaggggagaagataaggacaagaagataatgggagaaaaaagaaaaaggacacacacgctcggctcttttcctcccgtgctctttttttcaatatcagccccagttggtatcataaagtgtcgttaggtttttgaaccggggctacagaaattctttagtcccggttcctatttgaacgggacaaatgtcatttttaccattcaggcaaagatcagttcgccaatagtctatgaatctgaacagaactaggatgtgtcattttcactaatagattaatttattctgggttaaagagagtaacttaagtaatagtgtattaggcactctctaagactcttagatttctcctatatctaggggcccgtttggcacaccttcaactttagctccacttcttttagagctgaagctcaaccaaatggttacagtttcactcaaaaaggcagtgaagctggctaaagtattcttacaaaatgaattagagaagcgaagctgcgttttaggtagctcaacttcactccaaacccaatttctaaaattaaacctagaagttggaaccctaccgaacagagatatttaactaattgctactcttactagtgacaataaggaatttaccactggacacatatgagggcccacatgtcatatattgtgactggcaaatccttaatcgccacatattaaaagttgtatatagttaaatgcccctaccctaaatcctagtcccaaaatataaatattttttgatattgtcacaagtattaagaaaatatgagaatgattagaggaaacgtgtgattagttgaaaagataaagtatgtaaaagaaacttattgtgattggttgaaatgagaagaaataactctattttagaacaaagtattctctccgtccaaaaaaatttaacctaggagaagatgtgaccccttctaatacaatgatctacacaattctctggctagattcgttggactagaagggagcacattgctttgtacgttactacctccgtcaataatagatgttgctttaactttttacttgcaacgtttaaccattcgttttacttgaaaaattaatgcaaatataaaaaataataagtcatacttaaaatacttttgataataaagtaagtcacaaacaaaataaataataattaaaaaatctttaaataagacaaataatccaacattacaaacaaaaactctaagcaccaagtaatagtaatatggtacggaggtaaggcagtactctctctgtctaaaaaaactcaacttagaaggggatgcgtataactcaacttagaaggggatgcgtatgagtgtaacccacaactgtaaaatcatagatgtttttgattattattctatgatgaacaattgggcattggagattattggttttgttatttggaatttattcacgaagtggttttggagatgattggattcacatgtgatcgcagggttcattattttatgtgaccggtcagaccgggttgtgtatgctggtcagaccagcggtgatcgagcagtcggaccggccagcctgcggtctgaccggccgacgctgtgttggtttcggtttcgggttgtttgtttggatatccgagtttatttcttgattatgacttctagatggatactatacgtatgtaatacaattgtttgctgctaatgagtcaagttggagatagcttggtcgcggaatatggtttctttgtttgttccagtgtaggtgacttgatgtctcgggagagtatttgcgatgatggaccgggagtcggcttggggataaggtgacgtccgtggtggtcagagatcatgcgggatacttaggctagagttgatgcacgtggttgatggagattccatatggcatacgatggagttattgtgtgcgtatgagatgtggagttgaatttggaaggagtccaaatttggtacgattggttatgtaaagtttctttcttgtactagagggtttcctaaggtgtttaggactcttagtatgagtttggttcgtggctttaggctgcctaccttatgtataaatagagggggagcatgaggcttccctgtatcgctttagagagcaattgagttgagttttgagttagggtttcgagtttagtcgaaatttttgtaaggagtgctgttgatgcactttgtaaacacagagagaatcaataaagttgtcatctattttaagagttcttatatttgtgtttcaccgggttttggcggtataaccggcaactcaccggcggtcagaccagcggcattgcggcggtcagaccggcgggagaacggcggtcagaccggcggcggcgacagcgagcagcaggcgatctcggcggttagaccggtagatcaacaccggtcagaccggcggctatgcttcggtcagacctgctaatctacttcggtcagaccgatctcatcgaaattgagggtaacttttatttccgctaaaagttttcggtttttggttataccaaccattcacccccccctctggttggtttagttattgtgatacgatcctacaacaacctcttttttagttctagattgagtttttttttaagaacggagggagttttttttttacggaggtagtaaggggctgtttggatgcttgtttcaatttaccaaactactatatagctaaggtgtggcataccacaatttatgtggctaagaaattcttggccacaagttaggcaaatgttggtaaagatatgtgcctatgacaagtggggtcataaaataaaaaattgtggcatgataaagatgtggcaaccaagcaaacactaggttaaattggtcaaagtagcttgccaaagttgtgacaaagtatggtcactatccaaacaacccatgagcgcttagggcatccacaatgttaggaaaaagcaggtattaagcaatataatatttctatgatctagtaataagcattgtggaagtgggtagtaactaatgctaggtagtaagcttatgacccactcataagaataaaaaaacattaaaatctctctcactctctccttccaacacaagatgtgctactactgcatgctgagttggacaaaaagcaactaaaaagcaatattttttccctcatgggacccaccttacaaagacctattacttagccctgctacttattacctagttaaacaagatacattggtgttcccttagaaataacatttggagctagtcccccacctacgcggctacggccaccacgccgcccgacgcgcgcgcgcgcacatggggatggggggtgggggggggggagcaccaggccaccagcacgcccgcggcgatggctcccatagtcccatcccattcctcaacaaccctgtggagattatgggtaccccatacccacacggcatggttatccgactagttataggggataacttatatatatgaaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcatatatgagacaactagatcgtcagatctataatacacccggcggattcaaatccccaaacaggagtagggtattacctctcatcgagagggcctgaacctgtctaaatcctttgtctccacatccatccacttttaggtctcgtgcgctaccccgttttattattgccgaatccatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactgcgcggcactattgaggcgattgatgctggtcatggactcgaggcgtctcagctttccggtcgatcggccgcgagtccactccgccggcttgtcctcgccaccgccattgctgatagcaacaacgacttcaccgccggcccgcctccgtcgccgccgactggtgtcatcgcctatacggttggtcggtcacaccaccgttcatgggcgtctacgacttcaccgccggcctgcctccgtcgccgccgattggtgcctccgcctacacggctggcctattatgccgccgctgttgggcgtctacgacttcaccgccggcctgcttccgtcgccgccgagtggtgcctccgcctacacggctggcctattatgccgctgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccgacctgcttccgtcgccgccgagtggtgcctccgcctacacggctggcctattatgccgccgatgttgggcgtctacgacttcaccgccggcctgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgtcggcctgcctccgtcgccgccgactggtgtcctcgcctatacggttggttggtcacaccaccgttcatgggcgtctacgacttcaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttctccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggctgccttgtccgccgccgactggtgtttccgcctgcacggctggcctattatgctgccgttgttgggcgtctacgtcttcaccgaccggccgccgcatccgccgctgactggtgtcaccgcctgcacggctggcctgttataacgccaactgatactaccttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgtttttatcttcacaactgcgcgtcttcactaccggttcacttcatcacggcaacacaactttgtcatcatggtggagcgacttcatctttattatcttcggaaccagcaaactctattgctgctacttaacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaataactattcgacgacaagatgctacagttctcgactctatgttcagttgtttcccaactaatcaaagagtcggggggctacacaaatacaaggctcaaaatttgacaaattttatgtcaagctgaagaaatcaattcatcagccaatgagtcaactccaggagtcattatcttcatctttgcttcggagcatacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcatcatcatagtcggatatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatctttactgttagctgacctgactgttgccaactggtttcttcgcctccatggttatgcaacttcattacatttgatcggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatgttacccggaagatttattactctacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaaactttatatagctgtcccgctgacttttttatatataagtcaaggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcagattttacaccacatatgccatatatttccaggtgtggtgaaaccatgtgtcttatagggacttaagcacatctgttaaagcagtgtgcgcatggcgtatgcccaatactttggaaatttctttattcacaacatacaagcttttttatagctgttttgctatgtgaattttcaataatgtagccaactttagggtacactcatcatattttacaaagcagtcggtatatcacttggatcatattattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtctttatatttggtaaaagtactcgggagatcatggcgaggatgattgaagcactcggctttggagtaatctagttcgagagaagattatctttccgactgtgaaggtcccaggggctactgtggagattatgggtaccccatacccacacggcatggttatccgactagttataggggataacttatatatatgaaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcatatatgagacaactagatcgtcagatctataatacacccggcggattcaaatccccaaacaggagtagggtattacctctcatcgagagggcctgaacctgtctaaatcctttgtctccacatccatccacttttaggtctcgtgcgctaccccgttttattattgccgaatccatgtttcgacaaaccccccgctatcttaccatctccatgtgggtgtgggtgtggcgctcctcctcctcctcctccaccccggtccactccccctcccctctcctctttaaagcgccgccgcttcttcttggcagcggggtagatagattagctcccgattcggacaaagatcgctcgctgctcgctctcgccccgcattccatcaatgcgcccgctgatgacgatgatgatggattggccggctgcttaggcagcttgggatggtttcggggctccgttttctgctgctgctgcttcttgctctgacgacgacgaccacaaaccgtggccttgccgattcgatgtcacgggcgccgcccggatgtcgctgccggtcgccgaggtagctggcatcgccgccgcctgcgtcgccctgctcgccgccgtggccgcgctgtggtgcgccgcgcggcgcatggcccgccgccggggccgcaactccgacgagaccggctcctccgatccttccaccctgggtgcctctcagttcgccattgtttcttagttcttggccccttttgtatcctccatccatttcgatgctgatgtgtggtgccaatgtgcgtggtggcagtggagtggggcaagggaggcaggagctcgtcggcgccggagcaccagggagcgaggcaattctcgttggacgagctggctcaggcgaccaagagcttcagtgaggccaacctggttggcctgggcagcttcgggctggtgtacaagggcctcctccttgacggctccgtcgtcgcgatcaagaagcgcattggggcgccgaggcaggaattcgctgaagaggtaaaatgtggatgcagaatcagggtgatattgttgttgggggggaaagattggaactcctttttttttatagaagaatggaatttagctgtgtcctgagcttgaactgtgttggtcttaattgttcctcatgtgtttgtatgttgtctggattctttcggtgtctccttcaatgtttggtggtactttctgttactcctattggattctgaaattaactgcatctgcatctcactaaagtgtgccatatttatgggcatagagtgaacattttagtcaaatggcttgtttgggagctagtaagatctgtctggtgtcaattgttgtcgtttgctagtccagaaagtttcataaattagatagggacgggtaagtaaatgcatttgtttcagcctcatatgtcagcactcccattaacttctttggtgccccttgcaaaatgcaggttaggaagctttcagagattaatcaccggaacattgttactctcattggttattgccaagaagggggtctacaaatgctagtgtatgagtacttgcccaatggcagtgtctctcgccatctctatggtaatgtttagttaggtacttgcttttgtgcccttgctatactttctaaagccttgtacgttttaccagataccgggaaaagctccatgacaaggcttgagttcaaacaaaggctctcaatagccattggagcagctaaaggtaataacataagtgagttatctaattgctttggagacattaagtaataagtagtataatttttttttatttgctggtttgagtcatctgcatatcctgagcctcctctgagtcacaaggattgctttgttgacgtgaattataaattcttttttatttgcaggtctcaatcatctgcatactcttgtgcctcctttgattcacaaggatttcaagacaagcaatgtgttggttgatgaaaatttcattgcaaaggtggctgatgctggacttgttaggttacttagaggatacgaagacgtcagcccatctcatgggttcagtagtagtgtgtaccaagatcctgagtaagtataattaccacatctttttatcttctatttttcatgtcagataatagatgtgtttttggaccgaaagacaataaatatgctgatcactgctttaccctataatatttatatttgaaaaacttgtacaataattttgtcacaagtcaatcacagttttaggaaaagatcttcaattcatgtattctaactaagtcttgcagttctggaatgatttagtcactaattctgtcatatagtcattgatgtttcattacgcatctttgttcttagggtacaatcggtgctacagttttctgaaagcagcgatgtgtacagctttggagttttccttttggagttgatcactggaagggaagctgcttgcctgatatctccagattccagagaatctctggcccagtgggtaatttccattgacatttagctattgttacgaagaaagaaagctaaaaacttctactttgtgtttcaaatatcttaaacccagtgttcaggctcatcccttagtatttatagagatggtgtgaaggttcttacttttgttgcttggaaaagaacataactttttatttattggtccaatataatctgtcatagcttgtttatgtccacatcaacaaaaaagtggtaactatggatgtttggtaaatgctactgtttgtctgttaggcagtgggccaggtttttttttttcgtgtatgtgtgtggatcaaacctacagcagaggaggcccccgtggttataactttattaataaaccatggccagggatttcctcaacaacagttaggaaatattcgtattggagcatttttcacaccttttggcataagaggtccttgacatttgatgctactttcctgcctcaactgagatatatagttcaaaaaaggaaaaataagaacattttcagaagagaattgcagtttcttgcacacgattatattccatatcctacctccagctgacatccattttcctgtcacattgaaagattgaaggacatttcagttcaaacgaactaattgacccaaggttaggtgccaatttcacctcagaaggtatgaaagagtttgttggcctcacctttcagtgcctgactccatcttcaagaagaaggccaaagatgaggttagtcgcgacagaactagacagaattcttgagacagagatgtctctgacaacgattatgggtgatggaaccgccatcatcacccttgggagcacattgtttaagtagcgaagatgaaaattgattgcatgtctgctatttgatgacatgatgattgtctgtagagtctaacagctgttgtttcttagaagttgtacaggctctgcattgttgtgatatgccatgtatgattttttttaggcttatcatggttggtataatttggtagggaaaggtgagaagaaacagagctgtatgtatctttctttttcttcctccttttgttggttgagagaattgtatgtaatttcagattgttcagtgcccttttatgttttaatctttgaaagggctattgattgagttctttgctaattcagtgtcatattaaatgattaacatctgttgttacatctgtcctcagcacatgtttactacaaatttgtttcagaattaatagcatgtatatttgagtttatataacacccttggagattatttgtagcacctataaatttctgagtttgcaaaatccctactttcttaggaaaatttttattcggtttgcgactaattttgttagaaaatacgcatgaagataatagcctacatgtttgtgagttgtgattaattttgctagaaaatagtcgcaactccattttaatccttggttcaatttcacctaaacataatgcccggttatttctccgctccaaatttcagaaccaatacacataatcctcaaatcctactatatcacaataattttgatcaaaatttctactatagcacaataattttgtaatttataatttatatagtataagcttgaacttatttatatgtactacatagttactgccattgtgacgcttctgtcgtgtgtgagttatcctcagcagggatgaaaacggtaacggaaattcccggccgaccgatgttcgttttcgacttctatcagccgagctatatagaaacggtaatcgactgaaacgaatatgaaaatggtaaataaaaaaatatagaaatgatttttctattataccgaccgtttacatattcttgtgaaaattatcgctttttaaaatatggtaattaccgtatttctaaacatgtcgatatttatagggtatgtctctacttgatccacagtttaaagattagttaacttttcaaacaaatccctaacttgagtgcatggctgaatgaagttaatttataaagtaaatttcacaaaacttactttgaccaaattaacgtaaaactacaaatttaaggtcatatatcataaactaaaaatttagcaacaaatttattacaaaactataggtttaagactaagtataacaaaactacatatttaatgataaaattatcataaaactatagatttggggttttaaatcctttgtgtttgagttataaatgtctaacttttttgattaaattgatattaaacttgtagttgtgtgataacttgttactaaatctgtagtcttgctataatttaccttaaccttaaatctgtagtttgtgatacatcatgttaaatctatagttttctgataattttaccgaagtatccgtagttttgtaaaatttactctaatttataattgtatagtataagcttgaatttatttatacgtattacgtagttatgctaagttaaatattttcttttatagtttaatgttttttatttgctactggtttccgatttgcaccgacatgttttcgttagtattattcagttttcggttattatttccgagaaaaatatgcttatatgaaaaatatgccctaagttaagaaatgagtgaccgtaacccctcgtcctcgtcactttccccttgcgcaccgcctccgccgctgatccccatccatccagcgagcgagcatcattcgtcctaccgcatccatcctggtgagcacatcctccgccaccgccgcctatgccgatccccatccatcgcgcgagcagggtcgccgtcgctcgtcctgctgcttccgccgcatcctctttcccagggatggattcaacgtgggtgcaggagtccccccctacacccaccgaaccagagcaccccctgagccccccttcaaaaaattcaccatgatagagtagagggtgctgagggggctcctaatgggcgcgtgcgcgccggctggcttgctcgcgcgcgcgccccatcctgcttagtgtataggattaacggttaatgacactaattagttataagtgtaattttagtagtagtatttcttttaaaaaataattcaattaacatttgaaaactttcatgttgaaatttgaaactttaaatgtggatttgaaaactttcaaatcaagatttttttgataactttcaactttaatttgaaaatttccaattcaaatttgaaaactttcaatctagatttgaaaaaactttcaactcgaaatttgaatatttaaaatcaaaatttgaaaactttcaactagggtttgaaaactttcaactcgagattttaaaaacttttaactcgagattttgacaactttcaactcgagaatcgaaattcgaaaactttcatctcagatttgaaaactttcaacttgagatttgaaaactttcaactcagattcaaaaactttcaactcgagaatcgatattcgaaaactttcaaatccagatttgaaaaatttgaaaactttcaactcgagatttgaaaactttcaactcgagattcgaaaactttcaaatcgagattcgaaaactttcaactcgagattcgaaaactttcaagttctgatttgaaaattttcaactcaaaatttaaaaactttcaaactcaaaacatgctaaaagattaaaaatataatcagaaaaaagtggaaaaaaacggagaaatcactaaaaaaaatgaaaaaaaagttctgggcccgaaacgcacgtcgccggcgcgcgcactcgttagcttttccggggtgctgaaggtcgggactatctatacatttgtcgacaaattttcttctaaaaatctgtcaaatataattgtagtgtaattacattgtaacttacatataattacattgtaactacaatataataaaactgttacttatatataattacactgtaactgcaatataactgcatgtaagtaagatataactttagaaaacttccgcttggacagtgctcacgccaaagagggatcatgaactcgcaaagtctgtttggacgatgcgtgcggagcatgcaggctgaacttgtgcatgcggcatgccatcgaactaatgcttgccgtcatctaccagcatacagtgcttggccatcattcatgcatgccatgaaatattaaacgaggacatgttcggctatgccctgtgccactttatgaaagcccttcgtccgtcacctatgctacgcatgaatgaactgcccctgtggcctgcggacgtcgaaagaaacgaaagtag

SEQ ID NO: 78367 - DNA, 821 bp, Oryza sativa
acccccccccccacccccccaaaaaaaaaaaaataaataaaattcctggatcctctacccactcactttttttctcctatttgcgttaaccttagcttctgttctttgaaatttgcattaaccttaatacttatatttggggattcaactgaaccccctgtcctatgttagatccaccacttcttacttctttttatatatatcgcaggaatcaatctgaattaagaagattagcgtgatgtctttcctcaggctgttacctcaaaggttgccgcaactttttaggtaggtattagctgcaaattttcggcaatcttgtactgagtgtaatttgtaggctgcatttgtatattcagatatccaactttgccatggaattaggttgtgttttaattgcttccttgatggcaacttctcaggcagatggagcaagatgttgagacagtgataaacgttctacagccaggaccgatagggattgtggagcacaaattcactgatgcagagatccgcaatgcccaagctgtagtaaggcgagcagtcgagaattggcagaagagctcgacccttgagagaaatcttggtagtggttctttcgccaaatagaactaatgccaccaacacatgacttggtggatcagccgtaccgagtataaacgggttgttaacttgttacgacatcgctttcaaaacgttgatatattttcttcctgaacgaatccatgcaatcagatgcattatatgcagtctgttcactctgttgccaataaaagtactttgaacttttgttaattgttcattgaacttctgaggttttggat

SEQ ID NO: 78368 - DNA, 948 bp, Oryza sativa
  unsure (1)..(948): unsure at all n locations
tttttaattttttggtttagtgatttattttttttagtggggaatggtgatagttttttgtgattttgagatagtaaatgggggagatttatttggtttgtanatgattggtganggtgtggtgttnnnagganngatganggnnagaggngggggtgggggggtcaacatacggggaacacacattatgtctcatactattacaataccataatattatgttgtactctaaagaagtttcatatagaaacaaagaaaaaaaagagaaatacatcacaacttcacaagacaactgattatttttcacgcgtgacgcaaattatccttcatgaggagcattctgtacaagagagtatgagaaagcaaatgttcttttcgacatgctgcgattctagtctagacaaacaacatgaaactgtgctaaattgctaatggattgaagtattgaatcattccaaatttccacttaagtaatctctgattcacagtagcataaattgcattgcatatatttgcataaactgataaaagtgataagcatacctttgtttagatgttttgtagccgccggcctgctgctggcctattgctctgcctggtcaggagcagatcctggtcacgcgcgctcccgtggcgtcgccggcggccggccgcctgtctgcaacctgctcggctgctcttgctcgcggacgcgccgtcacccgtgctccgctgcttgcctgctcaccgctggcgccgccggccccccgcgctgctcgcctcttgcgccgccggcgtcggggaactagggatttggggtggggattgagttaagtagttgggctgggggctacatgtgggcctacggcctattttttctaagtgagttgtgaaagcccaatagcgtccgcctggcccaattttcgttcgccggccaatttgggctttccataccgattttgctataaa

SEQ ID NO: 78369 - DNA, 8823 bp, Oryza sativa
atctactgtagcaggaagcaagctgttgcccggattaaacaataaagtaaatggaaatgcctccaataagtcaaaacagtctgtagttgaaaatatgaagcatgcagctattcatgtcgatgcttcaactccaattaatgcatctgctctgctgaaggaagctagagatctgaagcacttgtctgaccgcttaaaggtttggatgtttgatacattagtcagccatttttttagggttctcttgattcagattccatcactactcatttgcaggggaagggggatgaccttgagagtgcaaacatttgtttcgaggcttgcctaaaatttctccatgttgcatctctcaaggaggctgctggtgttgatagctccaaacaaggggatccaataaatactatgacattatattctgatactggaaacctttgtgggtaagcaatttgcagttcacgtcttcaaaaggcaggcagcatgtagaatatcacttctatatttgttagacccttttaacattcttgaatgcacgatagtagtaactttttttaatttggtatatttattcttgttaggaaccatttcaaaacaacaagtgctttaatacttcttgtccttgtaattataaactataatggccgaactttaatgctttcaatgtctttcgtgttttttggacatgcctttcatttagctgccaaatattacttgttccatttatccttgtataaaaatttattatatgcatatgtaaattcactatgctaatatggccccattggcttgttcaacagattttgtgcccgtgaatttgagcgacttaagaaaatggcaaatgctgctttggcatataaatgtgtggaagtggcatacatgaaggcagctttctacaagcatcctggtgcaattaaagatagccatgccttgcaggcagcatctgtgattgctcctccaggttttacatattctctaattcatgaagctgcttagttgttttagtagtttctgaaatctctttcattcattaagggcatgtttggtttgaggaatggcctctctggaacgggctggcccatcatggggtcatgtttctattttcaactcattcagcatttctcaaaccaaaggttccattggagtcaggatcagatgatcctgggttgaacatattcctcaaaccaaaatgcttcataaaagtagggatgcttaaatgtttgaaaaactgtatctgtactaagttctaccacaagtgaaatataacaacatagaaatgaatatgaagtaggtaatgctttcgatggttctaggatttcatccttacaccatgatttttttgaatctcttacatcattattgttctgtttattagacaaagatatccttcattttatttcgtgatatcaattccaaacaggtttattatcaatttgttgaaatgattggtcttctgataattcacattcctcttgctttctccttggccagctgaatcaccgtcgtcttctgcctcagatgttgataatttaaataacccaagtacaatagctaacattggttcaacaagaggtctatgcacttctcagattgctaagaatcccatatctcggagcaatcatcacttgatgggattgcttgcttatgtaagctgcttatttttgctgcttatttttgccatttggattattggatattgatatgccaagttgagtttttacttgagggttgcacacaacacctacaattggcattgcacgattatgatccatttaatgcttgccttgtttagtttagagcaatacttattattgtgggtcaaatatgattacgtatggaactcaatgattgcatttattccagttttagagtttctcctatgatcctttctgtttgctagataaggtcagtatttaggaccaatagtgtgtaacggtactaaaaagatgtccatggaaatcaagctttaaaaaataacagcactcttcaaaccttttggtttagtatggattctgctatttgttagttcaaattgactggttatctaattccatgtaactactccacaactggtatccaatcatgattaaggagatatcagtgagaattaagggaactgtctcctgattgtaatattttttacaggtagaggacacaaattatgcatttgagggacccagaaagtcgcaaagtgcatttttttcctatctttctggtattgaaaaagatcaggctgatggcattgctcttttaacggaagtccttaatttcagtttccataatgtcaaggggctgctgcaactgatccgtcattcattggagtgtatcaaccatgaaaggttcaaataatagaatgggcattcttaatgtgaatagagatatatgttggcaatgtttctatatgttgttttacaatagatgcctccagtatgggtgcaagaatggagcaagattagcaatttgctaacagaggaaatttatgatgtgtggttatcacctggaagtattttctctgtggatgaacattttgacctgtgccaactggggttttacataaaatttagcaacaagtataaattgctacattcaacattctcagtttcaatgtctgattagtccccgattccattgttgatgtgaacccagttgtcacctatttcattgttgtaccggtaagaaatatctgtttacccctctttttgtacatgcatgtctgagtacctaccaaatggctggcttgctcaatcttctcttgtactcttgatatgaattgctgcatatttttctctatcagtcaaacttttgtactcaaatagcatccaataaacaagaaacttagaatcctcacacactatctttttttaaaaaaaaatctaacatatatacctgcacttttaaacagggacaaaatttcattgggacaatgttgaattgaacaatctattcctgagttcctacagaagcataggtcagggcagaggagaatattctacttttcctcaccttctattggtctgtcgatgaaggttccaataggcaagaaactttaacccttccgttcttaaatctttatgttgtactactagtgttttagttcagtcctgtacttagaatagataactaagtcaagaaggtttgtgtgattgcacttggttttatttcactagatgtgtccatcttcctcctgataggtagggtatatttgtgacctgtaataggaaaaccctggataattcttattttcagaaccatgtaatgaattaggacaaacataaagcatatctaatggacaacgtcattttgttacagctgcagtgaagtaatcctttatatgattatgattgccaagtttgatacatgcattcagttgtggaggcgcataagaacccagctacccagtgagcaaacttgcagaggacggaggacgtcagttaccacctctgactccaattttgtgtacatatatataaattaatgatgagctgattgcttccccttttttctccatacctgtgtacatctatagagaggtataccagaaaggctatagcggaacaaaatggagaattttgatccaatttcagttgattttctgtggtttctgagtgactgaattcattcttttggtatactgcaaagatagctgccccttagctaagtggtcattaagttgttgtgactatgattctttgagctgacctaacaacaaatgatgatggttctgttttctaacatgagtgttgtattggttcctgccccagcatcgtcattgtacatttgtaactgctcatgctgctattaaaaaaaaaatctttgcatctcgaaatgttgtcgttttcaggctgctttgatcgcgtattatatacatcagggaatttcataaaaccaaatgcttgtagttttataatatttgtaataaatatgtagatttgtgacacaacaccttaaatatatagttttgcaataatttggtcaaaatgtatatagttttgtgaaatttattctacatacattcattctcactgtaagggtaattcacgcgacagtgacttatatgtctccctcgcaaaattcttccagcttgacctttctcctctcattttgattttatttcagtaagtctaaggctctgttatttaattggacgtagtatcaaaaaaatttttaagtaggaattataaatataatattataaaactaataggtggtttagaataggctgatatacaaagttttttaagaaaccgtaatttaagaactgtggtacatacaaggaaagatttgataatttaacaccttttaaaataggcttcgattatttaacatctaaatggtcctacatgttatcatcacaagtgtcaatcaaagaaattgggtagaaaaaaaaatgttaaattatcaaatttcccccacataagttggtgacaaaaaagtaactcctacgaattacttttttgaattatttattgaatgaattgttcttttcaaattatttattgaatgaattgtttaaacattttatgtgtttcacacttcaaagtaataacagccccatcggatggcctaataagccaaagaaaaatccaaattttaaattttcaagcttaattttaagattgattttgacatattttcaacatagtaacatatttataaaagttttacccacaaattcttttattttctaataagccgttttggtttattagaaaataagccaaacgatggggacctaaaaaatacattttatagaaaaaaacttacttctactaccatttattttattaaactaatgaggaaggcaaatagacttattcctaggaagaaacgcaggctcaccagcccaactcaggcccaaaccgtgcaatcctcccaaaaccctagcccactaatctccactctatatattcccccaagctgcgggtttgtctccctccgccgcctctcttgctccaacgaaatatgctgttgttatactcctcctcgcctctctgtttgatgatttgtgtttatgatggttgttttggtggtctctttcgtttgccttctgctgttaaatctatccttggtttctctttcgttttgtttctcttggtaatgaatcttgggttcggtggcctggctgtgatgcgtattgataagggattttctgagggatggagacctagttttcctcctcctgattgagagaaaccaatggatccttctgagcctaccaaaaccaaccctgcgagttctttttttatttttgtttgctcttgtacactttgtgaactgttcatttttgttctttgattttttctctcttccttttgctgtcttctggtgaactgtaatacaagctagtgcaagatctgctctcagttgatgtgaggataaaactttcacagaaactcttttgatgtgttgaccctaaaattcagactacaattatctgatcagctgcagaaacttgccctacgaaaaaaaaaagatctcagtttttcccaccagatccagttgttttccttgttcgtcatgacttagatttggtatttaattgctaatccttgcacaataagccgatgctctggacgaaataagaggaaggaagcatggtagtgtgcacggagattcaccacaaggtctgcatgtctgcctgcagtgacgccttcgggctttgatctcgcgggcctggatttgacccacattttcctatctgaattttgcttccggtttatcttccggtaacattgggtttttaggggatggatgggtatggtggatggatcgacatgccagaacgatcaagatcgtattgtaactctgtacttctgcacaaacttacactaagttgtccttattgatatgccaatgcgatctacataatcctaaatttgtcattaatttttcagtgtcccttcggaaataattctttgttttaaatggctacaggaattaaaatacataaacatgtgaaaaattgaggaatcgatatgacatctagttctttaggaattgtggcatagatagttgatccttaggaattctaaaatgcaggaatttcaagttccttgttgcaaaggagtacctgggaaaatttgccatataattttaatgtaaaaattcctctacttttcctttgtaatttgttccaaaagagcccttaaagagggagtcctatacgccagggtcttctggggttcgaaggctcatcatttttaattatttgatattaggttatttcctaatatttgtgtccttaaaaggagtcgttacaagtgaaatataatgtttattcattttatgcatgtgcttgctcttgttgctcttttgcatagtgctgcctccggttgtgctttagagattttgatgctcaggccatgaagaacataagcagaaactagtgaagatttataccagttaatcttgttgcattttattattagaaccaaacaggctatgaagttagtcaaacttgttaatctttaagatgacaaaatgtgttaaaagtataaccagcaactaaacacctcagtaacatggtctatgttatgctggagttgtaattctaacagcaacaccaccattcatgggcagagaggcagagctagataggacgggaggtgtttaggaatctagtctaaatctctttttaactaattaattcatctattctcattatatatgttacttctcaatacaactcagatatatgcatcagcataaactctggctaaacattgtgtaggtgttcttttctcctgaagatggagattaagtttttttacgtaaaatgaggtggttttaacgtataattgattgagttttaattattacaaacttgaataatatattaatatgatattttagagtaactttaatataaagtttttgtacgaaacgtaccgtttagcagtttaaaaagcgtgtcacgaaaattttagggcttattcctttcaaaggaattgcaaaggaaaagcataggaataggaatagggcttattcgtttcataggaatgtaccataggaaagttttccattcctccaaggaaaagcataggaaaaaataatccactccaacctaatatttgcattcttttggttggcttgctcaacagcataggaaaaatatctgtgttggtttacatatgtattcacgaagtatttctatgttttgaaaatcctgtgaaccgaatgagcccttaggcttcatccaactcttatcagggatgcacatgaccatagttcgttccagcttttcgcccgtgccgtttgggacttgggacatgcatgtcatgtcagtggcgctgttcatctctcggaaggggagcacaagtagcaccccacagtcacacagccggtgatggacagggacgggttacaagaccggcgagttggcctagcctactggcatgaacgaccatcccgtggaagtccaccgtgatgggcatgacagaggctcgttgagatggtgccatcgctgttggcgaacgtgattagcacgtacggtggcgatggccagctttcccgctgttgctggccggccgcatcgtccacggagatgttcctcgatcggcgacccgcgatcagggttcactaaatcgattcggatggaattaaggtcaacccatgataagatggttttcatggtgatcgtgtgggtatcaaaagctttaccgcacggttttataaatcctgcccgcgatcgttgtgaatggaacaggaaagctgaaaaagaaaatatttacccctctaatgtatgataattaggagaggtgatctcagccatagacggctcagattgtccaaatccagagtgatggagtttctatcatatccagggcccgtgccgaagtagcctacttgctttgccggtgacatatacagctgatggttaataatctctccgcatctaaatataagaggttttgtttaaatgtggtatatcctattataataaatctggacagtttcttatccagatttattgtactatgatatgtcacaactaaccataaccaaaatcccttgtatttagaaatggaagggtattgtagtaactctgcaatggaaaatgttagccatgacacgtgaattcaactcagtgtaataattggtatagtgccaaatgattggagattggaacacggatgccatcctaaaaaaatactgctatggttctgcttggtcaactttgaattatataattaacgcgtgattttaaattttaaaaatgatttataaattttaaattttaaaaactactgtgattcattttataaatcgctttgatatttcctaagttaaacttttaaatttgattaaattcatagaaaagataacaatatttacaaccttaaattagtttcactaaatctaatattgaatatattttgatattgtgtttgttttgtgttaaaaatattattatatttttttataaacttagtgaaacttaaacttaaaatgtttgacttatagaaaagtaaaatgacttgtaatataaaataaatggagggagtagatcttttacttgtgatgcgagcaaacatgaaagctttatgacaaacaaaacaaccaaaaaaataatcctaaaattaaacctgtaaatttaaaatcagctctagggtgattatgtttagagtagaggcaagccaaattaagctggttgagagttactctagatcataatcaccctagatctagagttagggcctgtttgacacagctccaggagggatggagcttagccaaacagttttagctccaccaaacctgggagtagagttgggtggagctctctcacaaaatgtactggagttgtggagctggatttaggcagggctgcag

SEQ ID NO: 78370 - DNA, 5318 bp, Oryza sativa
  unsure (1)..(5318): unsure at all n locations
ttcctgcagccccaagttttcactatatatgtggtttgcactagatattttccctctattttaccatgcttggaatcaacggcaacttgttaaacaatggtgtacctctaatactctctttacttcttaatttcgcgcgacaatgtacgggaaatcatctagttttaaatttggctgatactcttgatgatacttaattaagtaataatccacttaggtggctaatcaaatttggctgatagttgtgcacttaggtgtgtctagtgctaccagtacattggaagtgattaactcaatgaaattttgtagcacgagattgaggattgtgtatcaaacaaatatatgatggtgaaaagcacgagattgaggaattttgttaagagaaaaaaaacattatctttttagtggattgtgtatatcaagatacataatctactaaagagataatgttttagcttatcaaaatttttcttggtcggtctcacatttcaattagtacttcctccgtttcacaatgtaagtaattgtagcattttctacattcatattaatgttaatgaatctagataaatatatatatgtctaaatttattaacatcaaagtaaatgtgagaaatgttagaataacttccattatgaaacggagagagtagtagattgcaaaccctggtcaaaagataagcatgacaaagctaacggtagcacatgcaaactaactgtactgcagtgcaactatgcaacagaaacgttagccaatagccatgacaagtgaattcaaacagatgtgtcatgctacggaaacctgcttgagcggtcaactttgaactatactccctgcaaaaaaaaatgaattatataattaaagcgatttgaattcaaagattgaattttctaaaataacttatgtgagattttttacttgtcttaggatcaaacatgaaaatagggccttgtcacaaagaaaatcgcttaattaaatttacaaatttaaaatcagctttatgatgattatctaaagtagggccaaaccaaagctatcaacatcttgagttactcccaactaggcaactagcttttagagtcgtatgctaaacagtggaacatggttctccatccgtcccacgaaggcgcacccacatatcttaaatatccaaatcttatattactagaaaaaatgcccgtgcgttgcaacgggtaaaaaagtttttgattgctatatattatactccttcacttttcatccactctcccataatatcatctttccgtttttatcaaaatcaaagagaatctttctacttttatcaaaatcaaagcgaatccataagagtcagataaaaacgacgacagtaaatccggtgaattaaaaccaaatgatgaggtaatagaaggaatcaattttttaattaattgaaggaggaaacgcatgtgagaggcaaatcgacagtggcgcgctaggggtcggcctggcgactttaaaaaaacgaatccttaccgcgtgccaaaaaaacgacttaaaacggatgcaaagacagcgacaaaaaaacagtggaaaaaataaaaaagcggattaaaaaggatggaaaaaatacctgtattttttaataattaggtatatggatatatatttacatttgcaaaatttgtcaaaccacacgaaaatcacaaaattatataacgtatattttttacgttaatgacttctatggtcatcccaatatgcaaatatataaaaggttactatttctatatcatatcagtgttgaaaaattaaaacttccaaggtcctgaacattaatgtgtgagtactaacctgggggtatttttacaaatattttgtatgtactgaagtataggataaacaatacttttagggatgaaaatgaaaaactgctggattcagatgccacgtgcatgttcgcatgtggcctttggcagcggtgcggtgactcgccgtccatctctcttcatgtaattcacgctccatgtactgcacatgatttcgcacagagagagacaaagggcgcccagcctaaccgctcggagcgagcgccgggcgcctcgatttttccgccctcattatctcctcgtttttccctgatcttttctcttcctctactcgtcctctccattgcgcatcttccctttccttctttttcttcttctcttctcagccgacgacgccctccatctcgtccctcccacccttccccaacccatggtggggtcgctcggcacggggccctccccccaagcggcagcgccctacccttggcggcagtgccttcgnctcggctcctccacctggccggcggggtctttcacccggtgagcaacggtgcgcgacgggccggggagcggcggccagcgatctactcctcggcgtcggcggctctctccttccgcgagcggcaacaggcggcggcgcctttccgcccctcgtctcgtctccctcgccatgaggccgcgggagggctcgacggtagtgggcggcggcgccctccctcccggcgggtggggaatcggtgggcaggggcggtgccctcccctctgctggatccagcgggaggggaggcggcggcggtcgggcgtcccggatccagcgtgaggggaggggatgggaggggaggcggtggcgacctggtggccctgcgacggtggcagcgacggcggcaccctgcccttcctgtgtcggcattttcttgtgttcttgtgttgatggaatctgttcttgtgttgatgagtgctgatgaaatctgttcttgtgttattgtagtagtgatttctctaggatttgggtccaaatttgatgcgtactcggattaaggcgcacgggggcaggctgtgaaggccagtactggtgaggttgccagcatgattttttttctttctttcttttttttttttgccatcggagaagggttgataagggatcgatcacacgcgcgcattagaaggattttttaggcgacggacgaaacggacgatcggaaaccttgcgtattttttaattaggtatagattataaaatttggtcaactattagtctaataaataaaatctgtttgatgacaataatatcatcattgaattgatatttgaatgtacttatgtaaggttatgattttgttgatacaaacacgctactccctttgttccacagaataaaacatagtcaaacttaccacaatatctaaaactaatatttgaatattggtttcaagtatactataatataatatttgtagcggcaacaatcataaccacaagaaaataaattcaatgattttattttcatcaaataaatttctatttgtattagactaattgttggtctaatatttcaagagttgaattttaaaatacgtgcatgttttatctagtgggatggagggagtagtatatgataaactcctgatgatctaaataatataaataatatggtaaacctttctcgatcggttttgttgagacttcttcttagtgcaaagacatgcatggggacagtctttccctttccctcaccagttgagttttttcttttaaaataaaatattaaggaccaaattgagcaattgggtgaacttgaaggattacattggctatttaggccttgtgtagttgggaaaattttttgggtttggttgtcacatcagatatacatacacatatttaaagtattaaatgtagtctaataacaaaacaaattacatattttgccaagaaattgcgagataaatttattaagcctaattaatccatcattagcaaatctttcctgtagcaccacattgttaaattatggcgcaattaggcttaaatgtcttgcaatttacacgcaatctgtgcaattgctttttcctacatttaatactccatacatgtgtccaaacattcgatgtgacagcgtaaaaatttttgttttgggaactaaacagggccttagccgataaccagtgttgccacaagtgtcaagcagtggcctataaagctactcccctagtcaaaaaaggccattcctagcattccaaggtgaaattagtggagagtaaaaataaccaaaatacccatcattatcagaaaaaacaataatgcagataagtaggtaaaggatactaaagcgatgataaaacttctcattttatgtgctaagggtaggtatgatgacagatttttttttctttttgacaaagttcaaactccagaagttaagttttttttgaacggaaaaggtacatcacatttattagtacgtaggatctcatcctcctatctatctattatattattaaaacagccttgaaaggaggcacaacgtttactgtggaggctagaaattcccacattaatcggagaaaaagaaaagaagagtccaagtagaaatacaatctaaaaatagctaaaattcggaattaaaaatatgcaatatggaaagaggagtccatatatgaacccaatacgtgattaattaaaattcataataataataaaataaatttataaattagaaaaataagaaaagaagagttcgagtaggaatacaatttataaataactaaaattcggaattaaaaataaggaatattgaaagaagattccatacaagtatcaatacgagattaattaaaatttagaataaaaaatataataaaatccgaaattaggcaaattaaaaagagagttaaagtaggaatacaattttgaaacaactgaaattgaaaataaaaaataaaaatatcaatagaacataataataaataaaataaaatctgaaattagaaaaagaaaaaaaagatttcaactaggaatacaatttataaataactaaaattggtaataaaaaataatactaatgaaagaaaataccatctaaaaaaatacatgacgagattaattaagtaacaggactataaaggagtagagtggtggcggttgatgaaacatctaaaagctattaataaaacaccaaatagaatcctaatgacgattaaaaggaaggacgttgggcaggttgtgaagcaatcagtcaacacggttggcggggacttctagaaagtaaaaaaaaaaccaatgataatcatatttgatttttaaaatctcaattataataaaatgagacgcggcgggcgggtcgtataggagtacaatggtagagccgtcgatggttggtgggttttctagaaagtaaaaaatgaattccaacgatagttgtgttcaatttttacaatcccaatgacaacaaagattatttgccggatgggtcgtagaggagtataatgacaacgtttgacgggatttctaaaaattatcaaaaacat

SEQ ID NO: 78371 - DNA, 9262 bp, Oryza sativa
ttttagaaattattagaaagaagcctgataggacaataaactataaaaactataagtttttaagatccaatttttaaaggttctaaggagaatgaatagaaacagtggtagattgagcaagctaataaaaaatactatgacagaagtaaggggtaacaactgatgtgtcttttaaaaactactacctccgtcccaaaataagtgcagccgtagatatccgtgcccaacgtttggccgtccgttttatttgaaaaatttgcgaaaaatttgaaaatatttagtcacacaaaaaatactattcatattttatcatctaatagcaataaaaatactaatcataaaaaattttcaaataagacgaacggtcaaacgttgagcgtgaatagtgcaaaactgcacttattttgggacggagggagtataaaattagaaacacgaagatgataaggtttggtatttcaaaatcttaagtcaacaagataactatttaataaattttaagtacactcatattaaaaaatatataatttatattgacatgcaatcattttgcgcgtaaaaaaaataattttatatgggtactagccgcgtaattgcgcgggccatccagttagttcctatatataattatggtgctaggctgctaataagctgccagttcgccacaagcccacaccaccacgtcatgacgtccgtgtcgtattctctaccgaaagtgtgcatgatgatggccatggccatcagctgcatgatgatgatgtcccaagcagcgtcgtcgaccgccgccatggcgcccagggacggcgagggcggcggacgacggcaccacttcgtgctggtgcacgggctgtgccacggcgcgtggtgctggtacagggtcgccacggcgctgcgccgcgcgggccaccgcgtcacggcgctcgacatggacgccgccggcgcgagcccggcgcgcgtcgacgaggtgcgcacgttcgaggactactcccgcccgctgctcgccgcgctcgccgcgctgccgccatccggggacggggagcgcgtcgtgctcgtcggccacagccacggcgggttcagcgtcgcgctcgccgccgagtggttccctgagaggctcgccgccgtcgtgttcctcaccgcgtccatgccgcccgtcggccgcgccatggccaacaccaccgacgaggtaaattaacatcgactagctagttgtttattaatgcttggcttaagcgcttaactcgatttgttaaactagttttatcttaagatttataatgttaaatttatcatcaagaacttacttaagtacaaattatgttcgaagtaattgaagaattaagtgtgaatttaacgatcactaagtaaaacaaatatatgataatctttttaagcgaggtaaatgagtagcccgtgagatggctcgttaattacggtcttgagcaaaagctcatcttactatgattacgagttagagccgattgaatccacgagcttttgagctctttgggctagtagagagaggaagccttactatatcaatctgaatgtcatttttcttttctcattctgcagctagcactgttattgaaatataccgtataatgttttaagattatgtaatcgaactttaaaatctattttccgttaaaaaaaattaaaaatcttactccctccgtttcataatataagagattttgattttttgcttacaacgtttgaccactcgtcttatttaaatttttttaaaattattaattattttatttgtgacttactttattatctacagtactttaagcacatcttttcgttttttatattttctaaaaaaatttaaataagataatcgcttatatcgtgggacagagggagtagatcactagtataagaaatcaaatatggtagcaatccatggctgcgaaagggaatctttcttagcgacatggacattattctttttttgctctatctgcacctggcagtgtttgctttttttgaaagaagagctagcagctttaaaatatctttcactaacaaacgtggtagtcttacgagaaggaaaaaaaataatgtactatatccgtcccaaaatatagtaacttttagctataactttaaacacagttatctagattcatagctaaaaataattatattttgagatagagggagtacttaataaaacttaaattgcaaatttataatcacctaaatttgcatattactaagacttaaattgatggactacgggtctgtttggaggagctttagattctgagaagcagctgtttggtagccagcttctgagaatctggaaaaactctgaaacccagcttctccagcttctggcttcttagttcatttttcagaatctataactacagattcttagaagctgtggattatttgggggccgcttctagcagaagcagttttttggaaaagctgcagctgggacaagctccgccaaacagggcctacgtaaaatatgtaattgtaagttcattttatctgcaattgttgttatgtatgattttgatacatttttatccaagattgaatattttaatatgtaattttatttgtaccaagttttaatgaatggtaagttatatttcatgtttaggttacaataatttcttcaaccttttatttaaaagaaaagggactttgcgtataaataattaatagaagagtggtgtaaagaatcatgggattgccattcaagaaattaaaaagtgattgaaattgcctaaaacaacagtcgaatataaacattcctaaaaaaaatacttcctcaactgtaaaatataaagcataacaaccactaatacaaataccaagaaaaaagttattatgacattattatttggatcacgccgataaatacaatacatccaataaaattagatatcttaatttagtcaagaagaaatgctcaggtgctagttaatcatactactcctacatgcacgccacgccttgttttagaaaacattgaaaacaatagcacgtacttcttttgcatatctattaaaaaaagcttctcattttcattttgcgtgtgcgagagaaagagagagctagacgtaattaagaaagttgacttatcttgataagaagtaattacaccggaagttaacacagccgagatcgccgacatgggcgtgtctgctctctgctggaggtacgcgtagtactattaggccctgtaatttcgagtttcatatcgaatcgaatgtttgacgggatatcgaaaaatgttttaggacacaaatgaaaaaactaattttataaatcaactggaaaccgcgagacaaattttttagtctaattaagccgtcattaacaattatggattattgtagcatttatggctaatcatgaactaattaggtcaaaagaatcgtctcgcgatttccatataaactgtacaattacttttatatttaatgttttatgtatgtgtcaaagatttgatgtgatgcttttagaaaaaaaatttagaaactaaacgagaccttactctactcctgtgactatacatgtctcatggctggctggctgcctagctggcgccgcgccttatgataaaacgtacaagacaccactatactctaaaaatagtcgaatccaaacaccaccttttgtacatgaagtcagaactctagagtctattgcatgaataagagctaattcgtgagacaactattttaagtctaattaatccataattagcatatgtttactgtagtatcacatagtataatcatagattaattaggctcaatagattcgtcccacgaattagtctagagttatggaatgtgttttgtcattagtttacgtttaatatttttaattagtgttaaatatccgatgtgaaatttagtccttctatccaaacatgccccaaataagtactttcatctctaaagtctcatccacctccgaggaccgcgcttagcgcgggtggcaggagccagtggctcgctccgtgccgatcagcattcgagtcttagactcaacgctcgtccctcgcccggggggatttttcccctctttacccgggactgacttcggttggtcccggctaggtaacagggtacacacacgcgtgcgcgtttagtgggactgcacgttttccgtgcactgaggcctagtgcctccaatctcattcctaacgtgtgtgtgcgtgtgttgtagtgtgagtgtagtaatttagtcgttttatctttctcttcttatcttccatgatcaaaaactctataattaagtagccatatttgggtcggctggagcactattatttactccctccattctaaattgatctacatatttcataggtacaccaagatcaagaaaaactaataactctctcatactatatttactctaacaacaaactctatgcatgcaccatccctactatttcttagccaatagcaaatcaagatattgcatgtgggttataaatacttatatgtatggatgcatgcatcaatgtctatttactccaatgcacaaataacgaatagacttaataaatgaacataaatatgcagatcatttaggaataacctcaaaaaactgtatgtatatcaatatgtgatggagagagtactagctagtccgtgcaatgattatcatgtatggatgacacaatatatttattacgttctaactttagagtttagactagcccacctaaacagtcgaatccaaacaccaactttcgacattttatcactacatactctaaaaatagctatacttggtatataatttaaatagtataagtaactatgttttactacctccgtcccaaaataagtgcagccatagatatccgtgtttagcgctttgaccatccgtcttatttgaaaaatattaaaaaaattagtcacacataaagtactattcatgttttatcatctaataacaataaaaatactaatcataatattttttgaaataagacgaacggtcaaacgttgaacatgaatagtgctaaaactgcacttattttgagacggagggagtaagacttaaagtggactagcttgtgatgtgtgcacacacatttatatcagaaaaattaatataaggaatctcgtggggcacgagggcacatgataaaacaagggcgaaggttacatatctcccatatccatttcccctaccaacttgctttctcccccaccgagcagcagcgcttcatcttcctcctccctccttccactactctgccccagtggccatcctcctcctccctctcctcaactccttgatgatcgtctccaacatcgacgacatcctctatcctcttttcacccttcctacaccaaatccagagcatgtgagagagtggaggttgacaagggcatgggggttatagccaaggagggagccaactatggctgtgaggttgggggttgtcatgtatgagtagaaggaaagggaggcggcgaggccgagggggacaaggttctgagcatcgacatggaggtggaggcagccggtctcaacgtaaatggcaaccttggagttgatgaagtggattagaggccgtcgggtttattcatgctccttgctaacccatcacttctactcgtcagtgttgtatacaggtacatcgcagccgataccttaggtatcagggggttgatacccagggtttgatacctcgggtatcatgcatggtacctaggtacaagggtttgataccttggggtatcatgccaggtaccttaggtatcagccagtacacatatgtactgtcggcccccggtttttagatacggaaagccacatgtgttcgcaataccaactccctggatcggtaggttggcatacacacaatataatactgtacaacatcgtttgcattgcatagttttatagttctcattgatacaaggaaagcccgaatgggttcccgaatagaccataactggtcgagtacaataccaacatcaaagcataaggtaggatagcagaagcgaggctatagcggaccggctatattcccgcaggcaacaactgggagttagtccctagggcgtctcttccttctctccctccttgggagcgtttttgaatggcacctccacatcaactgggtataagagagggtggtaaagcaagggtgagtactagcgtactcagcatgtcaccacttaaaataaatgcaaataatgaatacatggataccaggaaggggttcgagctatttgcgtaaagctatatttcacaaatcatttcacaaacctaggacctagcagttttaaccgaaaatgtcgttaagttgaagttgtgtttaatagtgggggttcatccacccaccccaagcctcgcttggtcaggtttaccctcaccaccagttcataccattactatactaacctcctcgcatgttgggcgagaggttacacaagtcttaacatctctagtctaagccgtactaaactttatgaggttcgatcaatcgttcgaaggtccgttcattcgagcgttcaaagatcgttcgttcaaaacgttcatgtgtttgattagccgaaacgtatgacggggttacgacgaccgagaggtggcgcaatctcttgcccaaccgaggcccaatcgatgccggccggggcggagcaagcgaagaggcggcagcctgtgcgcgggagggagtggcgaggatggatgggagtggaatgtcggggagaagggagaagagaggggcgggttgcgtgcttggctttggcggcgcttatataggtaccgggtgagctgatgcatgcattcatttcatccacgagcttccgcgcacgtaggtgaggtggttgactgtttggcggcgcggcggcacggcgtcaccgattggggctaccgtggcgatgcgggattggcttcgacaggtgttgggtgatggctgacacacggcgccgttaggcggaagctaacctcccgcactaactcgagtaatatcggcaaggtggcggtcgaagacaggattttcgggcgttcggccgccaatcgtgtttaccgcgtcgcggtgcgctggtgcgctggtggatccggcgcggcttttgctgccatttgctcggcggcgtgcggttggggagcgacaaaacggccagtgagggagggaaggaaggggcggcggccagcggcggcgcgcgaacggcctcacccgcgatttaagggaggacaaagccgattaagggtggagggggggaggggggagggcaaacatagacttccctcggctagccgattgagggaaaaaaggagaaatgggccaagggaggtaaatagaattttctttaaaaagtctcaaacagtagaggctaggttgagggagtggatttggacttcgtaggatagagttgctctgagaggtaaaatataaggataaaactcttttcgaggatagaaaggattgtagaaatttaaacaaaatttggcacttggcgagaaagggtaaaatccaaatccataagttcggcatgatgcaagtttttgcaaattttcctgaggcgaatttttggtcttcgaattttattttaacgaacttttcagggtgtgttacatgtaccaagtgaatagtatcatatattaggtatcgggtttggtacttacggtatcaggtaccatatcaaggaatgaggaaggagggtgcgctctcatcgtctggcttaccgacaagtcacatgtcattgtctcatcttcttttctcccttcctctcgacgcctccctccttcctctgttgttgctgtgaccggtgagggcaaggagttagtggtgccactgcttcatttctttgaaacgtgggagctcaaacataggggaagatggattagatttatataatatcccgttggaatggaatcccgtgctctagcaatcctcatactaatacacggaatcatgtggtgcatgaggtactagcaaaggcccagacccatctttgctacgggtagctatgggtaaaagaaaatacgataatatatttagataaaatatctttggtgtcaaatatacaagcaccgcttgtttgtgattttaatacatgtatccacttttttaaacaaatattcatactattgcataatatatgttaaaaaatattaaggactatcaccgccactactattttccatagcagtatagatattattacatgtatgtaactattctacgatcacattatgcactgtatattgatgatatactcctacataattaattaattatgaaattgttggtttctactttgcgatgcagtatgtgagctttgttggggcagatttcttcctcgactcgagggtgctggagcaaacgaaccccgatatcccgggaaaccctgaaatattcgggcccaattttatggcccagaaactttaccagctaagcccgccagaggtaatgccttaaatcgcaacatgaggcatcaatttctatttatttttttctagagcaagagggaattttaatttaatttttttatgatactctagatcagctcaaatagttcgtatgtttgctctcaaacagatgacgttatgtacggtcaaatctcacttgttaaatcaataataaaaaatatttatatttaataggtgaaaatggcattagtagatttgtcattaaaaaagcttcatatgattatatatgattatatttttaataatttgtatagatgtataatttgagaaaaaacataaatattagggaaggacctaatatcaaataaatagaaggggtaaggcttcaaatttagaatggctaactcatcaccctgtggagttaggtagaataccccgaacgtttctctttttgaaaaaaaagaacgtttttttcgaaaaaaagaaaatgatgacacttacattaaggaatatgtgaatgatcaaaatgatgttaattttcgattttcgtagaaaattcttttgaaaaagcacattttatggtaaagcttctgcattccaaataggactttagctagggatgacaaaaatcaatctctaatgcacctacgaattgacctgatatattcatatatataaatgttcatttatttttggatttatgattcatatataagtctttctttttttttccataggagttaaaccctggcgttgtcgctgatccggcccgcgaaccggttcaccggcgacgcgctcatgagggacgccggccttctgaccaaggagaggtacgggtcgacgaggcgcgtcttcgtcgtcgtggaggacgaccacgccatcc

SEQ ID NO: 78372 - DNA, 15087 bp, Oryza sativa
ccggaggccgcatcctccattgtccacgacacatcacagctcgccgccaacggccgtgtccttcgtcatccacgccccacactagagctcgtcgccgacggtcacatcctccaccgtccatgccacgtcggagcacgtcggcggcggacgcgtcctccatcatccacgccccacgccagagctcatcgtcagtagctgcgtcctccttcgtccactctctggcgatgagctccctggcgacacaacaataccaatctccatggcatacaagcagcaatacaaacaatgaattggaatcaccttctggttcttcaccttggctggaacttgctcctccactgccgcctcttccttaccctcttctccgactagctccccttcttcgggtcagcgcagcagcatccggcgatgtttcccgggcagtgcagcaaggcaggcacgagtcctttctccggagagccccttccccttctcctataatgtgctccttaacggagcggcgaggtgaggcgaggcagcgggggccttctccgacaagctcctctctctctctctcctccgctagcaagctccctccttccttcgctgccgcatgccgccattgcgctgctctgctgccgcgcttagtgctctaggatgaggagcaagacgataccgtcgcgtgggcgctggaaacaggattccgtcatttagcatttccgtaaagaaaaaggtgtctgtgagtatcatcaggagattttcttttttgaaaatgtacatcttttttttccaaatttgcatgacttgtcgggttcaaatcaaacatttaatttttttcttcatttaagtcttgaatgcatagagactacaaataaaacaacttatttgaaataactaaaatattaaataggtctagctcttatggatggagggaatacgtagagggtagagtacaattttctatttctaatacgaaggaagatacaattttctgcagtatatgcactcactgttagcaattaattagcaccgtaaggaaatcactgtggaatgttcagaacgctgccttgtccatttattaatcttccgtttagatcatcatttagtttactctcgaaagtctagttcgatcagtcacttgcatggacgttaccaaattttggctattttagttggtaatattttttcagagatatattatccataataaatctacaaatacttgagcctgttatgctatttataattgtatcggagcgaaataggcctacaatacaactattaacctataaaatttgataggatggaaattaatatgattactgaatgttactaattattcgaaaatgaagggaatatattattccacacttagccacaaagtgcctagaaacaattgggacagtaaatattttaaggcatgttcggtccaatacacgaattaattaataactaatataattcaataaatagcttgaagaaatgttatgtgagcagtgtttatatacaaaattatataagaaattgtatttataaaagcctgatatggataattcataccttatcttaaaaagaacacggtctcattagcgttagaatctcataaatacacgctatggtgctaactaccagtttgccagctgccaccaaggaaccaacccaccacctcatctatattaccgtagtactctctccatcccaaaataaaataatctaatactggatgtcatatatcttagtctagattcatactattaagacgtatcttatccaatactaagttggttttatgagacggagggagtatcttctaatgaaattgtgcaacacctccacccaataaatatgaggaaaaagtctacttttttacatttctagtttgattctcgttctttgaccacaaaaatcagggacagaattaaaactagatcagattacctctctaggcagacagttttgatgtttattttgttctatcttacatgttgacctgatctttattatacgtaacgtttaactgatattatagtgagaggataaaatgacacattatctctactattataaaaattaaatttgtttccgctaaaattttggtacttcatccgtatttgagttgttttttatttggttataaatcatctgtatctaattcgatgtgggtctaaataactaatatgcccctcctagcccgacccaagcggtccaaaccatcctgccacgccatccaatgcgtctccactcggcgtggcgcgtgcctctcccccgatcggtgttttttttcttttcccatttttcattttcattttctccttttcttttcttccgatcatcatgatcttctcacgatccttcccatctcttccgttttctcctccttttctcttttcttctctttaaaatttctctcctcataaatgttttccttttgaaattatcattatttaaggtgtgtatacggtaaatttgttactttacaaatgctttctatctacagtaaaaaaaattcaataattgaatattcaaaatttcaattttggtcgatgaagtatagcaaatacacatgtgttaacttatatagtagccacccaatcgatttgtgaggctatggaaaggtgtacataaaggattcttcgtatgataatgcaagcgaatgtaacatggttcaatgctatatatgattttgatttagttttaccattattttgtcttgtttcagtcatttaaattggcagagtttaatcaatcgcgaaaattattttcagctgttgcaacgcaaaggcatttttgctagtaggagtaaatataaaataaattcagtgggacccacatctacatgccatcctatgtcatccctactttctcttcctctcctctacactctcttcactcgttgcctccatgaccacctgcccatcacttcctcgagttctccttcacccttctcgtcttgcatcagaagagctgccactttcctcatggtagggcgtgacgatgccatcaacgtaggtgaagaagattatgcatggtcgtcgatctagaatccgcctctcgatgatggtcatagtggcaatggacccgcctctcctcaaccgcaggccacgctcaccagatgcaacgtcctcatcccgcatgcactgctggagggcaatatctagaggcgggcgtcaccaatctggagtacgagctcgacttggaggacgggttgggtgagttgcgtcacctcctctatctctctctctctagatttagatggacccgtctctcctcaaccgcaggccacgctcaccagatgcaacgtcctcatcccgcatgcaatgctggagggcaatatctagaggcaggcgtcaccaatctggagtacgagctcgacttggaggatgggttgggtgagttgcgtcacctcctctatctctctctctagatttaggaagccacgaccgctgatgcaaccaatgtggcatctgcctggagtagccacgggcttgtagtcgtcaccgcctcctcctcctcaagttcctttctttcctgggctcagtcctgccttctccacgcactgcccgaagcgagctttgcctcctccgccaatgccactgcctttgccctcgtcgatgcccagccagcttttgttaatgactagcaaggctctctacctagacaaattcacacttggcgcgacaatcaaggtggcatatgctcttgtcgatgacagcggtgcagcactcaggaggtgcctccgtagggtctcatcgtctagtgcgatatagtggatggcgtggtgggagagagactgaaaggagagaaaaggggaggagagagctgtcatgacatgttagtttcaccgtttttctttaaaaaaagtcgtgtgagacttacacgtggtttttgtctatttttaattgtttcttttgaattggaacgcatgttaagtgttacgtaggtactacgtcatgtaaaaaaccaggttaaagtgttacgtaggatgaaatcaccatcaaaatcgtataggaacgtaaattaaattgattttaacagttgagtgagtctctatacttgcttttcatatggataaaactcgttatgcactcaaggaaggtaaaaatggactttttcctaactatgaggattgcccaagcactcaagaccacggttggtggcacagtggagcttggcggcggcggcggcgaggtcgacggccgcagccatgtaaatagtgacgtacagtaaatgcttacggatatatggaggaactgaagttacaattttctgcagtgtgtcccacctgtttgtccgtttagcactatgacgaaaatcacgcggtacacatggaacgttcaacccgctgtcgacagcgataaaccttaactgagtttaccgcgtcttatcagcggtacacatggtaataatgctaagacgtcttatctgtttatcgctgtctcgatatagtttggtctgctccgtaatccttatcctccctccgtcataaaataagtgcagttttacactattcacgtttaacgtttgaccgttcgttttattaaaaaaatttatgattagtacttttgttgctattagatgataaaacatgaatagtattttctgtgtgactaattttttaatttttttataaattttttaaataagacggatggtcaaacgttggactcggatatctatcgttgcacttattttaagacggatgcagtatattttataaagttcgtactcaataagtgtagtcacttatgaagtcacgacatcttaattgtttttttttacttatgaagtcacatcatattaattgatttagcatttgaatgatttatcaaggacgtggattgcatttcttttcctccgaaaccacaccatacaacttaatcatttataacatttagataagtgatcaagatacaaaatatataagcacatgaaaaacatctatagtaaataagaaagaaaattttataatttatatatactattttgaaataattgtcaagattatggataccacatatctaacagtagttgacgaaatctcagtaggacccaccacataccatgtcttatacggaaactgacctcggatatggagggagttccggataaggaaagacaaccagagttctatatggaagcgacaaggctctactcggattgtatccatactggtttccctagttctacttggacaaggggacacctatgggtataaatacaagaccccctaggaggagaggggagacagaacaatagattaagacacaatatcaacatacaagccaatatacgccaagatatgccgccggatatcgacatcaaagatatgcctggactgaccctatcccggtacctacagaggccggctgtagggatctagcgttgtctctgatctcgccgagcacagattcgaggaggaagactaccctgttgtcgactacatgatgatacttcaatctgctatgtcgataacagatagataggctaccccaaatattgtaccagtgtgattatgatgaataagagcaacgaccggcttcggccaacaggagtagggttattacctgacaattcaggggcccgaacctatataaaaatcattgtccccatctctttacctcaatctcgcatatatcctagcaccaacgatccccatactatgcaaataccggaatcgcgacatcgaacatcaacaataatagcggctaccaaatttaattttacctattttaaatgtggcgatatatctttttggtttttgtaaaaacgtagaataacgcaattgccagaccggtcttgaccactgtttgataatttttcgtgcaggcctgcagggattatccataacaaaactacaaatattctacattattgaacgaaataaatctcactgtatagatataaacttacagaacagataatgtggagatagccattgctgccgattatttaaaaacgaagaaaacatatactactccctccgtttaattaaatgagtgttgacttttcgtataacgtttgaccatttattttattaaaaaaatataaatataatttcttttatatattgtggacttgttctatcatcaaataaaatataattttaacttacacttttacatttctatattaaatttttaaacaagataaacggttaaatgttgtgtgaaaagttattgaaaataaggtagtgtaatttaacacttaattagccacatttgttacacaaatgttatggtgctagccgccagtttgtcagcagcccaccaccataataccctattttattaactttctactgaaaatatgcaacacgcaaagaaatataaacgtgcattaaataattttctactgatgatgtgcaacacgcaaattaaagaaggaaatatatatataggagctacgcagatgcatatgcacaatcgatgatggcccaagcacccatgtccacgggcggcggcgccatggagctcggcggcggcggccatgagagcgtggaacgtcgtcgacggcaccagcaccacttcgtgctggtgcacgggctgtgccacggcgcgtggtgctggtacaaggccgccgcggcgctgcgccgcgcggggcaccgcgccacggcgctcgacatggccgccagcggcgcgcacccggcgcgcgtcgacgaggtgcgcacgttcgaggactactcccgcccgctgctcgacgcgctcgccgcgctgccgccggccggcggggacggcgacgacgaggagcgcgtcgtgctcgtcggccacagccagggcgggttcagcgtcgcgctcgcggcggagcggttcccagagagggtcgccgccgtcgtgttcctcaccgcggccatgccgcccgtcggccgccccatgtccgccaccaccgtggaggtaattaacctgtgtttagttcacactaaattaaaaatttggttgaaattggaatgatgtgatggaaaaattaaaagtttgtgtatataaaagtttttgatgtgatagaaaagttgaaagttttaagaataactttggaactaaacacggcgttagttgcgaaatcaacagaagttttttctgatcgatctactagtctttttttatttactccatgaatgcgcactaaacgatgttttaggattacgttaattaaatcaactttaaaatcttatgacctaaaaattccaccctatttttctaaaaggtagatgtataatatgtgagtttaattaggattgtgtcaatatctaagtgtcaatataaccctgaaatgctcaaattaaaatggcattttgtctgggagtccttaatgaattgtactgtggaccaacaagcattgtttgtccgtgatttattttctaaaaagaagaattatgaacacacccacacatggacaaaaatattttaagattgatagtcaatacaaatgcactgttgacatagactcatcaattagcactgaaaaaataattatacaaaaatatgagtactcatacttaatgagttgaagactagaatttgactgagtatattctaccattcgaaacttaacctatttaaggctgagttcgtttgttggagttgtgaactaataatcactcatacatatgaaaacgagaaagaagtgttggcaacctcaagcaacggactcagtgttagtagttacgcttcgtttttagaggtaaccacaactacctaccgagtatcgagataatgtttttgagaacgacatttaaatttggtcaatctttaatcatgttgtgaacttttttattacatttctgaacttagtggaaattaaatgatctttctcgccagataatatagccgacatgattttattttcatggaaatcataggaaataatcatattccctacaaacattttgtcgagataaaacctgccagacatctcgactccattattattatctccgagtcataatatttgataattttgagtagcggaccatatatattttttaaattatttacttatgataaataggctttatattaccacatatatgatttgcactacataaatataaataaatatgtaccgatttacactacatattttcttcacatttatgataactaggctttatattaggtttgtccatgtttccaagagaaaaaaatatttttatatttaatcatgagtaaatattttactgtgagtaaaaattttatttttgctaatgtggaaaaatctcagacgtttgttttcaaatttaacggtagttccaatgtttctaatatatatggtttgtattacatactttttctgtttattaggagaactcattttctttgcgtgcgaccgagagagagggggggagatatagacgtaactaaatgcgttgacttagtttaatattgacaactactgctaatgcgagaccgacacatgagtctactactcccatcgtcccaaattataatatttttttacatggtcttgaatgatatatttttgactattaatttatttaatattatgttatcaaacaactacaaaattaatatcacataaagtattttaaaatacaaatctagtgatataacatgtataatacttaaagtgtgttcggaagctagtgttcccaaccgaaagagtgcgcacgaaaaacggagcggtccattagcacgtaattaattaagtactcttagctaattaatattttttaccaaatttagactctagaacaagctatattttgtttattaataggacacatcatacattttccttccctactaagggctactttgggaaaaaagttccgaaggatgtattcggaaagaattactatatggacattttgaacaaaggaatggcttttctgaattcctttaaagtttgttaggattgcctacaattatgagaattttggaggatttttaacataaggtttaacgtcttgaaaatattcatttatgcctcctctcttctgatcaattcctattctttttctgtgatccatacaaacgatatggttttcttatatttttctatcataagacttgtagtgacaaggcactcgaattctaagtttttcaaaaattatgtattccaaagaagttgtcccaaaatatgagggatttttttttatttttagataaagagagtgtttaggacattttagtcatttttcctactacctctaaccccataatatagctatctcttctattgaagtttgaatggtagaggtagttatattatgagatgaaggtaatcggtaattctaaaactggtgggtaacccgccatgcaattggtccaggtggtcgtataggtccgcgacgcgtggagaaacgagaggaacgggcggacggcacaccacgatagattttcttttctttttttgttactcgtgccttcccgatttctcgcgtacgcgcgtccgatttgggcctgctcccagcaaggttgggctgattggcggcccatgcgcgaggaaggacgcgtgacgagcggacgaatgtcgtcgggtgcgtgtgctgggtctttgcctcttgggtgggggggtactggccgggcaactcctgcgctagcttcatgtaggaggaggaaaataatagaaaaaaaaagaccaatgttagccatcaaggaaattctacaggcaaaattaatgcaaattaaatattagatagaaaaaattaaggtaagaataatttgaaagaaaagaaaatgttacatgcaattctaaaaacaaaatctggtctaatttaacctagcaatttttacatcatggagtctaggacatttttgtagttatcagacagatcccatggttggagtcaaataagtaggtatgccctggttgggttctgaaggtaattttgcactgacaaaagtggttgaattacttcacttgctccattttgttttcttcagatataaatttttaagccactatacaataatatctattttaggtgttcagcatatcttcaaaaactttattaagactgtaagtgatgagggaaggattgaaatcactaattaagggatcatttcgaatgtgtgatttttttggatagaaatttcattggcataaaactaattctgaataaacatgaaagatttattaggatatagagaaactcacgttggtgatgggccataaatcagtcaccagctcagcgcgcgccaattggcatgctgattttctagtatatactaaagttttctcgagatacaatggatgcttttatttttggaaagagggggtattcgtgtgcacacttttctacagtcacattttattaggtaaagtatgccgatctcacacacacacacacagatatatatatatatatatatatatattgtattaattaattaactaatcaatcaattcattagcaaatagtttctactaattgtacgcagcacgtgaactatgttggggtggagttcttccttgactcgatggagctggagcagcagaacgctgacatcccggggaaccctgtaatcttcgggcccaattttatggcccaaatactttaccatctaagcccacaagaggtaataccttaaccaatcgcatcaagagggaatcttataggatttaaaatgttcaaattgctaatctagatcgttaagaccgcctagagaacggcaagtatttcttttagttgaatgtatttgacgttggaagaaataggtttagttgtctgaacgtcaaatataaattaaatgtctagatggagtaatttcgtgataaaatagcttgttcggaatgtgggaatttttcatggccggccactttggaattaacgaagaattaattccaagtttccaacaagaagttagggcgttttttttctcaagatggaaaacttaatgttgggatgttacattattacttgttgggatcgtatgggagtcacacaaataggatttgtactagcaaatgtggtggaaaatgtagaaactcaagacacacctaggagagagaaccacgagatatacgatcatgttaacttatcgtcaaaatccatatggaatagcacatttcatacagatccaagagtaatctgccttcgacgctcaattctccaaaattattgtagtaattttgttttgttataaggatagggacctcgtttagaaaacttagttattttcacatgaaatttatgcattccaatagaatgggaccttcagaatccttttagatcctttctagggggtggagattctaagaagcagaaggtgggaatctgaaaaagctttgatttttcagcttctcgttgctagttcattttctatagggagaatagctaatatggtccctaaagtttcgctcctgggtcactttagtccttaatctttcatattatccaaacaagtcctttaaatttgtcacgtgggttgatataatccttggccccatcaaaatcgccacatcgacatgccatgtcaccctcctatacaaaatctatatgatttatctaatttaccctacatatataataagaaaataaaatacaaaaggaaaaagtaaaaaatatatatatagtatatgtaagagcaaaaatatatgtcaaaagggtgaaaaaaagggaaagtttttttttctatggttatatctaattcaccgttatatttatttttctatgatacgtaagggtaaattggacaattcatcataacttttgcataaatgattacatggcatatccatatgacaatgttggtagacccaaagattattctagttcttatgacaaagtttaaggatttcttttggaccatttaaaatgttatgaactaaattgatattatagagaaactttagagactacagtagctattctcccttttctatactatatatagtagctactgattctgaattgtatgaaaccgctaaagattcttaagaaaaactacagctacatgtccaaaagctaacctaaacaggaccttatttaactaataatttcaatacatgatggtgacatgattatatcgtgtttttgccatataggatttgaccttaggactatcgctgatccggccgacgaacaagttcaccggcgacgcgctcatgagggaccctgggctcctgacgaaggagaggtacgggtcgacgaggcgcgtcttcgtcgtcgtggaggacgaccgcgggatccccgtggagttccagcgccgcatgatcgcggagaaccccggcgtcgaggtggtggacttcgccggcgccgaccacatggccatgatctccagcccggccaagctcgccgagttgcttgttaggatcgccgacaaagcacacgaaccatgagtccatgactcggactaggagtggggacagccaaatcactgatcaatagggcagaaatattatgtcacccaatgaggcaaagagaatgagggaaggaaaaaagaattaatgattgttacactgtttgtttgaactttgaagtagtatgtaatagtatattatttatttgggcaccatttgatgatgatgatgataataataataataataataataataataataataataataataataataataatagtaataataataataataataataataatggtgtttgtttagaggttattgtccgaactgggctgaaaaaagatgtgccaagcatcgcagatatacaggagaaaaggggaccatatagtaaaaaaacacgtaccaacacataaagtgggtgaaactgcccaaaagagaacatgtgttctagaaaataaggagatttaaatatttctcatttatacctttggtaattatttaagagtaaagtgcataggcggcagaggcgaatccctcataattcgggcccctttgaatcgcaggaatggaaaaacgcaggaataagaaaaacacaggattctgataggaatgcagatgtaaaatagaggattggaaaatacaggaaaaacataagaatgaccgtttgattggaccacaggaaaaacgcatgaatcggatgagagagatagattcaaaggaatttttccaagaggtaggacctcttgctaactttcctagcaaatctctataggattacatgttctataggaattttaaaggatagtataggattcaatcatttgtttcaaaggctttcatagaaatttttttcataagattgaaatccttcaaatttcctacatgtttcctacaaatcgaaggggcccgaattcatgggtattcacctaaataccaataaatattttggtgaaacatattatggattacaatgatttgtatgtcctagtggttgttcaagttatataggtctgggttcaactcctaacatccccatcatttttatcctcttttatcttcaatagtttagtttttaaaagatagttcttgaccaaacacatctccaattttcagtatttatttttccttcttttagtttttccatcttttatattcaatagcttagtaataatgtcttctaatagactttacttaggttttgtatgtgttgacagaaaacacgtagcctgggagatctgcttaactccagtgcaggtccaaagctcgccttcggatgtattagcgtgccagttgatttgatcctgtaatcaacaagaaatagaagcaaagaaaccgtagttaaatctaaaaatgatagccgatcggctagatgccgatgacatatcatttatctttgggccgatgtcatccatgtatcgatcggcagtcatgaataagtaaagaagaactaaatctacttgattggctgtagatattaacaatatataatccttatatcgatatatacttaaatcaagtgattgggatagatcggtcgccatgccgagacagtataaatcacctagatcgaaatatatattaataataagactatatacgttcatagcatagccgatcagatagatctagcatgtatcggctaatactccgataccactctatgttaagatgttaaaacaagtagaatatactaaacaaaagcctaatatacttaaatgcagcaagatcttaacacaaagggcagatttaacatatcagcgaaacaaatagagtaagtatagttaaatcagatacgatcggctgaaactccgatactattctaatcaacaactagatggcaggctagagatcaatattctaagcatgacttaatagatcaaacttaattgatgcagcattaagtatgaaaagaagaacaatatctagacaatcaagccgctagaagattcatagaatggtagatatcttatataatctagatcaatgtcgagatctaacctaatcggctgtcttttgcatacaaatattagccgatagtagattagataacgatattgctgaagattatataaggtatatggtaacttgacgaattatataaataagattagagcgtcatgaagatgtaagcactaatcctaagaacacgatccgtcataacgaattttacctcttgttgaagatcgaaaccgatgcagctcaacccgaaagtaagaactcgtcgaaataaaacaaaagcaaaaggtggcgatgcgccggaattgtattgaatgtgtgtgttttttttacatagggctcggggtttatttatacccgaggattacaagatacgcccataccggacacgaccattatctctaacaaactctaaaatatgacaagtctttgcggcaaacttttgcccacacttatctataaggaatttacataaatcatcattattaatagatacaattgccttcccaggactctatccatgcgtggcaatcatcttgaagcacatcaatctgagcctgacgtcgcgcacaagttgtattgtatatatcagcttatttagcttaactcaaccttagccgatcctagccgtagccgatcctaatcgtagccgatccagactccagccgattcttgctctgttccagaactcgatctccgcctccaactcttctttgaccaaatcccctttcctgatacgaatacttaccaaattcggttgttaatagtatggcatttaattttctttctcttttaactctttcacgtttaattttcaatagcttgtagtgtgatagtaatagattttagtatggcacgcaatatattccatttaaa

SEQ ID NO: 78373 - DNA, 9438 bp, Oryza sativa
aagtaattgcacaatcttagacactgttcaaaattttcaggggccacttaaccagtgaaaagtgaaatccaaaatggaatgagaatgatccacatcatctgaaaaatattatctgttggatttaatacaagacaaaagagagtgaatggtaaaaagacaaaagagagtgaatggtaaaaaaacacattcaagaggcttccggtgacgaagctttcctataagtggaaagaaagaacggaagaaaaaaccaaccctcatcctttaactaaatattcattaatcatgattgagctatttagtgcatattcaaaatgtatatttatgtaattaattttgtttctaagaattagttgttaatgtgtttaagaaaaatttgctagagacacacacattccttccaataaagaggtcatagtcgtctgaatatagatctaatgattttcacacaaatttaaaaaaaattaaactaattccttaaaaaccaacaaaatataatccacaaagggaacgcaccaatagaaaataagtggaggataaaggtaatacaatagcaaagacatataaagacgataactcatactattaaagtttgcaaaaaatattaagacatttaatgtattaaggtaatactatgattcatcctgacccaacttttactagcaacaagaaacccaagagaaatatattagcactctcacatatcacataacagggtgtgtagagtcgcgcaaatgcgcgacatcataggctagttgaagtgaagaattaattctgtgaacttaatattaagacgtgatcaatcatatgggagatagatcaagggggatttgttacaaatgttgtttggtaactgtcaaaatcctcaaaattttggaaccctttgatttgtaggaaaacatatgaaatttataggatttaaatcttacatgaaaattttctatttagtcctttgaagaaaggattgggaccctaacaatcctataaaattcctctgaaatagctcaagacaagaagatttttgaagaaaaattaacgtgaggtccaaccttatgaaaacttttattttagttatttttcttttctctaatttatatttttcttgttgtctattcgaacggtaatttcaattatttgtttaacacttgtattcatgttaaattcctatataattttctattcgtgtgtttctcgatcctactgctaaattgacctgatatattccaaccacctttcatttttgaatttatgatttatttttttgctctctgcacgtagtacggtagtaggacttgaccctggcgctgtcgctgatccggccggcgaaccggttcaccggcgacgagcttcatgaggggcgccgccctcctgaccatggaactctgtagtacatctatttggacattatcaggaaaataaatgaggggcctgtttagtggttatcatcagaaagggttgaaaagctgtgcatatatctgtagttcatgctacttaaatgtaatgtgcatatcatcagaaaggatgtaaatgtaaatgtaatgtgcagtaagacatgaatgctaaggaattagtactatcatagagccagaacttcaatgcacatatgaacataaactgaagcaaataaatgagatgattaacatactcaagctaaagactcgtcctctcagctgctatgaggtgaaatttgccaacttgaagaaataacagaaagagaaccagcaacagatctaattctagcaagcacaaaatcgtttactacttggccgattagtgtgtactattaacaattatagactggatgcctaccaaaataatctcagttgcacagcatattcattgcaaatggatacataaaactttactcagctcagaacctcagaatgtgaagttcaagaagtcctgtcctgctcatcatatagtatagtgaagctgccaaaaaatttgttcaggctccaaggcaatcagcacaaatcacaaaacaacagatcactcaacaggatgggccacagattggtcagggttaatgcctgcacttagaattgccgagcacagattaacacaaatttcttcctgcagcccaaatgtcagtcatcatccttaacacaactagcctaaattcaggggcacatatctgatggaattatacagaatgcaatatgtatgagatgacatgcccagtaagcctcccgatgacaggtgatgaccacgaacaaatttcccgcacgcaccatacatgcaaatccagtcacataatgcgttcagcagttacatgaaaggttcaaaaccacctgaagacatacataaccatgcaactgatagactacaaaaaagagaatagataagagttcaggtttctccaatttcttatgcattgcagccatcgcctgggcagctcgatagcatagcatgaggcagtcgagcttacaacatgctatcagttcttgcagggagcctcctgaagaagttcagaggaacagagggcatcttgtggcggaaccttgggtgtctcaaggtgtacaggcctgcaaggaagaccacaacacggaatggagtcacgtagaggacaatggcagcaacaaagcagaaggtcacaaagagcgccgtggctcttgggtctctccagcttagcagggactgcagcctttctccttgtgtcgcgagatcgccgactacggtctgtatcctcccagcaacactccgtagccggtcataacgcatcctcacaatgtcaggcggacgagaagtagggaatgtgtcaaactcttcatcaagctcatcaggatgagcactctccgcatgtgagaggcgagtgtccatgtgaggtggctgccttggccgccagcggtagtaccacactccaatcaggaacaggtagaggaagattgttggcagtatcagctcaggatacaagactaaaatcacaaagagaatgtggatcagtatggtggtcagcggatttctccaatggcagatctgatcaaaccacttggccaccgcaatcagagggcttaggacacccatgatacggaaaaagtttgccttgctcttccgcatgctccacatatgagagtcaacatccagcatgtactccacaatttccttccgcagtggtggttctgcacggctcagccttgttgatacaatgttggtggcttggcgccttagattgtctacctgcatcacggacaatgggtgtacatagtgcatcttgggcagcaatggttgtgaatacagatgcatcatgttcagcagtgatgagcatgtgaacctgacagcaagctgcacctcccccattttcttaacaccagcaggtgtcagaacaatcagagggtaagcatgagtatatactcgatcagtttctagcgtagagaggcggatgcggaccttcccaattctggtatcccgggcaccgttggctttttccccaccattcaagtggcaattgtcaaatacaccaatagtgatcacagtgcagggatcatacacctcccaagtgtattgttcattccacttgggtgtgaaactatcaataatagtccttgtccgcacccacttctgcccatacttagcaacacaataagcatcagttgttccacgcccatccttggtcttcatcggcaacaggccctgtgctgtcaagatacccaactcaagaatgccaatgctgtgcttccataactgtttagcagttggcctcaaatcactgctgtaatgtgttgactcatccaagacatgatatccaccttcgaggcatattctcaagtgaatccggcttgaaaatttggtctctttcttctgctcgccatccacaattacatgcttctcaagattgtaccactggctgttcagcaacttgtgatccagcctccgaggtacgtgctgcagagaaatgattgtccttccaagtacatcatccttccctggggcaatcctatcttctacactcagaatcaggtgttcctcgaatggttcagcagcaacaaacattaaatcctcattccacattggattcagcgtccggcttggtgatacccgggttctaagagcttggttacctagcatggctttgacataaacatcagggaacctggtcctgtcatttggtataagatcttgtgcctcaatgacattgactctcagataccaaagctttggagtaaggtaaacttttgatctaatacttgcaagtccatctcctgggatcgacgctgcatcagagtgccaagcttcagggaatgcttcatctgcttgagtacccatccaaacggccaacatcaactctcccttcaccttgtgtccattccgctcttccaaccgataccactgtggagccaatgggctgtcaggtggcactcgttttgggacctcattcaggtcaaacaacacccgcccgatgaagtcatccttgacaaagtccttatccttgacaatgatctcaaccactgatgactgaatgcgctccttagaaaaggcaaagacctggttccactcaggattagtcttcttctcgaaatgccgagttgtacccttataattcccaagcttcacctcaacatatgggtcacagcttccagtgatgtccttgcttggaaggtccttagcttttactacccggacataaagatactgcatctgctcaaccaagtcataggtggtggtgagcttgtcaccagcagctccaccaccaaggtgaggagaagtctccttcaaggagtactcctccggacggaacggcctctgcatcatcttgaacgaaattcttgaaccaaccaactcctacgctcctactcagcaatgaaagaaaaagatccaaccagcagcaactggtgtgctagaataactgcaacatcataaataagaacaagttttaaaatggctggttgtcggaaacaaaaatgatgaacgatatcaaaatgaacaggaagaacctggcaccttcgaattaacaagtcatcaggtaataaggtttctctcaacagagcacctcacaagcattttcttcatctcgaaccatcccagtatctccacatcatcaatcatgggaacaccacacctggagcaatcatggacaaaccaggtaaatctcgcgcatttactagctcaaagtaacaaaggacggttgccgttccccactgagggaagtaaatcactaaaccaagaggtgaaaaatgagttcttgcactgcaaagtaggcgactttaaagaataataataatctcgaaaggacagagaagcattaacatttccagcgcaggcggcaagaacaagcatgttctccctattgaccatgctccaatatagtaatagaaaactcaagacaacatatataccccccatctacatctggagagggagaccaaaccaaatgcaaaaacattcgtccagggattcacctgccatcaacgcccgaacgtcgtccccgtcgacatccagcccattccgaccggtgtcacgccggagatctagcaaccgccgccgccgccgccgccgccgagcaagaaacgctgctcaagcctgccattgccggtgcacaagaggtgagcaaccacaaacaactcgaaaaaacacacaagagagagcagaaaaaagatcagatctgaacccggcaagaaaaccaggaatcgagcaaaaaaatccccccaccccaaccattcgcaagaaaccagcagctacatatgcgcgcacacagcaagctcgtcgctttacccccttttcgcaagcacactttcactttcgcaaaagcaaaagaaaaacatccacgcacgcacggactcacaccccaccaaagataaaagcacgaaccgaaccaagacctctcaagaaccctcaagaaaccgtcacgcaaccgccgccgcgcttcccgttcccgaatctctaccgggcaagaccgaaaccacagatcggggaaaaccaaagaggcggaaatggcaccggcattacacggaaagcggccaagaaaaaagcagggatggatggaaagaacgggaacaaagatataccaaaagattcgagcgggctcaccacgcgatctctcccgagggttcgaggaggaggaacaaaaaccggaagcttcggcggcgagtggggaggggaggggaggggacgaagaggggaggcgagatttttcgattttccgcagggtttttctcgcgagcaaaaacaaacgctgtggagagagagagagagtggagcggggagaggcgaagcggcgctcgaagcgtgcgtcgtggtggaggtggtggtggggtggccggtggccttcttttttcgaaatgcgaagggggtggcggttttgcgtgttgcaccctgggttttggggatttggcagtttagggcaggtggtaaggggtggatggggtttttttgcgttttggaccctactatggggttttggggatttgagggtggtggagagtggagacaggagtgttgatggaacattgtgggggttggagttcgtgccaactctatctgcattgtcttcttccttcctctcccagctgccggtcaagtcttctttataaatggaaaatactactgctcccgagtcgcaaactactcttccccatccattttgatcgtctcataagatttgtaggtcttctcaaaataattattatctataagaatttcgtttgtttgtgtaaacagtaatatgatgattgaatgtgttgcatgtaattaatttttattggtgtataatttctattggtgtaatgataaacaatatttaaaacatgagcaattcaccggacacaaagcgatagaacacgttaactgatgagaattaatttgagaatgatgaatggttcggtgtccttggatttatgctttttcttaggagatgatcaaaatgggatggagatagtaccaaattaatagtaatcccttcgtctaggattatagagttatagtaccactacattcaaaaattatgagacacaacatggtactactacaaatcttggcatgtttattttttcagatttgtagtaatatgatttctcgtataagattaaattattatgagacagaatgagtagtactttcatatatttaaaaatgtatttttctcaaaataaattattctaccatactgtttaaattgatgtaaaatttatttctcaaatattttatttatctttataattaagtagttaacccatagcaataatctattaacaatctaatatgctcaaattcctaatgggtccttggtatttataaataaaagttctagtacatttagagaaaaaaatagtactacaagttgaggttagattttattttccttcttccttcattaatgatagttagtacgatagcagtactatatgttgaccagggtttcttggtactctgttgtgatcatgggcctgagtaaaaatagtataaaatatatttacgtgcggcttatttagtctggtgtttgaatctcctaaaaattaagtattaagtgtttcacgtaaaacgatgtaacaataacgtgtgattaattgagttttaattattataaatttgaaaaatagattaatcttatttttttagaacaactttcatatagaaagtttttagacgaaacgcaccgtttagcaacttgaaaaacgtgcaacttttatcccaaagtttatctaatttttgttggagaaaagaacaaggccatagtttggtgtattttggttttgattttatacacgacgttgtaaggtaatttttttccattgaaatggtaaggcatggattattaaagacatcgtgcacaattactaaaattgatttataataaacagtgatcaataaagttggaatgtatttctaacaaatgtttgccaagtttgtaaatataattctgaaaacgtaatcgtttgcatgtttggaaaatcaatatttttatgtgtgaaataatttataattagccaaaaaatgataatcgtagagtaatgtaaggtaaatcagtgacagagcggtacatctacatgactgcattgttcttacagttcccgtgcttgcaaccaccattgacaagtgaacttgggttgtatttagttccttccaaagttggaagagttggaagtttgagttaaaattagtacgatgtgactgaaaagttgtgcgtgtatgacaggttgatgtgatggaaaaagttggaagtttggatccaaacacagccttagagttggggttggtgtacaatagtacattcaaacaggttggtggtgcgccccttgtatgaaaaccggaggtggtacaaattattccctccgttttaggttataagatgttttgactttggttaaagtcaaactgttctaagtttaattgagtttatcgacaaatatattaatatttataatactaaattagtttgatcaaattaataattgaatatattttcataataaatttgtcttgggttaaaaatgttactacttttctctacaaacttgatcaaaattaaatcagtttgactttgaccaaagtctaaacgtcttataacctgaaacggagggagtatattaggccatcaccaatgcgtagccccaggtcgtccccttggccccctctgcccgtcgccgtttgcttttatcgtcggtgctgttcccccacaatggaacgtgtccctcgctcacttttggcaggggaacgcaaccgaggggacgcgttgggcgcgagcgtcacctatggacaccgtttccaccgaaaaatttccccttccacccctcatggccaccggcgacgggagagagaggccagcggcagcgacgaggtacagaggtgcgagtcggcggtgagagggggcgagagggagacctgcgcgacctcctccgtcggcgtcatgacctcctcctcgatgcggtgctgctggcaccgctccaccccgatctggccgcgagggggccagatccgcgcacgatggcatcggatatgccgcctctggtcgtcggcggcgccggaaccgaggtcgactacggcggtggggtgaggtcggggcgaggccggcatgagacggcgacgagtgagggtttgctcgcatatgtctggcgacggtgtcggcctgggttgtgagcccgacccggtgaccaccgcgcgatggacatgaccccgccggcgccgcttgccatcggccaccacgagggagagagaggctgcaacgagagagggagaaagaggcggcgaagagagagaggatccggcgccggcgaggtggaaggggaggacggaggaaaaggatcggcaggggagagcggagtaaacggagcggctggggagagggcggaggaaaaatcggcgaaggggagaagggcagagaaagagacgcaaagcggagaaggggcagaggaagagacgcgtgagataggagtggctgtagggaggggtattttcgaattttttcagtgccgagacacccattgtaggcttgagtatcttcatatagtc

SEQ ID NO: 78374 - DNA, 25431 bp, Oryza sativa
gggtgtgcactttgggcggcccaccgagcgtgagtagggacgacacgctgtccgcggtcgcagacagggtgggaccacggcgccacgctttgcatattcctccgcctcggtggtggtggtgggtagtagtatgggattattcgcgtgcgctttccttttttttttttacttgggcgggcgggcggggctgctacagggaatcgcttccacttctccttttctcgatcggcgtgcgggcagagacagacagcggacgggtgaagaggaccccacgtggagggcgatccagctgctgtgggttggactccggtcggtcgggggtagtctcctcgacctcgatcggtgcgtggaccggggtcgacgagacgacgacccagcgacacacatcccatccacgcacgcatcccgccggtggacgtcgccgccgcagcttccgccgagccgggccgtctcggggcgggcgccaccggcgtcggcgtacggggctgtttggttcttaacattgccataactcactttaggcaatgttaggcaagtgtggcttgccatacttttttggcctacaaattataagccacacttgtgacaaagttagacaaagaattgagtctataatatgtggggtaagatggtaagaaagtgtggcttgccataactatagcaatgaaccaaacacaaaactaagaaggtgtggcagcctaaaatgtgatgtggcaagttgaaacattgaaccaaacagcccctacgtgctgcgtgctgtgcgggaacgacctagcacgctcgttcaagggacaagggacacgccacagagacatccgaggtggttattcttcgagctcatcggttggcccaataagcctaataggttaaaagcaaaagctataatttgaattcttaaaattgaatttggaaatggttttaacatattttcaatgtaattttattttaacattggtttttaagtcgctatgaacgagtttataaaaaaatttcctatatattaacttttatttcttaaaaagccgttttgtcttattagggaatataggtaaccaatgaggctcttattaaggattcgttgctatgtttttttgacggttttacatcgtgttaatgtaatttttttgagaaaaatctacaccacggcatcccgtattgttaagagaacaaaagatagataataaagtggatcaccaaactcttcgtcgctttgtctttctcatgccataagatcgtttcgtcttcttcaagccacgcaaaggatgtagttcatccggttttcccccactacttcaaacaccacccttctcctcctcctcccaccttacccatcatcacgcgacgacccaatctctatcttcctcccccttcctcaactcctcaagcgtcgtcttcctccttcctccctctttatccatccctacaccacatctagaggccggcgagtttattgggagctgttggaatcacagtagtcggtgaggagggaggcgacgatgaggtcggtaaagaggaaggaaaagaagggtgcaagtccgagtacaacgaggttcgcggcacctgcgaggatgtgtcggtcttggcattgagagcaatttaggagttggcaaagcagacgaggggtgattgcaaagtgcttcatggggctttgaggttgttacgcaggcatcgcttgaagccatcgtgcttctcgctaagtcgctagctcgttgatgtagcttgcagatatgcaatgggcgcttcatcctcaactgatacacataggcttggtacaagatgctaggtaccaaggcatagggaagaggcaagcgcaaccattgtctggttctcgacgagccaccaaccgttagcaactcctctccacttctccctttgtctcctctacacgctccctaactccacccctactattgaggtaccaagcactagtactccaaacttaggtactaggtatcaaagcagagggaaggggagagcgtcgtcgccacctggtcaggcaatgagtcacctgccgttgtctcctcctatcctcttcttccttcctcttctctacgcgctccctcttcccctaccattattgtggccgatggggcaaaacacgatgagtgttgctgcttcgcttgcacacaagcaggaaagtagggggctgcactgctttgcttgttttgcgtgtagaaactctaagtacgtttggtgcgacatgtgggattagatttattaagttgtcccgtttcaactgcatcatgtgctctagcatctctcaaaatttttctatatacaaattactttaaaatattaaataaatattaaataaatatttttaaatttataataattaaaacttaattaattatgtgctaataatttacttgttttttatgacttaacctaatcttcatctttattagatgaagagcaccacctagcttctctggattctggaaagtatgcacccgtggccagggcgccgagctggtagcccagaaccagaaatgtgattccaatgcctttttttttcttaaaaaaaacgatggttttcttttggaaatcaatttgtgccataccaattgtttggctgcttcgacagtaattttcagtgattttttttatttgtattgaagtcaaacctttggcaattttatccatctaccgatccaaatctttgttggcggtcaaaatttggctatgtaacaaatgagagaggcaaaattttgttgtataacattacggttttagctatgaacactgccgaaatcaatcatttaaaataaaaataacattgtcaaaatctgtatatttgctattagaaatacccatactgttatactcactctgtcttaaaataagttaatttttacaacatcccatacataccaataaaataagaacaagtaccctcactttatcaaacctaatgcaattatttagcacttcatctactcctaatacatttatcatacttttataaactctgatgtagtgattaaaaaataaacttattttaggacaaacaaaaggggctaaaaataatctcattttaaggcggaaggaatactatggctcgatgaagaaatatacaacgagtgaaaggtcagaaatgttccctcgcccatttctttatttcatacctaacaaatgaaaccaagtttgcttttaaaattttatatggttgtctaaccgatcttccctttgtgcaagattttttaaagacgaattgtgcttaagaaaacattcatcaaacacaattcattgaaaagtaccttaatctttgattcccaactctcccgttaccggcgcggagctacagtgatcagggagggttcacaagcacccatgtccaaaaatcattttaccttataggtaccattcaccccccccccctcaactcaaccaagtgtacccccaacaggccaccatacagagcaagaaggtaaaagatgcgttcatgcttgcagcttataagtattctcgggtagtcagctgacgagttgcttcctttccaaattgttttttaggatcatcctgatttactgtaagcaaaccgaacaatgttgcttgatagggagtcgattggatgattattggttgttttttttctctaaatttagggttgagttccaatttgttatcatttgcctcttttgtgttttagacaatgagtgtggattgaggtagttctctaatttgggtatgttttttgttgtgattttagtcttacttttttttactacagttcactaatttttatattaacattggggttctctattttggtaaacacattatcgctacattttcttttacctatttttgtgtattgaatgtttactatgatgttacttaatgtaaacacgtataaggttacacttgtggtatagtagtgcacctcctatattttgctctagctccaccactgcccgttacgacaggcgttaagctgttggttaggtacaaggcaccacagcgatgcaatactgatcaagaattcaagatgagcctagtgtgctgtgtgcagagtatttgtttgcagctatattgaggtgtcaatcaatcttctaaaaagcttagccgcaaaagttatttgagtggttgtttatccaccttctagcacttttacgatctaattagcagtcaatgggtaactgaatttggaccttggtgaatcattctcgaccatcccaaactaaaaatggaatgaaatgttacaatgttggatcttatctagtactatttcactaggattaacggataagccgagaacatatcttcccacaaagttacgcaaggttagaaactgtgaactgatctggaaaagtttccagcccactgaagtttatcaaatcttagtaaatataaaaaaaaatggcaaatcaagcttggaatctgcttccttctcgaagcaaaagcattggctctgctccaacgagcccggattacgtggccggccgattgatgcagttgccactaacgcgaggaatttttcgcttcatcactaaacaattactagataataatacactactcaacatattctaattaccgctatatatatacgcgatcatggcgcgttcaaggtcgagcagcttcgatatcgacggaagccaaagccggccaccggccatggcgatggcgtgcaggacgctggagctgacgctgctgtccgcgagcgacctgaggggcgtcaacctcgtctccaagatggaggtctacgcggtggtctacctcgccggcgacccgcgcgcgcgccagcgcgtcgccacggaccgcgccggcggccgcaacccgtcgtggaaggggaaggacgccaccgtccgcctcgccgtcccggcgtcgggcgccgggagcggcgcggtccgcgtgctcctccgccggagcgcgccgggctcggcggcgaccgcgacgtcggggaggtgttcgtcccgctcccggacgtcctcgccggctccggggacgggcccaccgccgccgcggtggcgtcctacccggtccgcaaggtcggctcgagcaggaccacccacggcgtgctcaacctctcctacaagctcggcggcgtcgtccaccttgaccccgccgcggccgccgccgccgcttgcagttgcaagcccgccgcgccggcagcaggtggctcgacgatggcgtacctggcggcggcagcggcggcgtacagggtgcgccgccgccgcagccgccgctgtacggctaccgccagctgccgccgataccgcagccggtgccgcctatgggcgcggtggagggcggcggcgtgcgcgccggccggtgaagcagccacgggcaaaaatggagtcttgcagaatatgaatgctaaactatattctgtcttaaataaatatataaatatgtgaacatatatgcgaatgaatctgatcatctgaaggcgagcaaaaaaagtaaaattatgaaattgaagcttgcaaatcgcaatggtgtttagctgtttatgaaccgtggaaatgcaagctatatactcaagtcttattgaaacctacattttattttcatgttcaaattgatttttgcttggctttttttttttgaaaacttggtgaaatgaaagcctcaaacatgtggacaccttcaacattaaagcgtagcgtagacttgatattttgatggctgaaggacggtctaatacagtgagacggaaagctgcctgttaaatggaagtttgttatgacattaatatagaacatcaaatcatcgaaaatttgaaccagaaattcttttgaaagttgaaacacaacctgaaaatcttgcaaacatgaattctgaatcctacaaatttagtttgttttgcagtattcagacttctgaattctgaatcatggaagtttctcatgtcaataaaagctttaacggccgctttgaatcataggaatgaaaaaacggaggaataggaaaaacattggattatgataggaatgtagctaaaacagaggattgcaaaacacatgaaaaacatatgaatgaccgtttgattggaccacaggaaaaacacacaggaatttgaggagagataaaactcaaaagatttcttccatgaggttctacctctggttaaaattccttcaaaacttgtatgggaagagatattccataggaatttcataggattacatagggttcattcctttgattcaaagagatttgtaggaaaaattcctataggaatgaaatcctctaaaattcctatgaatttcctttgaatcaaaggggccttatttaactaaattgttttcctttttttacccaccgacttactatcaaataaagtatcttccgatcatatgagatgttccgtttgattctcttcatcttacttcacacaaatttgtatgatttggacaaaattattgcgagtgagctacaaatgatcaaatcagtgcaatatagcttgactcttcccattttattttatatggagttgtataattggaaaaaaatatctctagaagtgagctacacatatcggatcatttcagtatacattgtttccattgttcaagtgagatgtaatatggtcttctccaatatctcaactatcttattcagagaaggaactgtctgatctgtccaaatgggttcacaccctttgaagagcaaatatgtactaaaatattggaaagatatcacaacatctaacaacatctatggtattatcttcctggttgattgcgtctcctttacaaatatatatagaagtataaagcattggttgcactcatgaaatagagcaggaaaagagtcttaagtataaaacagagttgcatgctagcttcacactagcatgcggcaaagacatgtagcatgcatgtttactactacctactagccgctggctcattcatcgtgaagggtaatgacttggttctaaagtaaagaattatgcataataaattatgccatcatattggaaagatataaaacaaaactatcggtactttttcatgagaatggtgaaatattctggtcggtggtttagattttagaagatctgtctatatgcgtaggcgcctttgttatgtacagaaaatgtctccgttctgaatgctgcaaaactttgctttgctttcaatcctacattgactcaaagtttttgtctatggaatttcttaacaacaaacctgttaaaattaatctggtatttttctgctaatcccattttttaatgaagaaatcttctatgaaaactttaacatgagtaataacaatctggtataattttctattcttaaatacttattcaacataaaggcaagggctcatgaagaattcataatacatgctggattttttacatttagctctttttacaaaacatattttacaaatagattaaaaaacattaaaaaaatggacatctaactcgatcggcgccaatgtctctaacgcatatatgtatatcagcaaaattgtgtgtgtctatatgaatgtatgtacatcacttctaacccagtagccaactatctcaaatcccctaactctatcccactaaacattagggacacaacacttgttattgttaagtggctagtcttaaaatcatgcatctgcgttaatgtgacatcccggcccagggcttaatagaattaatagaatactcatatcaacaaattctaactttttttccggaagccgatctcgaaagaactctgaggttaagtatgcttgacttggagcaatttcgagataggtgaccgacctagaaattcttcccaggtgcacacgagtgaagacaaagtgttctttccttggacaaagtgtgcagaaaagacttgtgttggagcaatgggtgaccgacgggaagcaacgactgggaagcaatttctttcccgggacaaagtgtgcagaaaaaaaattctttcccaagtgcgcaattttgggatgggtgaccttccgggtgcgcaatttcgggatgggtgaccgacctggaaattcttcccgggtgcacacgtcccgagacaaagtgtgcagaaaaatttctttcccggatgcgcaattttgggatgggtgacctcctgggtgcgcaatttcaggattagggatgacaatggatcgggtcgggcacggttagagcgaaaccatgctcggcccgagacccatgtgcccacgcccgacccatgcccacaaagccaatcgggcccgacccatgcccacaaagccaatcgggcaaatccccgtacctgtgcccatgctcgtcgggcacgggcatgcccgacgggtgcccactgggcatgcctgccatccgccaccgcgccgccgcccgcgcgcagccgcgtcaccggtcgccgcccccaccgccgtgtcgccgcctgctacccgcgtgcagccccgtcgccggccaccacccacaccgccgtgtcgcgggccgccgccccacgctcgtgtgccacctaccgcgaaactgcagtcgcccacgctcgtgcgccaccagccacacgctagccgccgccgctgcgctcaagcaccgccgcgtctccactcgccagccactgtcccgccgcctaccgcgtcgccactcgccagccactgtcccgccgcctaccgcgtgccactcgccagccactgtcccgccgcctgccgcgtcgccactcaccagccaccgtcctaccgccagccgcgtcgccagccaccgcgtcgcccacccccgccacgccgccagccaccgcgtcgctagccaccgccgagtcgcgccgccagccacctttcccgtgggccgccgctggtagaagattgaaaggtggtagtggggagataaggctagggtttcattgagtaagtatatactccctccattccaaaatataagacataaccacccttgacccaaagaccaagaaacaattattatcacctctttgtttgaatcaatccaattaatacaatacatgcacccaatagaattaaatatcttgtgagtgtatgatttaaaaaataataatttaggagagaagagatgctaaataattgccatgcatgcatgcacgccttatattatgaaacacctttaaaaagttgttgtgccctatattttggaacggagagagtatattgctgtatacaaatgagccaaatgggctattgggccatgaggggaggttaaactattgaagacatgaaggatatacatgggctataaaagtctcgggtcgggcatgggttatccacgggtgaaatataaaacccgcatgtgcccactaagtctacggatattgggtcggatgtgcccacgggaaaaaaaggtgcacacgcccgcgtccatcgggccgggtatccgcggatacccgaacccacgggcaatactgccatccctattcgagatgggtgaccgaccgggaaattctttccgggtgcacacgtcccgggacaaagtgtgcagaaaaatttctttcctgggtacgcaatttcgggatgggtgaccgaccaggaaattctttccaggtgtacacgagtgaggacaaagtgtgcagaaaagacttgtgttggtttgtgagagcagtctatgacctatgaaagctgccagatgtaagtgggcccggcctaggagaggcgtgacgttacagctaatatgacactactatagatttaatttttctgaatgagacccctctaggtttcaggcgggtcagaagacttgtgttggtttgtgagggcagcctatgacctatgaaagctggcagatgtaagtgggcccggtctgggagaggcgggacgttatagctaatatggcactactatagattttatttttctgaatgagacccccctaggtttcaagcgggacataactgaccctcatgcaaaaattgctattccaggagtggttcaagggttgcatgcgaaaatatatttttgcaggaggcccactgttggtatttgatacggttacagataaaatccacaagcgcacggatataccgatgtagcacttcccctacggagtatttcttccatgaggttctacctctggttaaaattccttcaaaacttgtatggaagagacattccatagggctgtcaccacctctacacccacctcaacatactgtgggatacacagcaattactggataataattacctaaacaccacgtctaagcaattaatatctactttagtgtttataactcaccaaagcaatcactatattttagttgattatagtgaacaataatcccgtatgctgattaggaactaaccaagagataattctcacaagataaatctaaattactcaagaagaatattatattgaattcagagtaataaacaaaataaaagaaataggagaagattaccaacaactccggaattcttccgactccttctactctactctcttcctattctagtatacaatatagtacaatagagcctcttataattcagctcaagcttggaagtgtgtgtgtgaagtgagggagtgaagcctttatatagaggtaggtatgacggttggcgaagaggaaatgtccgaagtgccctccaaccgccatcagggatgcatctgggacgtccatgccaaaccccagcctggatggctgagattgtggttcggccgaaccagggccgaacctgggctgggcccatctggcctggcctttggcccaagtcctcccctggtcctcctctatccatttcttggtattttgggctgatttactgatgtttcgatgaagttcacaacccgtccttgcatggatacataattctcttcactttagtctgattttcctcccaccttcagggtttattatctgcatccaaatatacaccaacacctgtggaatatgtgagattaagtgcctatctctatgttggatgttttattatctgatctttatgcagatgttggcggtatagaatcgacatttaacagccgccaacacccacctacgataataggctattttcgtaggtgggcctcttaatagaaccgcatgacaaaatcaattttcccatatggacatttctctccttcgcctacaattcacgcaacagctagtcagctacccctccacttaactctttttcatccgtgcatttggcctctccaccttccccttttttctttccccccttctcttctcctctctctatttccttctctactttctcctcctcctctcactttccttctcctcctttctccacttcccctcctcttccttcccgcacttcccagcagagatgacagctcgggaacaggcggcaccatcacgtggagatggtggcctcaagggcgggcggtgccggtgcacggatctagcgtccttggagagacaggagtaagcctcgggtggcggcggcctcaaactggctggatctgctgccggtgcccacagaagtggtagatttgcccaatctgaggatgacgggagcagcagtggtgacctcggactgggtaaatccgtcgccgatgcccgcgggagcagactcacgcaatccgaccggggacggtgggagcactggtagcgggagcgaatggccgcgatggcaacggctacgacgacgacgatggtggtggcggcttcgatgacgatgcgtttagaagctagggttttgggagaatcggggagctagggtttcagccgaatttgttcttttgaaatttttatatttttgttgctgaaattattttcacatgcgggcgtcataggtgaaagcattcaaaaatgttgtttttgcatgtggttgcgctaaatatatagaaaaatattgattgtcacaaacatctgtgtgcaggcggaccatccagccgtttgggaaaaaaaaatttgccgactgcaaaaatcgttttttacaagtgtgaaaattttttataacgacgagagctcagtttgaaaactttggtaagtattttaatggacaaggactcaattttaaacttactgaaattaattagagtttcatctatatgatcggtaagactaacaagaaaacaaaataagcatatgatagttgtaattctaatcttcctttctacaaatgatacagattagattaatcaggttacacatgatagttataattcttatctccctccctacaaaatgatacagattaatcaggttacacatgatagttgtaattcttatcttcctttctacaaatgatattgattaatcaggttgactcaaacatataatctcatatcaatttgtacagttgttgtgataataagttttgaagttgcacatgatgatccatatacaacacaattattttgtttgagatcagatattatattttgtccaggatggtaacaagatgtaagatgtaaaatggtttcctacaatatctcagctaaatgcatagagcaggggttgttttctagatgatggataaactaactagctgtggtctgcttctgcactgaagcattgattgattctagttatcaaatgcagagcaggaacagatgttgttggctggcagtgtctccattgcgcagaagcatggattgattatatagttatgaaatgtagagcatgaatagggtctttggtatgtaaaagagacatatgaatgctatcttcataaaagtagcatgctacttaccggctggttcattcatcgtgacgggaaaattgctcaggggtgaaagagaggatgtatatgcatgaagcattgaagccgcaagagaaatggcatcgtattggaaacacagaaacaaaaatatactaccacgatttcatattaagctttgatttttttcaagccaaatttttaggtttgatgaaatttatagaaaaatataataatagttttaacataaaactaagaagctatcaaaatatattcaatgctgaatttaataaaactaatttaacgttataaattttggtatattttgcataaacttgatcaaacttttaagaagtttgacttaaacaagtcaaaagcgtgtgaaacggagtgagtagataatttctaatcatattggtgaaagatatgtccgattttttttctcgaggtaattaagtctattcttactgtattgctaactttgtttacttcctttcaatccaatacactgatacttataaaagcttgtgcctatctcatcgtattttttttaattgttgaatatatatacaccggtacttttagctgggggatctagtctgttcatcatggatgtttgaacgagaaaatatgtagtgaaaacctacacctacgttgtggaccactggatctaaaatgtgcgttccagattaggcgttacctacccagctcccactcaacacgttttatgaataaccccccgcgtcaggctttatacatttacaaatacaccatctcatttccctcctttctcacataggtacacatctttctgaatcaccagatccaaatcaaagacaaccagccgcacaggataggagcgatgatgagtgaagcctcgatgctatcctccccggcggcaacctactctggcctctggctgtcctcgccctcgtcggtagctgagaaggcgcggaaggagaggaactcttttggtaaggaggatgttgccgatgtcgccgttgcgccgaacacggatgcagatctgagggagccggatgtggtgaagcttagagggagcacgctgccgaaggtccgagggagctagcccccgacgcagtggagttggcggtcatgcgttgaggatattgactcgtagctctaggctctgaaggtgagggtttcttgatcgcctctcctagtctcagcctgcatgtagctgtttgaactgattggatctctcgtgtggatgtctcatggatattggattttgtcccaatttagtagctgatgtttaggaaaatggcaaaatgtttggacaccaaacacaccgtgactaaattttttgcaagtgctgaactcatcagtaaccaattacatattggattttgtcccaatttagttgttgatgtttaggaaaatggcaaaatgtttggacaccaagcacactgtgactaaaatttctacaagtgctcaattttggggagctgaagtgctgaactcttccttgaccaattacaggggatgctttcagaatatgataggcataaaatggatctttgttggtttcttggattagttaagtaaatgtttcactagttttttaacttaaccttgctagtatcacacaatttttcaggcttccctgtatgtttttctaaccttgctaccaaatcagtatttttacttccttggatgtcacattttcagactaccaagctgagaggagagcaacatgcaacagacagtaatcctgtgggtctagggttcagcacttcaaaactgacgaccattgtgagaatacataggaggtgctaactaagatgatgattgaaggtgacaatctagagaaggtgctgcaggaattggaggagatgaagaacttcatcaagacaatgcatagcacttatcatgctattaggatttaaaaagaaaattcatataagagttagtttgtaatcaatttgtctatatactgaaatgacaatattacaagcaaacacaatgtgtaaaatgcctctgcttcttccaccttgacttgcactgcttttgcatctcaatgacagcccgcgcacgagcagaactcgacggcaatccacgacaacgcacggcagtgagagttatcgttcttcccttccttaattcaaaaatgagcacaagaacaaggttttggtgaattttaagtggacaatggacactgcagagcagactgaagtgaatataatctaccttatgcacatgacaacaggaaatcgtgcctagggtggaaaatggcatctccctcaccacatacacagaccacatatatggatgagggtgaacagatatataccttcatgaaaaaaaattgacatctgaacattcagggaacttaattctaaagaaactcaacatgaatatattgttatagagacgaaaaactttcatgaccatagtgtgcaaatgcagcacaccggtttgtgggaacacaggtgcagaaaattactagttcaagtagaaaaatacagcacacagaaaatttatccagttcaagtatatttaggattttcctagaaaatcataggtccagaaagtggctacaaacaactggcacactacaagataattgagctatcaccaccaatttattacaacgaaaaataattcgtggcaatatattgtactatcgcaatgatattttttttgtggcaaataactataatttgttgcaacgatttacaatcattgttttattcagtatttttgttgcaataggaaatgagctattgccacaacaaacagtactattgcaaaaacatgttctatcgccacacatttaatttttgtggcaatttgcatagtacatggtacttttcactattttctattgccatgattaacaaattcgttgcaataaaaatttatcatctcataatttaacttattcttttcatatggacacggattaggacaaattttatatgaaatttatagctctcgatgagatctacaacttaaatttttcatttgaaatattttaaatactcaaattcatgatttaaatcttagttaggcagtctcaaatggaattgtatgcatttttaaacaaaattgatgcgtagatgagttggtcatggagagcgcgcgtgatggagagatcttagattcgaatcctggccatgacaagatatcagaagaaaatagttaggatgataaattaatattgaaacatttaatttggtacgtagaactaatgccacacatggagtgatagcaatagttatttattgcaacgatgtgaagtgtcgcaatatatattttttgccacatccattttatggcaatatcaaattttattacaactaaataaaaatcgttgcaataacctattaccatgctatttattaccacggctagcaacgattttaagattgtggcaacatgtatctatttccataattttagcattgatactacgattttttttcgtggcgataaattatttttcgtggcgataaattatttttctagtagtggcagagtcaacctagtccatcaatgtataacgacatggtctgatattcagatgtcttttgctgacacaatttagatcccacagagttttggcaggtaataacattcataagttacaacacttgtgcacaaatatcagttatccccttcaaggtgttgtctaataaaaaatgcaaccttgctattaaatggctaaaatctattaatagatcacacacgtgtgcactggatgatggcagtggctctactttgaacaaaaaactactctaggcaaaagaattctcgccagctgctctcagcaaaaaaaactgcacccagcaaactgcatagtgaaaaaaattgttaagaaggacacatatacttgtgagcatagataaaaaattgttaaggacacatatacttgtgagcatagatacatacaaagttttattcacactacggaccaaactaagataacaaaatgttcctggaacacaatggttgttctaatattttttccctgtcttcccatatgtactcttaaccatttcaagctgaatattagctgtccaaaatgtccttgtcgcaatatacatttgtatatgagccaaacatgtttgtagaatacaacaattgtgttacttaaatattttccatatgtaattcttaaccattccaaactgaaaatgcaatccaaaatgattgtgcttcctacacatcccactgtatattacatgcccacttgcccacctagaatccttcccatatttttttatactttgttccaagttgataacactaggtcccaaatcatacaggcaaaaacttaaagaactataaataagaacccatgcaaaaatgcaagggaccacatcagttaacaggacaattgtacatttgcgatttatactaataattagactcatgacgacaatactaaaaatgttattacctcacaatggtcccaactaattatatttcaacatgtgttcactacctgctgttagttaaatattatatggccacctattatcttttacatgaattgctactttgttccaaggaaatctacagcatgtcaattagaaccagaatgttcttgccacactatagactttacgatacaccgttagttgaattttggatgacaacacacaatcttttacagagaaatgctaacttcttccaggaaattgtatgacaactattataagatgactgatagttaaggaagcatgatgtatagaaccttgcatcactgttgtggttctttgttaggacagttgtgcgaatcgtgcagcatgacttgtttgcacttcttgcaccttcgtggtactctctcttttttctttctcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggatgagcttctccatttggttgcatgcttctgaaagcattttttgcatcacaggatcattactgttgcttgtgtttccttccaacaagataccatatgcatcgaacacatgtgtcttctggcagtccttcctaaacctttccaataaatagtatctcggcagttcacttagctgggcacttcttaggactggaattagatgacgacatggtataccatgagtttcaaacagcataaatgtgcacgttgcaaccattgtctgtctatcataacgcacaactcttggcttcctggattcttcaatgatatcgatgattttgacctcgccatcttgttgcacattgtcaataaggcaacggtccctggcagctagcacctctttctaaattatgctaaatacctcatgtgtgaagtaggggtgggcgtttggtcagaccgaaaaattcggtcccggtcttcggtttttcggtcagttcggtcttcgcaaactcaggaccgaatttcatccaaaaaaactcaggaccggcaaattcggtctcggttttttcggtctcggtctgaccgaaatttttgaggagagtttggaacgaaaaaatttggaacgcgcggtggagggcggcggccgcggcgcggtggaggacggcggcggcggtcgcacggtggagggcggaggcgggccgcggcgcaggggagggcggaggcggcggcagcgcggtggagggcaaaaccggcggcggcggcgcggtggaggctggaggaggcggcggtgcggtgggggctggaggaggaggcggcggcgtggtggggctgaagaagaaggctgcactggtagtagggttagtatcacttctagggtttgttttagtgggcttattgggcttcctaggtctattgggccaaaatttcggtcatttcggttaattcggttaaccgaacccaataaccgaaataaattcggtcttttgagggctgggaccgaatagataaccgaatttctcggtctcggtcttttcggtctcggtctcggtcttttcggttcggttcttcggttcggtctaaatatgcccacccctagtgtgaagaactcacttgcatgcttctctatcacccattctgtcttcaaattgcggattgtgtggagcgtaatgttatcttcttctagttccttatgtctttgttcttctagtgcagcatcaagcctgagccaaaactccaccaaagcaagcttccacccaattagacgagaaaagaatgaatcggcactctctgaccttgaggtggtccttaacaatcctaacaaaggtatgtcactaaaataagctggcacccatgaacgccgttgatcgaactttgtactgaaccattcgttgtcttccaacccatattcataaataatacaactccattcatcctcgaattcgagtggtgtttcagaagaccacacacaagagcttagtcgggctttgaatttttcatcctctttcagaattggtccaaccttctcacaaaccttcatcaaaatgtgccacatgcatagtctatgaatagtagtggtcagaacttctcttattgcagctttcatgcttgcagcttcatcagtgataattagcttaggtgcaacacctcccattgctttcaaaaaagtgtggaacaaccacatataggactccattgtctcgtcagataacattgtagcaccaaaaagtacactgctcttgtggtggttcactcctgtgaaaggggtaaaaaccatgccatactcattggtgctgtatgtagagtcgaaagagacgagatctccaaagtgagcataatttttcctgcaaatagcatctgcccaaaatacatgaattaacctccccttggcgtgccacaacataattaaaataaaaacctgggtttgcaagactctttctactcaactgatcaacaaacattatagcatttgaggactttattaaaactcttaaagcactatggtaattctgcaagttcctttttgtaaatccaacattctcaaacccttctacccaacacgaagggatcggtatgcttgtgatgtaccgatgctaactttatggcacgtgagcaatgtgtttctaccactcaagtaagctttctgttggaacgtatgagatgcctcttgtcaggagaaacgaatgcatgtgtatgaccttgctcaaatcccgtgataacatacttatcgccatcgactagtttaataaccagcttcgcctcacaaccacacctagtgattcttttctcataactccttttctcactaccagattctagtcctctctcacctttgtcctcccagaatccttcgttcgcacaaaggaacagtttgtacagaaccactccatcaactttcttgtgttgtccaatgcgaactgagaagccaactctaagcgcatagctttcataaaactccttggctgattctaaaccattaaaagtcataccgatgtttggcaccatagaatcatcacagtctggaataaaatacgaaccctacacagtgcacattaacaatgatgaaagagcagcatatcatgaatgcttaaactaacttgaaaaaatgggtgtgcaataatacttacacagaatggagtgcttgaggacttttgaggcgtggtgtattgatctcgtcgattcggaatacctgcagtaaccgattctgcatcggaatgcacatcattaaagtccaatctccctgccatgtcacttcgttctctaagaataacctggatgatcaaaataccatatgtaaaacttaatttttataaacagagcacacccagtagaaataaacagacagtaaaatagaagagaaattcaagaagtgagatctatatgtgagacataggtaaaatgaaagaaaactaagaaagtgaacatgtcagattatttcaggcttgcttaatggtaaaacatgtctttccctaggcaagaatgtcagagcaaatgggagactcgaagcaaacaacacatcaacccaaaccagtgggccgataatattttcttggaagaaagtaacggtttccggtaaaaagattataggtaaccatagaaaattcaactaacagtgggtagggaacacatgctgaaatacaattccctgtgactataattttggaggcatagttgctaccattgtgtgccaagagcattttggttctaacaaaatgcttgacaggctcaaactttcacatatgtgcttgcaacatgacatttgcatatttgtctttgcagcttgcaggggtaacacttttgatgaaagtagccgaggggaatacatttcccatagaagttttttttttaacagtggagacacagtgttaaagggtgcattttgtttaggaacaccatagggaaatgatggttctcctatttcagaggtattcattggatgcattgtcgtactcgttcccagattttatggattaaattagtcaaattatagtcaattacactatcagctgctgtggtgcatgaatgaatgaatggttggatggatggacagactactgttgagtcttgagcagtgttcagctctgcaaaaggatatgtaacagtcttgatgtttatggaaagtagaattataatctgttgatcagattgtctattcacagcaaagttctgaatggatgtgatgctaattcctggtttcgatcaagcatcttgattttattcagaagcaactactccaatctgtagttgtgtggcatgttaatgaaatgaaacatgacaacagttgtagaaaaatcttttatagtcacgagttgtaggaaaaataatcagtcatctagattgacggtttcccacaatagaactgcatatacatttcataaaaaatcagggaggtcggcatttgagttacatgtacaattttaggcaataagctcatgatgtagatttcccaggtcacacattcatctgagtatctacagaacatgagaaaatctgagttccggctaactacagaaagaaagaaacaagcatatggtcagagatacaaaatccacactaacatgagtattaatgttctaaagcaatatgcaagataatggagaacataaagcacgacggcaggccgtcgtcagcaacatcaattctacgcacggtcctcccatcgatgaataatacaacagtaacagctgcagacgccgccggttgctccacatcagtgggtagctcatcacaaccttacagaacagcagtaatggaggaacaccattactaccttttgttggccaatcgatgaggggctaggcccaagtggagggaaggacaagaagaacaagaagaagaggaagctgtagctgtctctacaagaacaccgacggcatagtaactctatttcatctgcagttgtcagtgttggtggcatcaaaaccctagttcatctcagcccctaaattgttcaaaccaagaacattccgctcattccgcggaagaacatacacgaactatagcagggatcaagaagagagaatgaccttaattcagtggatgctggatgagcaatcggcgaatcgaggccgccgttcgcagatgcctcgacgtcaccggagcagcatgggggttgattcatgttgccgcgaatcacgtggaaaggtggcgctgttgccgaccaccgccggcgccccaccccaccccaccgccgtgccgccgccacaccacccttcccccaaccccaccgtcgtgccgcagcagagagttgagtttggggatggatcccttctgaatccgagatgtgttgtggtacaatttgggggctgagattctaaagtttggaattaggcggggtgttttctgaacatttcattctgtggtgacgtggacatatctggaacctacgttttgcatccaagtgtggtttctatgtttgcactatagatagtgtttccactacatatcttctatgtttgaacggttttgcatgtttgaaactgcaggtcaatcccaaatccatttgattttcgctctcgtcggtcttcccacccatccatccatacctccgccgcctgctccggcgaatcctccgccgcctgacgcctccaccgctcatctcatccgccgccacccgcctctcatctcgctgctgctccacggcatcccccgctgctgctctccggctcggtggcgcagccgtcctctcccgatcgagccggcgccattctcctctcgttccgtggcttctcgagctcaccaccacaagcggttggatcgtcgcagaagatcgagcgggggagatgcgagacggcccggcgccgccgagccgatgtccacccgctccaccaccagctccgtcctcaacttcctacgccacgtctccttcccgccggacccgcgcctcctcccctccgcgctcaagtcatgctcggcgctgcgcctcgcccgcgccctgcacgcggccgccgccgtcgcgggcgtctcgcgggacgccttcgtcgcgtcctcgctcctccacgcctacctccgcttcggcgccacggccgacgcccgcagcgtgctcgacggaatgccgcacaggaccgtcgtgggctggagcgcgctcattgccgctcacgcctctcacggggacgccgagggagcgtgggggctcctcgagcggatgcggagcgatggcgtcgagccgaatgtgatcacctggaacgggcttgtctccgggctgaaccggagcgggcgcgcacgggacgcggtcctggcgcttgtgaggatgcacggggaagggttcttgcctgacgcgaccggagtctcgtgtgcgctatctgcggttggggatgttggagatgtcgctgtcggtgagcagctccatgggtatgtggtgaaggccgggtgcaggttggatgcttgtgtggccactgcgctcatcgacatgtatggcaagtgcggacgagctgatgagatagtccgggtgtttgatgagtcaagccatatggatgttgcctcttgcaatgccctcgtcgctgggctgtcacggaatgctcaagtctctgaggctttaaggttgttcagggagtttgtcggcagagggattgagttgaatgttgtttcctggacctcgattgtagcttgttgtgtgcagaatggaagggatctggaagccgttgatcttttcagggagatgcagtcagaaggaatcgagccaaattcagttacaataccgtgcgtgctgccagcttttgcaaatattgcagctctgatgcatggtcgttctgcacactgtttttctcttaggaagggctttcatcatgacatttatgtggggagtgctttggtggacatgtacgccaagtgtggcagggtcagggatgcaaggatgatctttgaagcaatgccatataggaatgtggtttcatggaatgcaatgattggtggctatgctatgcatggagaggctgagaatgctgtgcggttgttccgatccatgcaaagttccaaagagaagcctgacctagtcaccttcacttgtgtccttggtgcctgcagccaagctggctggacagaggaggggcgtagttactttaatgaaatgcagcacaagcatggaatttctccgaggatggagcattacgcatgtatggttactctgcttggtcgggctggtaagcttgatgatgcgtatgatatcataaatcagatgccgtttgagccagacggttgtatttgggggtcattgctgggctcttgcagggttcatggaaatgtggtccttgctgaggttgcagcagaaaatctatttcaactagagccagaaaatgctggtaattatgtcctgctttccaacatttatgcatccaagaaaatgtgggatggggtcaataggctgagggatatgatgaagactgtagggttgaagaaagaaaaaggctgtagttggatagagatcaagaacaaggtacacatgttgttggctggtgatagttcacaccccatgatggctgcaataactgagaagctaaaacaccttactatggagatgaggaggctaggctttgcaccaagtacagattatgtcctacatgatgtggaagagcaagaaaaggatgatatcctttctgtgcacagtgagaagttggctgtagcattgggccttataagcacaagtcatggaacaccccttcaggtgataaagaatcttcggatttgtggtgactgccatgaagcaatgaagttcatatcatctttcgagaggagggagatatatgttagagacaccaaccgatttcatcacttcaaggatggaaaatgttcatgcgcagactattggtgatttttcttgtcttgttcgactctacattttacagaacttggcaaggatggtgtagaaaagcatctacgtctctgtaccctaggttaatatttcctcatgaggtaattacttaccagcaatatctgcattacttagtgatttattttataataataataataataataataataataataataataataataataataataataataataataataatattaatattaatattattattattattattattattattgagcaagggctgaaagcccattttcattaccagaaatgggatagtctttacattacacacgacctttacaccattacatgataacagacagcacagctatcacagttttctggcactatgagggttccatcccacccctttcctgccataacctgaaactaagacacaggactactgtgtcaccttaaagcataaccgggacttagtatcaggaatggcatgacttgcccatcaccaaaacacaaacatccaggaccgaaggtaatgacataacacaccc

SEQ ID NO: 78375 - DNA, 6004 bp, Oryza sativa
  unsure (1)..(6004): unsure at all n locations
gttatttggtttgtgcaattttcataagaaacatgatatatttatatagtagactttcccatcttacctgcatatgtttgatggacagaataatttcttaagcaattcagtgaaagtaatattattttatatgaaaagtattcatggttgtgatctgcagacttgttgatttaagtgaccgtatactgtaaactgggatatggtaaataaagaaggatttacaggtgaagaaaagctaaagccttaaaggtactttcctgtcaatctgcataataattatgctactttcantttgtgattcatgtctaataactatcctgagacatcactctaatcagaatctctgtttaatactagaaagctagactattgaagagcctgatatacgttgacacaataataatattttactacagatgctcgatggtttcagatattttcataaccccttttcattgacgaagttacttgcatcttcttgttctctcgtctctgggagaggcagagagctagctctgtgtttttgtttggttctatgccctaccaaaagttggcagagcaaaaaccttgggattggtaaattttggtaggatagagatgaagatgtctagtgctaaaattgtacttatttgagatagatacatgaacttgccataatttttgctgagtagagctttcatggagttttttgttttgttatgtaacaacttttttgcattttactaaaattttgctaggtaaacaaaccaaactagataaacatcacgctgaacatgaactattgaactgggtctgtatatatctctgcctccccagctgtcagagcccctaaggcctggccgagtcagccatatgggaaagaatcaaagaaaggactaatacaagaggaatcatgtatctttgtctgccgatagatgtggcacaaagaagccgtccaatacattttatttgcagtaaggtaaaattgaggatatcttaaaaaagggatagaacgaggagaatatcaaagtacagtaaaaacgagcatcgtctgaacttgtttagtcttggcctcttctcgtcgtagctgctttaaaatttatactctatatataaatgggcatgccaatatgaagctggaataatccttcatccttcgaaaagctcgttcaccatgtcttccatgtcctgttgattactgccacatttctcctgctctggatgggcctccaggtatgttctgtatccagtaggaccagtaataaccttgtcaatgatagcttttcgcaggctcctcctgagctcagggttcggaaccttccatagcttctgatgtctgcatgttctctgaaattccgatttgaatcttgctagctgcgagggtttagaaaaccagagcgttgtcatcttaatgtgcaggcaagatagcactgtatcccaggagacattgagatagcaatttcggtagtcgcaatattttatccctattttcgagtcagatggaaggctgtaaccggtgattgcaatatactgatcttgtatgaagtaggaattgttaagcaagaacaagtacctcaggatagggtctgagaacgactctgatttcttctccagatgatctattaagttgctgatcatttgctcaatgatgtcgcattttaggatgcgatgaggccaacattggcctagtatggagttgagctcgtcaatgtgtccccaaaatagtcttgcatagtccataattaagtgagtagccttgtggatttctgcactctgcgggaaagtttcccaggaatgcatgccactcaagacaggagtaacagcttcagcatcgtttgccatcctttgtatggcctgacccaaattatcttttgcagtcgagaaaatattgctggtcttgttgagcaggccttgcagcatttcgtccgaatctggtagccagagggtctccttcttcaaggagagcatgatgatttcagacgcgtgggagatgcagctgcgcacgttcatgaggcccgagagcttgttcattggattccaggttttatcggccacggcgactagggaattggcaaaggcaagcatcttgcagacggtcgcctcaacgaaccgcaccagtcgaaggtcgtcgtcccggtcgacttgggcggtcgaacggccctcttcctggagatggcgctgcgtggcgctgagcgcttcggccatcacggtgaatcctcgtgtccacctctgcacggcaagatcgtacagcttatccaaggccagctcgctcttctccttctccagcgccgaccggagtacccagccgacgtcgagctcggagaaccacctctccagagcaggtctgggcgcccggccgaactccccgatcagcttgcccatgaagccgtcgcggaccatccgccgcgcaatgtcgcgagggcttttgtcttcaagtcttgccaacctccgggaagatgagatggagtaaggggcgtagcgatgacgagagctgcttgacttactgctgctgtagtaactactggatctcgccgaccgagacgacgacgacggcgaccacccgccggccgagtcgacggccaagctccggatctcctgcaggtagctgtgtctccgtgactgcagggaaatgttaggatcgctgctacgacccaactccatcgtgatcgccagctgtggctctagcttcatgctcgctcactcgagctcggccatgtttggataatgggtttgggatatgatttcccaccccttaaggcctcgttcggcacgtggggagggctttccctagggggaaacaccaccagtccaggattgggtggatcccctcccaccacccaatccacttccacgttgggtgttaaacccccatcctattcggatggggaaaaaaggggaaaagcagggaaagcagggaaaatgcatatctttgaataaaaactgagaaaaaacgagcatagatagcacatctcaacttaggaatagaatcaaattacaaaaccacacaaaataatctgaaatttcaaaaaaaaaagaaaagctgataactaatttctacaatggcatgtacagaagaaaaccaaaattaagaaaatagttcattaaataaagaaaatgaaaatactgccaagcttttaaaacgatagtaacactgctattcaatgtagcagttgacattcgcatgtggtaagtcaatctgtgccctccaaacaatattacaagcatatataatagttgccaatgtactccacgcatttaaattctagtgattagcaagtgacattaacacctagaacactgagtacaaccacaaactaggttcccaggttccaaaatctgatttatccacaaatttaagaaatgaagatggtaactgcatgcactgtaccatttgatcttcacctaataatattagctccatgacctgagaggagaaaatgatgagcattgtgaccccaagaaaagattaaaatcaatgccaaaaaacacacacaaaaaaaaaaagacagacagacacggcagccaaagaacagctgttgcagcatccagaaacaagcctctgataagtttttacaggtgatcacaacaacagaaagcttccaatatagaatagcatacagaaaatgacagcacattaggaggagaacaatgttggcccatagataagtttattttacaaagatatgacatagcaggactatggtagcttaatgccgacagtaaagcataaaaaaaaagtacagagaagttggactgatgacagcaatgtcgagctcaacaggactacaggagaaatgaaaaaaaggctgatcactatcatcatgctattcatctaccctataattcaccaacccactcttacacctacattactcattcatcaaatccaacggccagaatcatccaatccaacggatcacattataccacgcaccccctcaacctccgtatggaccccatcccccacttctctgtcaatcacgccaccccctcgccctcaaggattctctgcgcaccgtgcctccatctgcggatctgcctctgcgcacccatccgcccctgaccgcgcatcggccccgcgccccctccactgctccgccgaccaccgtcaggtcgcgacgccgccgatgactctctcgtgccgccaaggatcacgccgccaccgtgactcctcgccatcgatgcgcgacgtgacgcgtttccatctcttcgttcgtcgtcgacgtcttcgccggcctcctcaagaatcccgcaccgccgctgtcgaccgagatgaggaaggccaagccattatcgaaatagttgcgcgcgtaggcacaccagcagaaaaaggcaccggccactccaagctcgtccggcactacgactcggaggcctcctggaacaatgtatcactattcactagcacccctccttcctcactgctttgctgttcttgttgctaatggtctgcctctagattcctgcctgatgcttgcttgtttgggctttgcaaaggattaatggctggacgtcgtgcattggatccggcaggagtgcaattacatcccaaataagatgctacttgttagcacaataattaaattcttcatgatgttactttaagatcgatgtagccacctgtagcaaatgttgagtgcatgatcaaaaaattgaagtttactgttatttacttgtgaattgggatttgcttgcatcagtctacaaaatcttccctattgcttagttcgaaactaggcggtgtggattttggttaattttgacatatgcaggatcttagctcgatgatacgtgcgcatctgctgtttaagatgcacttggctctgttcagggatgattaactgtgcattctttagttactgattagtaagctttacagtataataacttagcggctgaaatcgtaaatgttagtactgcatttcctttacttggatgtaaggattcatgcaatcatgtggtctcacttgtgttgaggttttagcaaatataattcagattgccctgattggcagagctgagcatatgcgtgagttttgaatctgtcagtagttgaatactgctttgatatgtctgtagcaccccaaatatgttatgcagaattattggtacttatttgtgtttattgcaccgtcattcatttctgtagctattgcctcatgatgaagcaatatttggatatgtcatcgaagccagggagaccaagagcagtagtcatctgctccacaaggtagctgactgatcaggtcaggttatccttactaccaaaaaaacatgagtttatgatcggatttttttaaatgatactgctgaatgtgatttcgtgcaatgggatgaggcgtatatatgcctgtctaattgtattgctttgaatagaattggtttttagataaacctaatatgtttatttttagacaacaacatggattcatgctggattttagtatgaaaacctttggtctatgctggagtttagactaaaaaactctcctctctcaatattcaaataatgtgttacaaaagatcccatggtggtggtagagactaaccaccacttaatactgttttttatttttgtttatttagatacaacatggacaaagttcataaaattacattagtaatcatcatcaaattcatgcttttcattcaggctgaagagatgggtaggtttttcggaaacacaattatatccaggtattattcagtttcttgttgcttcttatatcatgtaaagagcttatttatctacctcggatgttcattccaagagacagcataaattactccggagatcccaaaacttgagctgtggtgtcttaagttagcaactaacatatctgtaatatttatgtttctcaaagatgtgcccttatcagtaaattgtgaaagaggggtggagatgccttcaagtgattttttttttgttgttttctgacatagaaatgcaataaagaagattggattattttaggcaatgattggcaaggataagtaattttactgatattagatttcagctgca

SEQ ID NO: 78376 - DNA, 8091 bp, Oryza sativa
  unsure (1)..(8091): unsure at all n locations
ttggtatattcaagcctagcatgctcattttggatgtggtactttcatagaagtgcacttagtgctggagacttcgatagaatgtcacactttcacctcagaaataccgaaaatttgttggtattgtttcatactccctccgttttttaatagatgacgctgtttatttttttctcacatgtttgaccatttgtcttattcaaaaattttatgcaaatgtataagatataaatcacacttaaagtactatgagtgataaaacaactcataacaaaataaattataattacgtaaattttttgaataagacgaatggtcaaacatgtgagaaaaagtcaacggcatcatctattaaaaaaccgtcatctattaaaaaacagaggtagcatttagaataaaattaagataaggtttgtgcttttttttattatttttcctgttctttttctctttttttggattatctgattgaattttgtatctatttttgaatttgtgttttatccatcttacgtgatgagttactcgtgtgtatggaaacggaggccatcgttcgattggactcacggacgaaaaattgatgtgaagaactgaaagttacaaatttttgaggtagttataagatatgttggttcaattacagtgttgataggttaattagtcacggttcattagtagagtcattagtgttttcttgattggccttttcttttttgagtccgaacggggtgtgtttgcaaaccctttttcccaacccatcttgctcgtttttcacgcacacgcctttcaaactactaaatggtatattttctgtaaaaagtttctatacgaaagttgcttaaaaaaatcaaattattctattttttttaaaaaatagcaaatacttaattaattacgtactaatggaccgctccgtttttcatgtttactgtgcacgtggggaaactggagtagtgaacacaagtcatcatagtccggtttattttagttgtgttgtcagtagagaggcacggacgaaaatttagttgagtatgtaatcatctgcaacatttttaataggtaaagataatagtagagattaaaaccgaaatataaaattaaagccgattcaaacacggatgacataccaaaatttagaaacatattcaatttttataatagtagagaagagatatatatataatttttataatagtagataagagagatatatataagtagagatttgttacatatatgttgcttgcaaaaatagaacgtgcacgtatattattaaatgtcaccgtagtgttagtacgagcatgctactagcggtgcaggagaatttcttaagtgtattgcaaatgctaaatattaggatagttatttacctactttattttttagttgtttatgcccgcaacaaattaatggaataaatctatactttttaacatattttttaaatgtatatttccctttatattgtatactgaagtgattatatataattaattattatcaagatttattgtgtccatgcaatatcatatttttgtactttgtgttaaatatatttaatgtacgatatgaattgaattgaaactcaattgcacatatcatataaaaatattttttgctaacatgaaattttaagtttttgaagatcaaataaaattgctccgtagcgtttagcacgggcatattactagtgttgtaagaatcatacaagcaagcttaacttcatggacaatggagccactttacaaacaagtacatggaaagaaagatctttatgtgagttctttggtggacatgtacgctaagtgtggcagggtcagggatgcaaggatgatctttgaagcaatgccatctaggaatgtggtttcatggaatgcaatgattggtggctatgctatgcatggagaggctgagaatgctgtgcggaagttccgaagagaagcctgacctagtcaccttcacttgtgtccttggtgcctgcagccaagctggctggacagaggaggggcgtagttactttaatgaaatgcagcacaagcatggaatttctccgaggatggagcactactcatgtatggttactctgcttggtcgggctggtaagcttgatgatgcgtatgatatcataaatcagatgccgtttgagccagacggttgtatttgggggtcattgctgggcccttgcagggttcatggaaatgtggtccttgctgaggttgcagcagaaaatctatttcaactatagccagaaaatgctagtaattatgtcctgctttccaacatttatgcatacaagaaaatgtgggatggggtcaataggctgagggatatgatgaagactgtagggttgaagaaagaaaaaggctgtagttggatagagatcaagaacaaggtacacatgttgttggctggcgatagttcaaaccccatgatggctgcaataactgagaagcaatgaagtgaggatggtgaaggatggtgaagtgaggatgctgagatgcaagggatatttgattcaggtgataaagaatctccggatttgtggtgactgccatgaagcaatgaagttcatatcatctttcgaggggagggagatatatattagagatacgaaccgatttcatcacttcaaggatggaaaatgttcatgcaaagactactggtgatttttcttgtcttgtacgactttacattttgcagaatgacattgcaagggtggttaaaaaaaaatcatccatgtgtccctaccctaggctagtatttgctcatgaggtaattattcacctgcaatatcaggctttgtttggaaaactagccaagagttattttgagagctatttttttagcataaggaaatagcccttcaataaaataactctaatcatttggatccaagggttattttgagagctatttggcctttaatgtaccttcacatggagagagatagagagaagacactttttcagtgggtcccacccgaaatagccccaattaacaccccttggatgggatagtttttctgggtgggttatttccaaatagccctcaaaaagctcacccttttggatttttttggggctatttgggctatttgagggtggactaaaaaatatcccttggatccaaacaggacattagtgaggatggtgaagaccaaaatccttctttccccaccctataggttgggttttctcatgaggtaattgtttacctgcgatgtcagcactttagatgggaatagaaacaacggaaagccactactagtactcccacagtttatgttgaccaacaaagaaaacacttcaaggataaacaaagctcattctcagggaatcttatctatgccaatcccacaagtggaagggaaaattcccaattatccaatatgcagatgatattctcatcattctgaaagcttgtcaaaaagagctttttgtctcaaaggtattacccaaccatttgcttactctactactccctccgtttcataatgtaagtcattctagtatttcccacatttatattgatggtaatgaatctagacaagcatttcccacattatgtctagattcattaacatcaatatgaatgtgggaaatgctagaatgacttacattgtaaacggagggagtatttgagaatttccataaatcttgtacgatgccaattcatgtcaatgaagaaaaactagaaatccttactggtacttttcgatgtaatattgtttcgatgcccttcacttatttgggtcttccggttggaacaacaaagccaagaattgttgaattccccccctcccccctaattgatagagttgaaagaagacttatggcaatcaccatgtttcttaatcatggccaaagacttacccttgttacccttgtcaattttgtcctctcttcgccgccaaccttttatatgtgcacactcaaactcccaaagaaagtgatagaacatattgatgctccattgctccgctggccgccacctgcctatcaacaattgatgctccattgctccaccaccatccatccttcatcggtgtgtgggcactgttgcaccggcgccccccaccggttagcctgcgtgtgccaccatgcggccatccgctctccgcactggtctcccatagtcgatgggcctcttcgatggctgcgcctcctcacaccgagccggcctccatcactgccggccgtgcctcctcgcgccacgttgacctccgcgcctcctttcgctgcatcggcctccgccgtccacaggtccaggaacaaaacccgcgtctaacgatcacgtcgcctcaactccaccaccgctgattttaggagctccactaccgccgccggccgtgccggcctccgacaccgccgaccgcgcctcctcgcgtcgtgttgccactgctccacagcgtcgctgccagcccgctgccctagctgcgcccagccggatctagcctagggcagcccgtgggtgatggcggtgctggatctgctgcctcctcgctgggagggctcgccaccgccactccccatcgccaagtgtccgccgcctcccccgcgcctgatatggagcgccgccacgaagtaggccctaccgccgccatcctagcttgccaatcggctttccggcaatgagctccagtggcggtgaggtgggggaggggggaggggagggggcggcgacgctatggtttcacccccgtgtctcctgcgtgttggcgacgctacgggagctgatttacttagacaattttagttatgagtgacattatctgttctgaaaaatactcatggtcgtaatctgcacacttgttgatttcagaagtgatcaaatccatgtaaacggaggaagtaattttataggatatggtaaatacatatgagaagttacaggtgaagaaacgttagagacttaaaaggtaataaattttaaattgttttgaacgaacatgcattgttaaattttggtaggatagagataaagatgtttagtttagtgttaaatatatgaggttgcgtaaaaattttcaggacaactaggaagatagcccgcgcattcacgcgggcatgtgtcgtacactatgtttgaacatctacaatatattatttctccataaattgttttcattagcattgcttttataattttctaacctagctattagttatctttataacatatcatatttaattaatccctacaagaaattatttataatattcttcatcatctaaaaagtaggtagacatattttgtgttagaaaacatgtatagcaaattaagtgtaaaatcaaaagtaagatgctttttaattgaatataggttgtcattgtttattgacagatgaattgggtgggatatgaggctccactaaatgcatgggtttatatagcctaatattattgtttaatttgagagataatccatatgtgaacgttccatgtagagtgtgtgggagactccatgcaacctagcgcgaataatattggatgaagaaatatagttgtgcaatatattattttggaagatgatgcattatgatacacgcttgtcttttaagatgagatagatctaatggttggaaataatgggtttatcggtttaaaaggcccaggaggatttatggggtaacaggtggtgactttatataaaaaagaaaccatcatctatgatatataaaataaaattataagtgtagcttaaaattatggtctttttaatatttgtttcaatctttagtttagaagctgaaaatagggaggagacaggagagaaacgaatagcgtagaactcgaatcagatatgagaaagggtttgtagtgcaatagtgttatgtgcatatgattggagagggagctggagggtacattttttttaaaaacaaaatctttgtaaacaatctaagtgagaacctatgaattgttgttttttcattctaaagatctttaagacatgacatgtggtggcttaagtttttttataaagagaggcaatctaatagttaaaaataatgggtcatcaaattaagtggaaagagatgattattttctctttgaatttcaattttttttcaaagttttacaatatcataagtggtgacttaagagtgctatagagcacgtttaatcgatctttactgtgtaaaacgattcaagaatatatatatcatgtttttcaatgtcttgttgttatttggtaaggagattttgtttttattgaggtagatttaatacgttcatctgtttgaattatttatgtctttaaatccaattgttaaaattataactccactgttttaaatgaaaattgatgaaattataagtccgccaatttaattgaaaattgatggttagatttgttttcttcataatattttttataattaaaattgttatttataaaataggaagatgagaaagaattattggagataaagaaaatgtatgtatgtatacttacgtgcgtggggggtggtgggaagggtgggccagtggggagaggagagttgtgccggtgggagaggggtgagggatgtggattgtggtttttttaagaaaaaaaagataaatctaatagttgaaaatagatggttcactaatttattataataccacgtggcggtttagtagtgtttataggcgtaccacgtggtagtatatatgtgtttgtataaagtttaatggattattagtatataatttttttgatttttaaatggtaattaggatgacatgccctaaaaattattcttttcagtagaagtttacacggttgaatcattaaattttttaaagacaccatggatctaaatttagatgtgttcgcaaatttgttgattatttagggtgcttgttgtttagccaataaaagataaatctagtagagtttagcaggatgaaaacacgtgcatgcacaccctcatttgtagtagacctaatgctaattgcattgataatcctagcaagaataggttagcctatttggataaccaaattaaagcaagcagcacgcacgttgaaaacctattcaatattttgatttctctgcatcattgtggtttattatataacttagtaacaattatgatcacttatgtttttatatggggttgctagctataaaataggaaattcacctacataccacagaaggaggagtacgtatatagagagaggagatttcttttactgaaaatgaaaccgatacttgagatatatctaacggttagaaataataggtccaccgatttataagttataacggatggtcagatttttttcttttttctcataatttttaagattttttctaatttcttagagtgtcacgtgacggcttaggagagtatgtaggatgtcacatggcgacttgtgcattcataggaagtttaatggacttgtgctagaatacaactcggaataacatatatttttacaactgttggctgaatttattaatttggtttttatcccatgagagtgaaaaaaaagaaaaaagaaaagaagggaagggagcatacgtacgaactatgtacgggatggatcgacaaagaacgtgccgctttctaaatataaatctatttggtatcttttatgttagatctaacggttaaaaaatttgggtccaccggattaaatgaaaattaatggttagatattttatttttcttggaatttctttaatttggtagagcgccacttggcggtctaggagtatttatagatgtgccatgtggtggtttattagtgtttatagggattttaaatggctttttagtatataataatcgatagatngatagatagatagatagatagtttgatggagtgtttgctttgctaccttatcaaaagtttggtgttaccaagttttattaggttattagcaaaccaaacagataaaaatgtcacgctgccgctgcacttgaactagttctgtgtctatctctgttctcccagttgtcggagcccctgaggccggcgagtcagctatacggtaaataatcaaaaagaggaggaactaatacaggaggaagaatatacattgttatctgtcaacaggggaaagtatctcgtgcaatcacttaattcg

SEQ ID NO: 78377 - DNA, 10123 bp, Oryza sativa
ctgtgtccaaattgcactatactaatgcacctttttggggtccaaattacactatactgaatttaacttgtttttcaaaaaataaattatatatgttgtgtggggaacaaaaatcatttttaaatttttgcgatttgaaatgtaagatgcagtacataggcgctacaaatcatatttgcatttttattctgaaattacgtatggtacagcttccatttgactaattgcaatccagccactttaatctggtgcatacgaatttgctgttactttgcccataccatgatgagctacaaaaatttggttatttgccaggtggtttgacctggggtggtagatgcagggtctgtccattaagttgctgaagtcgttagcgcggggcgctccggggcgccggttgttgaagctattgagttcagcgatgttgacatcctcctcacctttgcgcttcatgcctttgttcttggaggattcggggttgtcgcatttgggtggaggcagtagccacccaagttggcgtccaagtgggtgtgtcacgaccaactccgagttggcgtccttgttggcctagtcaagatgaacgcttgtgggtcctccacctgctaaagttttgcgggcccactacttgataaaatccccgttcttgtagccttgatacaaggatgccatgacgtgagagtccttgacatgtgttatggtgttgcgcttctccgtgaaacgtctgatgtagtcggagaaacgttcattatcaccctgaataatttgatatatagaggtcccaggggtgccacgagtgggaacgtgccttggaagttggcgatgaactggacctttaactcggctcatgagtcgatagcattcttgaggaggctagttagccaggcccaagttgccgaagtaaacatcgatggcaaataattcgccatagcgcactggtcacctccggcagcttggatggcggtggagtagactgacaaccaagaagtggggtcagattttctgtcatatttgtcaatcccatctgctttaagttggcaggccactgcacccaacggagggtgttggtgaaggcggggaccccctctgcttggtcagggtgatggaagtggtactctatagattgaatctgtattggtgtgtgcacaacacgacgtgtgaatagcacgtgctccctccggtttcattttaattgacgttttggacaatgacacggtctacaaaatacgtttttgaccttatttttctattataatatatatatatataataaataagtgcatgtttacttttattacagtgctttgaaagacaaaattatatatgttgttctagttcctttaaactaaatatttttaaaattattggtggtcaaagttataaaagtttgacctcaatcttattttaaaacgtcaattaatatgaaaccggagggagtagtgcgtataaaggaatcaatcaattacccgtcttagagtttccggctccctttatatagacctagaggcaaccggctaaggtcggtaaattatcccttataatctaggtatttatcacctatttatatgtgataagatttatagccctattttcctataaacatttttaatccctctcaccatgttacatcatgtcgcattggctttaggcctatacggcccatcctgtgtaatacggtccaaaggcctagtctcgggtacccgggtacccacactagcatttgtgctttccaaaatgcaggttgtaattacaggttacggccttgaatagacacactattaaccttcattcatatatgcaccgtacaggagatagcgctccaacaaaatgaattatgaagttgtcaagtggtaagctttcataacccaaatgtaactggcgttaagttcactgaattatggtaggcttcgataaacataaaaaaataaaaaataaacgagctctgggtacagtgttgggataacagcagtagtgatctaaaatacaactgtatcgagcatggttcctagcgtctgaactatgtttgatgacatcaaattggagacatgctcttccaagtgcttcttagcatcttgccgtcccacatttgctatcgctaatttctcaggcggcagctcatcctcctcttgcaccgccttgttgtacttgatagcaaggttcagcatttcctgcaaaagataacacataaatattataaatgataaaaactacagagatgaagtttcaacattgactaaaatgatcgttcaaaatagaaatacacacctgaacagtctgctcattggtctttgaatgagtgtcaaacctcttcagaatcaatccatcggtccatttctttttgtgcaagttcagtaacatcttttcctcaagctcatttttccggtaattgattgcaattgaatagtagtgcctgttcagcccatgaataagagcctgacaaaaaagagataccctgatcattcataagtaataggaaaaagaaaacatatgtagaagctccaacattattacccacttacctgaatagatggcttatttaggtgcccaacatttgatgttgtctgtcgtggctcctgaccaagcatcatggtctgagggttaataaggcgaaatgcatcaatgacaactttccccttgacactttggatgggatctatcacgacggcaactgccctggggtttaaagcttcaaaactctgcatgttcaattttgaagatgttagacgtaaatataacttgcactaagcccctttttataaaaacgttaacttgggaaagtagcacttgacactttgtgaaaaaacaacaaacatatgcgaaatttttgcaatagaagttaaggtcagctagatgatcatggtagctgactgcagggaattaccagctaccaatgctgatatcaaattgacccttctctagtttattagatatacatatagagttagcttctaggtttcaggtgacagccttatataaagggtggtgaataatcattaagtagaaggaataagaacaatgaaatggccttctcccaaaggtattatcatcttcatctatgatctcatcttttctcctacatccccccccccccccaaacattttatcacagctctattcaggatggtagtaagtaatagcctcaatgattaagatttatcacatatattgtcacgcattattctgggatctgttttccaaacctattccctgcatcaggtgtacaaataagctataacccaaaatatgcatcagggtgatatagttgaattcaacccagaagctccagtcaggaaaagccattgccaaaagcagccagtaacagcctgacatggttaactgaacaaaggctggagcgttcgtttgaatgacagaaaggagaggaagtcctcgttttccgcgcgcacgcttcctgatctactaaatgttgtgttttttgcaacattttctataagaaagttgctttcaaaaaatcatattaatccattttctagtttgaaataatgaacactcaattaatcatgcactaatggctcacctcgttttgagtatcttctccttctcttttcctctcctctaaaacacagccttaatggttagctaatctgcctaacactaggtgtcacgtgcaaggacgtttggagacaaaggggatatatttgattataatggtcgggaagtaacaggaaatggccctgaaaccaaatggcgcgacggagtcgaatcgacgccgtgccaacgagacaggactatgggccctaaaataatcttgatctaatgcctaacctgacctgggctatagggtccctacttatatagatgaactctctaacctaatcccatcctaacagactttatccaactggactactctatcctaacagactttatccaactacaataagaaggccagtcagccagtgaacctattaggcccatgacaccgtgacactagcatggaatatggtaaaagccagggaacacacaaacatatggcaatactaatagaaatcaagaatatggtaccccattcatttgaaaaattagttactatgtccatatttcattaaaaagaataaaaaatgtaatgacaaatacaggaatcatctcttgttaaaccaagttacaggattcctttcatactgaagaaaaaatgtctgaaatatgcaccaaacctgttgagtattgatgtcaactcctgaaagccagcaaccaaatccaggatgggaatggtaccaacctaccaccatttctggcctgtaaaagcaacgaaattatcaagcttaatttgcttgcccacagaaaagctgagtaaaaataattctagataaccaagcaaaaggtgtcgaccaacagagcaacaaaatatctaaagttatggccaacaccaatatccaaataacttaacagaagttgaaatagaagaaccaaagagataacaagatacaggatatgctgtatgagaagacaggtgttctttctttccaatatgattactttcagttatgatctaaatgcacttgaacacagagcttttcatgtgtgaagaagtgctcttaacagcaagtaaaatttatcattttttctctccccgagaaagcgcaatcttttttaacagcacaagtaagacaattctcacggacatcgtgttatcggcgctacgttatatgcggctaggaatctatgactattattacaaaaagaatcaaatctagaccttgattcttcttcttttttatacatgatatatgatacagaaaagagtaaaggcgcaattaactgaccaccactaaaacataagggcaagtcttagatcttccaaattcaggcatatagcaacaaacgatgaaagaacactgccaatcaatcaggcaaaggcaaaagcattattacctcccggtctgcttgagcatgtcgagcatgttggtctggaagacatggtcgacggcctcgacgctgaccccggtcccgctctgcggcatggcgaagacgtcgaccaccctgaccgtgtagtcgtcgacgaactcccccagcatcagccccatcacctccatcggcacgccggccctccctgcggcgcgcaggcgggtgagcaaaagagccgcagaaaccctagccaagcaggagagggggggacgcaccgtgcttgagcatcttgaggagggcgagggaggagatgtagacctgctcggaggagtcgagcagcggcgagtccgacggcggctgccccatgccggaggcgccgaagatccgctgcagccgctccatggcttctccccaccgccgccgccgccgccgccgccgattcttcgcttcgcttcgcttcggtagtttcgtagggttcacaggatcttttttcttcttttccttcttttcttttggatggaggaggagggggagttacgctgaaataaccaaagcatgtaaattttaaatggagtaaatttcacgaaactactgacactttagctaaattatcataaaactacatatttaaatatgatgtatcacaagactatagagttgacgccaaatttatcacagaaccacaaatttaaggttaaatatcacaaaactacaaatttagtaataaaattatcacaaaactatacaatcggaatgagattctctgacgcagtgaattctacgtaagagggacgtccggtcttggatcgccattctttgtgcatccgacgggcaacaactcttccacgtcctcagtcgtaggcccataattaagctcgattccagcacatttgcatcagtgattcacggcgctcaacagtcgggatctccggccgccctcaccgccatccgccgctatcgatctctcgctggtaaagcgcgtacgcagtcgatgatcctcagacaaccacatcatgctcatcgacgaggtcagccagcattgaggacaaatcgaagggaaaaaccactccttttctcttcaattcgcatacagagaatcctttcattggtcaacatcgtctgcactcacttggtctcttgttttaacagaagggggaaaaagtatctgttggcaagctctttttttttctttaggctactcggggagattttctaccagcaagattttcaatcacatattcacatactgaaggcctcagcaagattttcatccacatcccaaagatcccggcagtggtatcgcgtcccccatgtgagagtcgaggaccatcgagtgtgaacgcgcttcaccagtgagagatagcggcgacgatgaaggctagagatcccggcgccgcgattgcttgccgtgaatgggctataccaagcaagcttatgggcctacagtgaaggatggacaaagaacggcgatccagggcaagacgtccctctcaccctctagcgtagaattcactatgccaggggatctcgttcctatacaatcatacgtactttgtaggcgcacatattttacaaccctagttttactagtattatttatgcgagttgtacatataaccttcgttaatccagcaggaacgaaatatcataatgaacattgacagtgtttaagaggaggggataataaaagaagatatgtaaaatgaggtgagccaagtatgttccatgacagttcataaaaagtttaccgtgtattacacgttaatacatgttttcctttaatttctaaacatgcaagagtatatagacctgcaatatgtggtggagacgggagcgttcaacgacatcacctatcctataattacccactaaataatcacatgattagctaaatagttgtgttcctagatgaaatgtggttcactcgcactaactatcttacccatatattaatcttgtcagaaaaactactgtacgggatcccatcccatcgacgcacgacgggatagaccgctccatatggatcaatcaatccagacttcagccaggccactcattgctctagtcttatcctctttattcactttcccctttttctctttccactacttagtagtttccaccatccatggattcgtacaacacgatacaagagactgtaggctatagctcaggcaagacaacagtgaggctggctgaactccactggcgttgcaagcagtgagaccttcctcgcgtgcgcaagtagcccggatgccatgccgttggttggggcaatatcaagttgagcctttgccggtgaactttgctcatgtggttcggcaacaataaccgtgtcgacgccattggtggctagtgcctggtggcctctagtgtggttggccaagtgctccacaggccaacgctgcctctaggtggttgcttgcacaattgcacgtggaatgaagggtggcaggagagtattcattctaggagacacatagagaaagatcaacatgctaacaggagatcaacaatagcatgtatgagcaattggttgttgattttttttcactcggaatttattctcaaaattggattttggattttcttaggttggctttcctttggatgcagcgctattcggttacgatactctttgtggtatcatcgtgatattccagtggcatcgatatgatatttttggtggtatcaacatggtaccctaacggtatcggtacccatgtggtatcatgatacctcggtggtaccatagcatggtacctccggtattggcatggtacccggatggtatcggcatggtacccgggtggtatcatgataccttggtatcatagcatggtaccttggtggtatcatgatacctcagtggtaccatagcatggtacctccgatggtatcatgtcatatggttcaagggtatggcatggtatcgggggtggtgttatcgtgtagtctagctaggcggccttttttttctctaaacaagctagctggtgcatgtgtgcctcgtggaagatggtgcttgtgggcctcaaatcggtgagaacgcatcgagagttcgagaaaaggaggcgctaccacgctacgcgctagagtatttgtctgttagattcattaactaccccgtaacccttacgggattccgtgctccagctgccctctaactttatttattattttagaaacttcattaattactaaattaccaaagacattttgatagatcaatttcaaacatacattgtcttttctggaatttctgctaggttgccaaactacaaaagcataattaccgctttacatatatgagagatatgtagtatatatgttgttgtgctttctatcaattatcttctttattatagtcacatccaaatcttgattccatggtagtgaattgtagtatcaatccatatgtgtagccatggacccatatcctctgatgtatagtagcaaggttagaagatctacaatgactccaactcctacacacttcttccctcaaatatctaatccctttgcactgtagaagtaggacgacacaaaagtaaggctgtgttcaggagtgagggttggtaacccttactcaccggcacgcaaaacgaagtagcgtttagcgcgtgattaattaagttttagctatttttttaaaaaaatggattaatatgatttttaagcaactttcgtataggaactttttgtaaaaaagtactgtttagcagtttgaaaaacatgcgcgtggaaagcgaggaggaggagttgggagcatgtcctaccgaacacagcctaaggagcaccaacacccatggccatgtttcttctacctatttcctagtgtgattgtagccactgcagcaacatgagcattctcgctcatctaaccgagctggatagaactcgagccccactctccaatgagcttgacatgctctcataagtggtgtgtaatagcagtttgaggtggcgtcgtggtgcggctcacgttagcaagagaatcaaggctcatccagcaccatgaagcaggattgcatgctccaccggtgcccatagaaatcaatagcaggtggttgttgtttttctaccaccgctgcttagtgatgtcaagattaaagtgggccaaattcatcgaaggacataaagaaacttgctttcaaacatgcagacaaaaataggaaggaaatgtgggataaaaaaaaaagagacgtttaatgtgtttgaatggtagatatggacatacaatatttctctaacttttgctattgcatgccagaggatccgagtccgtatagccaccatgtgacagcaaatttgcatgtggtttatgtgtacataagacttagttatatgtgcactacacatattacgttttatgtgtcgggagaagggggggttgaggggttttgaatttctagctcagtatagaaaatgtagcaatttaaaattgttcggatatatgtgaagttgcttccatctaataccatatcgtcatggagtggtcaatcaaagttcagccttttgccactgacaataattttcttgtatgatttttcatcttcccatttatttttctatacttctttaaaacggagcagtgttggtgatgagtggtgaattaagatgtggtatatatacataaaataaggataatactgtaattatctttaattaaaatccccgttacaagcattatatgctgctagtagtgtaacagctcaagatgcatatcccggtccctgtcgccacgagcacggcacgatacgaacgtccgtctctgccgcacgtgacggtggagcgcctgagcccctgatgcgccccatactgccgtcgccgtcgccccacgtttccttctccagtttcccacacacactcacccctggccctgggcactggcaccaagcatgtttgtttcgtgcaacacctgcacacccacgacacgtcgcgccgctcatgcccttttcccacccgcacccccgaacaaacacagcaatcccatctcactcccccccgcccgatctcatccgtccacaaccgaatccaacggcaggaagcacatccacgtggaagatcactgcaatatcctgtttctgcaggggggtaaacggaagatgaaccgaatagtctacttgggtgtattgcgactcatttttttttatatttattttttccataattacttcctctcgtctctgtctcgtcctgtctttctccgaggaggagaaacaccggagggagggtgggcgacgaggaggaggaaaaataa

SEQ ID NO: 78378 - DNA, 3089 bp, Oryza sativa
ggggagctggagctcgcttccgccggcggattgggtggcggcgggggcgacgagcttgttgatcctgaccagctcacctacatcgtaagggatgctctcccattggtgtttttgttttttaattattgttgttattacttttttttttgagcgtgtgcggattggatggttgatgagatggtggtggtaccgtggtgttggtcgcctgcttgtttttgcgcatcagcggcaatgctgtcatctagattgttgtggcttcttgaaattttgagtttgatttttttctctgtttgtgcacgtactttcgattgcaatgttgtcatctagactgctgcttcgtgcaatttcggggtcggtttttatctgtttctgcacgtagttttggttttggttgataaaggggattactgatgagtggtgtggtccgttcggtaatatgagctgatcatcaagtcatcgattttcgcgaatgggttttgctattttccagtaaattgccgccctccatagtgagaatgtgttagcatcggctgatatattggaaattgtctctggagtattagcttggagctgacatgtgagtgtccatctagttggtgaatttcctctctatcatgtgtatcttttctggtacggtggtacgaccttctggtgagaaccaaagttttcatagcacagtacttccgtgctactctgatggattttggtaagagcagctgtaacagcggaatcagcacataattttgactgcttgttatcttgtgactggcagcataatgttttcaagattgatttatatagccatgtattggttaatttgcttgtgacaatttgcaaggttatttatctattgcatacatagaatgaagcgattaacttgtgagttgatgcgaacgttatctaggccattgacttcttttatttttccttcaaattcatgcttctaaacaatctattaaaatcctgcctgtcatgccaaagcatttgtcacctataagctcgataagttacttcaataagcttgtgggcatctcacctataagctcaccaaaccttcccataaccaatttgttcgtcaggtaaaactatattataagctctagaaaatataatagataaacaaaaggaattccacatatatgccaagaaaaacgtttagcattatcttttgttgcattagttggcagcccatgcatccacattcattcatgcttcacaaaagttttagtaactttgtttctcacttgatctttatagtatttgaattgaaaaaccttaagcaacatgaatttctgcacatttggatgacttatatgcgatagttgcatttgactaaaaaatttcttatattctatagtcctaactttattattattaatttattgattgttattttgttcaacatgctgcacagttcaagaattgatagtctgtacagacacaagaacactggtttcggttagaaaagtatgctgactggatttttaggatgctgtgaaatctatttgttcactcctagataaaatcatatataatccagtttatattcccttttatctcttttggggagtttcaagttttctgttattttcttgatcaccatagggtttttaactgtttatctttaaacgatataggaatttccagctttccttgtttaccatgattatttggaggggggtctagtattatgatgtatgaaggtgattatattgactgatagtggattctctgtcatgatgaatgcagtattatgttgtattttggatttttaattggatgcttaaaacttgattcagcattggaagctcttataatgtaattgtcaatttgttttgcggcttgatttgcctttgtctgtgttgtaacttgattcaccagtggttcagaaggacaaatactctactccatatagctgatgatggtttgcattctgtgtgcaagtttaattatcagtgatgctacttttggcatagggaatacgtaactcgtatagtttttgttggatccagctgtgggattttatctctgttatgtgatgcttctggacttcacgggtcggacctactgtacctttttttgtttggatggtgaggaattatagggaatgagttattctttctgcagtatggctgctgctaaatgctaatgaactccagatgttagatcttcaaccttctgtttccatatttattcccaaagaggctttctctttcacagatggtccttatgttctgtacagtcttaaagaagtagttttctctttgtgaatgatcagcatgaaataaagtatgatgtatgttgtacaggatgaaaaacttcaaaatatcctgggtcatttccagaaggagtttgaaggtggagtatctgctgagaacttgggtaaggggactaaagctgtgtcacatttgctccgtggagctacagttgtattgaactactgatgtatgtgcaaaatcattaacactgcatagggtcacaatatgggggttatggttcattcttgcctacataccagcgctctcctcctgccttatctcaatctggaagccctgcagttctacccaaccatggcagtgcctcgagatcaccatatataccactggaggtatactgccgcaaacttcaccatgcgttgttgtcttcttagtattactgcctaatgtttgcaccctgttgtgatatacttccagagtgtacagaaaaaccattttgtcaagcaagctatagatggaaggaggaaaaacaattactgccaaagaacatccagtgagaatgatagtaatcactctcaacagttgttgaacagtggtcctgagcagaagacagcaaaaatacgtatcaaggtgaacaataaatgcctagaaagaaataatgctgctatctacagtggcctgggcctcgacatttctccttcctcatctatagatgacagtccacaatggagcatcgaggctcctgaatcaaaactttttcctgatgaatctgcagataccatttttcaggttaagtttacaccatcaattcaatttatcttggcaaaacctctggtggttgatttttgataaataatccatgggctgcaggaa

SEQ ID NO: 78379 - DNA, 574 bp, Oryza sativa
ccccccgcacagtacaaaatcgccctagcggagggcggcaagggggccgcctgcaaatttcgttgacggccgtcgcccgagagcgaacggtcgtctgccacgtcactttcgccgccctctgggatagcgatttttaaaaatcgccctcccagaggacggtaggcgaccacttctgtcaattttcaaaatgaaaaattatttttgtaaaacttttaataaaaaaattaaaaataaaaaaaattccaaatcagcccatggaatgagaacggaaattctcggcccataaaaatatttaggctggagacgtgcggcccactatagttgatgtggttggtttgctcactgacatgcgggcgccttcatcatgtgggacccacttgtctgtggctcatgctcgcgtcccccatcacaactcggtcactggtgccacggctgcttctgcttgggttccgggccatctcgatctcgccggagtcgcgcgccgccgtgcggaggtcgtccgaagcggaagcggagcgcgctcctccggtcaccttgggtgcgtgctctctgtgctcctaatccttcttattcc

SEQ ID NO: 78380 - DNA, 5334 bp, Oryza sativa
atgcaaaaagtacggccgcaagctctgagggggcggccaaattgcaattagccccttgccgccttctgtatgggcggcaagggcctaatcgtaattttggccgacggcggcagacggcgcggtcgacccaccgtctgccacgtcagcttgccgccccaatggtgggtggcagggtctatttttgcaatttttctcgccgatagattatttctgtaaatattaaaaaaaaaatctaaaaacgaaaaaaattctatcctatttgagggagaagctacagtgtctaatagaatctcagctcccttaaaaagttcagattgtcattacgagaatatgtaggtgtagagtccagaaaataaattacaagccaaaaacaaaaaaaaatctttcatggtttttagaagctgactactaacgagtagattctcaaaatcttaaactccccacaaacaaggcttacgaaaagtgacacatcctgctactcagcagcggagccagggccccggcgaccctgggcagctgcccgggctccgccggctgcatgcaaccgtacctcattagattaaacataattaccttgttgatcatcttccttaatcaccttatcaattgaagcggcaacagtatatactccctccatattgtaatatatgacaccattgactttttgaccaatgtttgatcattcgtcctatttaaaaatttatataattataatttattttattatgacttgatttatcatcaaatatcatttaagcatggcatagatatttttatatttgcacaaaaaaattgaataagaagaatagtcaaacgttggtcaaaaaatcaacggcatcatacattaaaatacatagggagtatacagtatacatacttaactaacggcttagcgaaaaatagcaaagcaaatgttcactctaaaatgatctatggatttgtatagacttgtgtatactatatactatatttgttgaacttgcccaggcttacaaaattttttggatccgccactgttgctactacaaatctaaacaatatgttcatatttacagcactaggatatactaagttagtttattttaaaacagatgaaataacttttaacaaatacccatggtatctcttaaataaaaaaacaaatggaatccaatgaatccacggtaaaagtgttatctcttgcgaataatcgtcagtttatgttgtttagaaaatattaatgataagcgtagaaatttcttttaagttgccttattgttcaaatttttttttaattgcttgcactatgccagatcaacccatctttgatgcctacctatgacggatcaaaatgtatcatcatggatgatatcatctctgatgggttaaagtaaatcctggcgtagatgaggctcaagaaaatgccctgttacagtaaataactcatctatgacggatctatataaggacccgatacataacgtttctaacgagctcacatatagggccgtcatatatgacctattactcgtggtgggtgttgagttttcacccgtcacgagtgggatacttcaccttaaacgtgttcaaatcttataccgttgatggtgattaaaaaaaacccacccccaccctaggggcccgctagcctgctcgccccttctcctcccctcatcttctctctcttatatcttcctccgccagcgcacccatccctcccgcctgatcgccacccgccaccctccctcccgacccctggctgtcgcggccttcttcccatgattgccgtccaccggatctagcctccacgaacgttgtcatctccttcgcccactgttggtggtttgctcgtctcgtcagccccgagctccttggcgccaggtccggtctccatgtggttggggaccaacggatctagacgcctccatgcatgctccgcttgtcgccttcttcgccctctgtcccaaatcgtcggccaccacctcatccagatctgctcaagcgccgacaacccgccttagcacctttgacaacccgcatcagcaccttataacttataagtagtgggagaaggtgctaaggcgggtcgtcggtgctcgagcggatccgtatgaggcagcggttgacgatcttgggacagatcaacgagaatagaacacgaataaaaaactttatcgagtagtggtttctcatcattgtcaagctcgacgccagaaactgtcattctcttataaggtgcgctaaaatttaaattttaaaactatttttcataaaattttattttaaggattggtttttaaatcattaagaacacatatataaaaagtttacctataaattattatttctactaataaatggtacgacttataagagcaagtttaatagtatagtcaactattagctccaaatcatctatagtcaatttaatatccaattcatacaatagttacctataacatatactccctccatttctaaatatttgacgtcgttgacttttttaaacatgtttgatcattcattttattaaaaaaaatcaagtaattattaattattttcctatcatttgattcattgttaaatatacttttatgtacatatatagttttatatatttcacaaaagtttttgaataatacgactggttaaagatgtgctaaaaattcaacgatgtcaaatatttagaaacggaacgagtagtatacaattaatacctgatcctacttgtcatacacatatttatcttatagctcgttactcttctctctcatattttatcttctcgaaatatatttatagctaatttatagtccgctattgtacccgctctaattagcgtcaggcgaagcttctcaacagaaaagccaagcaaacgtttcgggctacgttcacctgtgatcagaccggcccaaacaatgatgggccgagccaggccggggccgggccgggttcccataaatatttaatgctacggttgaaaatggctgtgccacagacaggtaggtcccacgggcacggccacatccccctccccccttcttccatcctcgcatcataaaaatccatattcttctccttcttctccctccgcgtcgcattcgcatcacccccccgaaaccctagacccaccaccaccaccaccatccccgagctcgcggagaggcagcgagagcgagaggtagctgctagtaggcgtcgggcgaggagatgtacgcggaccagatctccaccggccggaagcgctccatccacgaccgcatcgacggcgaccagcccgccgcccgcgctggcgccggcgccggcggccggggggcccgtaacccgccgtccaagaggtcagcgcggagcagctccagtctcctcctcctcttccctccctaccgtcctctcctccgcggcatatgctctttgcatctaagtacctcgctctgttccttcgtggctggcgcgctgtgtgtagcttaggaatacgcgtagcgtagttttgatcttgtcgcgaggaatgattgtggcttttaaagcttcggtgtcctcgtttctttgttgtgagaggagctgaatatcaccgtgtttgtggttgaaattgtgctgtgcgtgcccacccttttttacttcctgattgcgtgttgacaatgatcttgttgcgggcgagcggtaccacgcatagtttgtattgataccaattaagtcggtgtaatgcgtgaatttcagttatataggcttttggtatgtttgcacttggagcttctttgtttggaagttaaaagtccaaaattttctcttaccaaaaaaggatttgtgattccacgtggtgtgtacggtagtgtcggcttacagcttacaacaggattttcctgttgttactacttatgacttatgagatgtcctaaccaagccacatcgggtctgctgtccttttttgttgcaaaaagtcttaactttgaactagttatagtaaattgtagtgcttatagaaggaactacaacttttaagtagtcgtttggtttccatggttattagtgaggtattttccagaagacagcggtgcctcccgatgttggaaagtcagcccttgatgtttgatagtttttttccctaacaaaggtgtccgaccatttgttgtgttgatgcttacatcagttctattatcgtgttccaactgatcattgtaggcaaaatttgttgaaactgagccatggtatgtttaatcctgtttataaaaggtgcatgatctttattgtcatgcttatctagaagttagtctttctttattgaatcacataacttttattgtgcacaacactaccattcctgtatgcccatttcacttggctagctaattattaaaaccgtagatccttatattctgtaggcaacggcaaactgatgaaaaatggaagcatgatctttaccgggaagacgatgaaccagcttcaagtaataaaagaaagaagtttttgatgtaccttaaataaagacaggccttttgtattcttatttaattcttatctgcctgtgcattatgttaagaatcaattgatccacgggatttgcgattgaagcttcagaagaaaagctctcagcaaagctttgctggccaaaggggttctggtgtacgtgatctacgtgagatgctttctggaacaatgcacccacagccagtcaatgcggaccctccaaaggcaaagccatcatcagagatcgtgaaagtcacaaggcgtgaaaatgcagatgtaatgcctgtacgtcaaagtaagaaagtaccaaaaccgacgtcatcgaagaagacatctcagccgaaggtaagggttatgtttgttgtaatgggtgccacatgtatatagttttccagtatttagttggatctcattctcagttgtttgcaattagcttgagagactgcttttttggtaactacttttattttgatgtccagaatgaaacttgtagtaatagttttgagaaaatttcttatttaccatataatataactccaatcccttattttccaatggaaaattgatcttccctcgaatgccactagttcattttgtcttcctttatttgccactttcgtcatcttgctgttgactgtagtctgtactgcaccactggggagcggcattattgatatgcgaaaatcttttcttcttcgattagcttcagcaaggcagctaatccctccactgcagctgtttcctcctccttgaatgcatggcgagcacttcccttctgtcaaagcacttgggtaggtgtccttgttggtggtgtcaatttagcctaacttatcaaacaaaaacattcgagttggtggtgccaatttagccaactcaacaaaacaatcgagccat

SEQ ID NO: 78381 - DNA, 616 bp, Oryza sativa
  unsure (1)..(616): unsure at all n locations
aagcgcatatatggccaaggcgtcgctagcgaggtacgagaaaagaatgaaaaacctatagcagtgcggaatacggaagaacttgcgcatccgccaaaaattacaagaaagtactgtacgccgaggctgcccaatacaagaatgcgcagctgccactcctcccaccatttcacgccgcttgacaaatccatcgtctacgatcgaatnacagtgggctagctcccgtctctctagctctgtccccttttcatctacgtgatgttgcctttacatagtcagtcaggcacacacatatatatctaatgggacttatggaggagtaattttcaaaacttcgcgtcaactactgcttcgatgcttccttacttgcatggtcctagagaaatattcacgcactaatcaataatctcgatctccattattaactgtgtgattgatcgatcctggagcttttaagtgtagagtataagaatcagttttacttgtaaaacatgttacgtagatctcgaggtcaactacgatcgattaattctataaaattacaatatatatttagttcattaagttcctgaacaacattgaattcactaggacatgctcagccaatttcagtttt

SEQ ID NO: 78382 - DNA, 1157 bp, Oryza sativa
ccccaaacatggcctaaagcttgttgggatctggtagatccaacattgttgggacatggttctagaattactatactcaattgatgcttgatttaatcatgtcttgtagcctagactttttatccccacataatctagaaagcatggtcaaccaagcattaatctatcctccatccatccccccacaagaaacaatgggtacagatccacgatagctgaattcttcatgctggctcttggctctgagtgctctgcagaggtggaggagatggattcagctgtaacggctgacttgccaaaactgctagcctgataagtgatgtggagaagtgctgccttcgtaggttcatcttgttgcctatgcacgcactgatcttctgcagatatggacaggagatagagattgagttcacaggcagcactatgtttgtgagggtagaaaaggagttctttttccaaagatgtttaatagtcccttgacttaagggaagacaaaaatgaactgatgggcaatggcaaatagggtaagatcgtttttcacatggcaagtaaacaattttggttagcattttttttttttagaaatgttatccctggttttattgaaagcatggttctgttgattgggttaatcttttatggcaaatagtgaattttctaacacttttggatttcttgtgctgatgtttgtttcactatgttgtgctctttggagataagagtaactccaggtcctgtcatgatcttgttgtgtaaataggtgttgaattttaatcttttatcgaggaattttgggatctgttcatttcattgtcatttaaattgccccttcaatttggaatgccttctattttctgttttaagagcgccattgccattcattatacatttctgacttctgatcctgtatataaaatgatgtgcatagaattctggccgagcccactagccactggcttactagtcactgctatttaatcataggtacttctatagttggaaacttgagttggtttggtaattgggagaaggcaaattggttatatagcatcgaaagttaacgtttttggttttatagcaccgaaagataccgttcattttaatagcacccaaagttcaccccgtttccatttttaacactttcgtcaattctcgat

SEQ ID NO: 78383 - DNA, 925 bp, Oryza sativa
  unsure (1)..(925): unsure at all n locations
cggctcaacggatgcagcaggtggcggtgcgacgggtgctgcaccgcagcaccggtggcgctcgtagtctcggcgtcattgcttagtgggattagtgaacactgaacagtaattagtatttttagttgttgggttgttaagcatggtttactggttgatggtggtcattgtactagtaggccttttggccactagtgctttattgggctaggcatgttatccgggtattatccggatatttaaccgggtaatacccgtatttttaccggataatctgtatccgtcggataccgtcctcccgaacccgatctcatatccgatagaaaatacccgtattcgaacccgctacccggagaaacttccgggtacccgaaatttttacccgaaattgtcccgaaataatacggctgggcgggcgggcgggaaatacccgccccgttttcacccctactcagcagcacaacgtgccgtncacccacaccgnatnnctctcctctcctggtgnccgcaccgtncttcttcgcccccgtngaattgnattccagcgagcgtgcttacgcctgcgccccgtggcctccgcgccgggcgatcccgcttgcagtgccgcaggtgcccttctgccccctggtcgccatcgcatgcctcttctgtttccagtggaactttctctcccgcgtggcttcttctcccgtgcctgcttgcctcttcgagtctgctgaggggacagggatgcgatgcagtgcagatggttgatcgttcgattcaaatccaccggccatgagaaaatgaggtgacgtgacagcatcaggaagcagagaattcctagtagtggggatgatttgtataggtatataggattacataggctaaatgtagagtagaactaaatttttgttgttaattaataggttaaggttaaggtgtc

SEQ ID NO: 78384 - DNA, 18186 bp, Oryza sativa
cgaacgttaacgtgaaatgcaatatatatatatatatatgtatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagaccttgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcatacatgactattttagtcttagcatgtaatattatttgagttttaatataagattactttatttgagattagacttagtatataattatttactacggaaatggtgcgacaagtagcaattgactattggtgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagactagcacgtaagtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagtcagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaacccccgtggacagaagagggcacgcgggcaacgaggtgcagcgaagaagctcgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaagaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtataggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggtgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgattctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatagattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatatatacatatatatatatgtatgcatatatatgtattgaaacatatatatgcatggtttatatatatatatatatataaactatatatatatataaaccatgcagcaacagggccatgcaaaaaaaaaatggtcagctcgatctttagtcccggttggtaacaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgatctatctatcgtttagtgatgatttgtctgactcggccagaactcaagcgagctggattagtttttactacttaatttgatctgtttcagttggtcccatgccgaaaccaccacaatcttgttcagtatgatggagtgaacgtgtattcctgtgcggggcgtcgcatcgcatgcaaacggaaccgatcccgcgtgaggctgcaacctagcgctagcgtcggacaaaaaatatacggaagagaaataggagaaactcaaaacccaggtaaacacagatgacgtaacaaaattctgacaaaaacatcttgaatttttataataggtaaagataagtagatatttatctataaacttagttaaatctgaagtaatttgactttgaccaaaattaaaacaatctataatcttttttttcaaggaaaaacgatctataatctaatacggagggagtagcagagaagagatgcagtatatcggtagagagcatcaggtcggaattttttttctctttttaaaggagcgcggccggattggtgttacggtgttttgtggcagcgcgcgcgaaccacgcggttacggcgagttcgaatctaattcgactattcagtagtcgagttcgaatctaattcacagcgcaaaacgagccttcttcttataaaatagacaggcagcacagcaacacaggccagcaatacaccagatcgatcggtcaagcacaagcgctagccctgcaggctgcagtttaacacgcgaaggtatggcaccaatatcctctctaaccccttgtagttattccatataatgtagttaactcgtgactttgtgagtcttttctatggtttctggaaacatatttatctctatccttctactacctccgtttcataattttaatgcatttttttctaattaaacttagggagtagctatatttatgtcgtcatatttttcaccaaaaaatagtcggcatatatttacattgtaagttcctataaattacatatgtaattttagcgtatttataatgtaagtctcaaaattacatatgtaagtccgaaaattatatatgtaattttagtgtatttacaatgtaagtctcaaaattgcatatgtaagtcccaaaattacatatgtaattattatgtaattatagtataattagtatgtaatcatctatcatcacgatatatgtgtggaaataatcttctctcacggaagcacatgcagtgggaggcctgtgcggctgtgtgaccaataggcatgtaatccgactgtaatcaagggaaatttatggcgacataaatgtagcaaatccgttaaacttatttagatttaactaagtttataaaaagttttactccctccgtttcataatgtaagttattctagcattttccatattcatattgatgttaatgaatctaaatagatatatatgtctagattcattaacattaatatgaagggacaattacattgtgaaacggagggagtagtaatatctactatattaaattagttttattaaatttagcattcaatatattttgatatacatttgttttgtgttaaaaatattgctatatttttctaaagatttaatcaaacttaaaaactggttgagtagagtaaaagttaaagctaattataatatgaaacggaggagtacctttcaaaaaaaaaaaacgtggtcagtggtaggtgattattgttaatattctcttggccactgacgatgtactccacgtaggtcttttttttttcttttgccttttctgttttagtcagctgtacgttattttgttctaaaaatctggcgaacgtcttatcatttttaggtaaattaaaaaatattgtgagggaaatggagagcgttttttatgacaagctagggaaaaagaaacagatcccatctgagcacttatttaccttttaaaatacaatttaattttcttgtcaatatgagcagtcttataacctttcaattttctacaccattatagcagaggaactgaggaagaaatgctagctcacagtatggagattagtaaggaaggccaagaatatttagctcttttggatcctaatattgtgcctgtgctactatttgttgattacaacgttgatgatagtgagtataacactgatggtgaagattattccatcgatgatgagggtgaggagttagatcacgcaagcaacaattcacttgatgaggatatcaatgaagatgctgaagatgaggaagatggtaaacttggggaggtagatgataggtgtgaagaagataatgagggaagtgaagaggatgtagggacagatgaagttacggataatgatgatcaggaggaagatgacactgtgttcttctacagtataaccaaaagacaattgatgtccgaaagagtggaggaattcaatacacacttctactggaccacaccacagggctggttgcttatggtgcatcctgaatcacataaagttttcttatggagtcccttcatagatcagaggatcaaccttccatttgatgaagacggtttctttacaaataatacagtccagtgcttgttatcgcataaaccgactgattcaaactgtgttgtgctagtggtgaattgtagaaacactatattttggtactgctatcctcaaggacatacatggttcaagcatgagtatcaatcaagtattattagcactcgtgaaagccattaggacgtcattaaaacgatgaagctactcacagcaattaatgggagattctacacatatttatgtaatgataaggcaattgtggcacttgagttcttgccaaagccaacatttagaactacgccggttgaggatgcaccaaatccaagttattggtccatttatactagttacttcttagaatcttgtggagacttgtttatgttgtcatacaaacatccagtgttatgtgctcaaaaggtttcgcagattgaagttcacaagctcgatttatctagaagaatttgggtgaaagttagcacaattggtaacatggcattttttgttgacagtactgattctggagtatcagcatcactcaatgcagaagatgttggattaaagagaaattgtatttattatgtgagacctaaagataagggattatatatttatgacatagaaagaggaactactagcgtacacaatccaggggtagatctagccgattacctgacacctgacattatgatgactccattatcttgaatcattcgcgctatatatgttttattttcttttgtataatattctatttttgtaatggtatattttggagtgaaatatatattggcacgttggaagagaatacaatcttttatttaatgctacagtacaactttgccaggtccaaacgttttagttatatttagcggattaatgccggtaaattattcttgccatgtttttcaaatatgagttatcaaaaacttatgctacaccggtattacttagacattcattctaatttatttgttagatttagatttatttttatctttacttattataaaaattgaagatgagcatgtaatcatccttattttcgtctgtaggctgactttggagctgggatgccccgtgaacgggtcacacgattgcgcgtgcctgtcgtcttactcgcgaacacgtcgcgcgcgatgggcaacgtcaaaacgacgttggactaattgtccgttcttgtgattggccttttcagcgtgcgtggatccgttgcaaactccgaaactcgtgtgttctatcgtgtgtggtcgccagccttcatcagtcctcatggacacctaatcgcatcaggattcattcccgtgttcgatcacatatcaatatatcatgacaagattacatctacgcaaagtttaaaagtttttctcattccattgcaccgcggagccatcgacccaaccaaagttgcacaaaaatatattcctcttttttaagttatgatgatgaatatactagcaaagtcccggtgaaaaatatattgcagcattactaggagagaaactgaaattatgataaacattaattagtatattatcatggttcaatttttgtgatccaaaccattaagaaaacataaacttcaccctaaattgtaactttacttttacctgttgcaacgcgcgggccctttagccctctttttaatattattagtcattttgattttttttcctaatcaaacttctttaagtttgatcaagtttttatataaaatttagcaacatctatcacagcaaattagtttaattaaaaataatatttaatatattttaataatatattttttaaaaaatgtttctatatttttctataaatttagtcaaactttatagagaaagaaaaatcagtcaaactttaaagagaaagaacaatcaagatgacttataatatgaaacgaagggagtatataatttatttcatacttttatagcaggctggtttttgtacgaattaagaattgaattggcatttaggtatgtaggttctaattaatttataggccataattaaattatgggaattgttatgcttctacctgctaaatgttttggggaaaatccaaataacccctacaagtcaatggtcttttcaatctccccctacaacttaatgtagtgcaaagcactccccataggtctattttctcttccaacttcccacctatgtctagttttcggtgattcttcgtcacactaagtgatttctagatctctagtgtggtgagcaaagatgtcccatgtgccttctcaatgaatgcaactgccaacagaaccttgaccgcaaccatggcatagacgtcctcgacgatggtgcacctgtcgtcgtccaatgaactggaaatttcatccgcagttctaccgccggtttccatcatggcatcaactgttgagattataggcatataatgatttaatctattctataaataaatcatgatattacagatgaaaactagcatgaacgcatcattagatctatacttgtaaactacacagtataacatgaacagatcaaatatgcgcaacatattgaacacgtaccgaggtgacggaaagaccggctgcttggtcgaaacttttcgcaggcgtctacgaaggcacgaaacacgcgagcgaagaggaaggcgagccgtcgcgaacgaacagggagcagtcgcgcgaagcgcttcccaaaaaccttattgccgccttctcccggtgcaggacgtcgaaggcagaggttccggagacctgctctcccgatcgttggtgcacgcaggcgagcgggatggagtagtctacgagcgacggcgcagtacagagtaggaggcaaaccctagattgatttcgcgtgtgttgcgtgaagacggcgggtcggtttatatagagaagggccgcttgatcagggcatccgcacgatctctactgcgcgtaaccgaaccggataagtcgcgcgtaacttatccgaactccacgccgtttgcacgcaccggatttttcggaacgtttccaaaacaaaaacgaatccgaatttgcagcaaaacaaaactgcaaaaggaggctacatctgcgcaagggtgaggagtcaattttttggaccattcgacgtgtacgtcgtgcacgcgcgccgtcggcccggccaggcgagcgagcgcacgcgtgtgtttccccttttctctacaccacacatgcttcaagtggttaggagggcatcctcccttttaaggaagtccccctctcttagaataagcaaggtggtactaaactccacatgcatgccatcccatgaggtgggcttttgtgattttccaaagaattaatcttcgagtgggctaaggcccattcattaattccaacatcaacaacaagcactcatgtgtggcctactccagaagtacaagcagtaccacaggattcggtgatggccatgttggctgtttcaactaccccaccatcgtgtgatccttcaactatactagcatctccgaagaaggtaatgctcatggtgttattaatgtattggttgtgcaacatattcacaagagaatttctttagtgttagatccaactttaattgttagtgtaagaccaatgttcagagaaaatttgttcaaatctcaggtgggtattcaaaacatttttttttaaatgaaaagcggcaaaagacttgccgaatatattagaagaaagaaagagaacccacatagttcagtttacatattacagactgggccactaggggtgagacgactaaaaactgatggacagtacttgataggattacaatttctcagaaacgtgggagaggcaactgaaaaacaaactcacagccccttaatgggattggttagctagatcaagctgggcaagccacttgattctcagtttgggagatttgaaggaaaatcctacggttatgctctagccatacaatccaccaggttacctggaggtctcccaatatcttcctcttggctattggagaaatgttgcaaagcatctcccaccaatccatcaaggtgggcgctgaaggatgctgagaaaccatatcatggccctgccactgacaaacttggttccaaatggctcgtgtcttcaaagtcacctctacaaagactgcatatccaatcacagggccaatgtctcttcaacaatttttttcacagggtaatcaaaacagaggatccccacatatccctaaagttggaatgacttttgaatcagaggatcaggcatatgaattttataactactatgctggtaagatcgggtttagtatccgaaagagtcactcaagattgagacgagatggcacaatatatcaaaagcatattgtttgcagtaattaaggagaaagaggtgctcattcatcacatgatactgtaaagaaaatgccaccacaaggacatcgtgcgatgctcgtgttcaattcaatatttgtcggaagggcaactggagggtgcaaaaggtcgtacttgaacataatcattaattatcttgcaaatccagataagagacacatgttgaggtcaaaacgtcgtttggtatatgccgataaaatttttattagtcagatgcgagaataagctgaaatgtacaattttttcaagcagtggtatggaggtactcagaatgtaccttttttatgaatggattgcaataatcatttgggtcatgagcgcaagaaatatttggaagtgaatgatgcacaaacagttagaagacccttcctttttttttatgccatacaattagatgaagaggatggttggaaagatatttttttctggacagacggtcagttcatcatggattatacttgctttggtgacattgtatcatttgacactacattacaaacgaataagtttgaaatgatttttgcagggaatttaactatttcccactattgcctttgccacttatccaattgcccctcttagatttgcctctctcttcttctttttttttttttttgcccttctaagataatggcttcttaactaattgccactttttcttacgtggcttgcaatcctaaaaaacagagtgggacccacaaatcagcctcttcccttcacttcatcttcctcctcatcctccagctcgctgatagggaggagcccgctcctagtccggcatccctccatgcctccctctgagcctggcaccgacgagctcccgtgcacacgcctccctccgcgagctccctacctccctccaagcctggcgctggcgagctccctccatgccctgcgtcccgcaagctccggcggccctctcctcgacagcaggcggccttcctctcggcggcgatgcgggtgcttggtgacaacaggcagtcctccctccatgcccggcgtcccgcgaactccgacggccctctcttcggcggcgggggatctcgaggagcccatccgccgccgccccgtggtcccgccatcattgagaggagggccgccgtcaaccgccgaggatcaatgaaggggaggacggcggggctggccggagcagcgtcagcagccggcggggcttgccgggctgaagggagagaggaaggggagagtttgtgagactgataagtgggtcccacattgatatttacattggtttgccacattggcacaccacgtgggcaaaagtggcaaatagttaagagcaattagcattgtattttcaagcacaaagcatcgtccttgcttgtggcacatttatgaaaatgctagtaaacatctcagccatgtaatttctaaacatcgtcaatttcttccacatttcaagaaatgtgtctatgaagagaggtctgtcatctgtggcacactttgaaagaaaatggcatgaactactgagtgcttataatcttgagcaaaactcatggttgaaaagcatatatgatttgcgagagagtgggcttctgtcttccgccatgattcaaagtttgtaatctgaaatatttaatctctgtaaaacgttaagagtttgcaaggattgtagtgcagatgctatgagctgtgatttgacatcttcttttgttgttcaaattgcaaagaaatcgagatccctttgtaatttgtacaatgtatgtaaaatacatttggcgtgttaagtgctctgaaatctgcattctgatggatgtgttaataaatgtgattatttatctgattccatagataaataaaatatggaatattgtgtaatccgaaatcttaaatgtctgaaatcgtatagtccagcattatgcatcaatttgatgctgtctggtgaattgataagtactccccaaaacgtttcggcactggaggctactggttataatacaaaagcgttttgaaccatagcttctatagccgccaaagcagggttgagtcgagctgacaaaggcacgcgagccgagcgcggaggatgggccgccacatatcgcacacggtgtggagagccgaggatagcgcaccattggatcatgcacttgtgcacgcgtcagatatgttggagcagggttgcagtcttgcagacgagagaaggttttttgcagccggtctccacccgccccagatcagaattttttttttctctttaatctggccatagtcggatagtccggcatccacggagcccacggggtatgcatgcgtatgcatggtaacagaacgtatgcacggcaaattaacaaatcccagtatgagttttgagttctggagtccgggacataattcttctggcaccacggcaagaagacggaaaggaagcgcgcgcgctgcggccgcccgtctccacatgtaggccgcgcccgcgccgtgtaaagccatgtgcgtgtgaccttgatggaggtgcgaggcgaggcgcggctgcgctgccgcgcgcgtagtactggtactgttctgcgtgccgctgccgccgaggccgagcgcgtccagattcaccctcacaaccacgtcccccgtcttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctggaaaataaagtcaggtgtaccgactagatgcacctaataggtgtagcccccgacaatgtggttaattgaacaaaccaagcatatagtcaaggaataaataatccaatcaaccgagtggttttgataatcgtaatcaaccaagtgacttgatatcaatatatagcatatgcagtgtgaaccctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcgtatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatagaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgcttccgagtaataaatcttccgggtgatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactattaatccatgtggaatgtatccggaacaagtccaaatcggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcggaatccaccaatcatgaagatgaagaaaataattggcggcgacaaacgcatccgacggtaatgatgattagcggcaacagagatagccgactatgatgacgaagtttcccatcaacggcagcagagttggctatgttgatgaggcttgacaagatgttgatgaagatgacgatgtcagtgatccagtcgatagcgatgtagcagccgatgataacgatgagatcctctatcggaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagaggcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcaacggcacaagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccgacgatgaagatgtagatgcccaacaacagcggcataatgggccaatcaacactggcagaatcatgcagccatggaagtgaagaaaccagtcggcagccatggcaaacgtaggcagcttgtgttgaagatactggtgcctattagtagtgacagcgatgtagccagccgtgaagaagatagcatcagttggcgttataacaggccagccgtacaggcggtgacaccagtcagcggcggatgcggcggccggtcggtgaagacgtagacgcccaacaacggcagcataataggccagccgtgtagggggaaacaccagtcggcggcggtcgaggcggccggtcggtgaagacgtaggcgcccaacaacgacggcataataagtcagccgtgcaggcgaaagcaccagtcggcggcggacgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagc

SEQ ID NO: 78385 - DNA, 2442 bp, Oryza sativa
ggggaggcgcggaccagatcgggctgttgagccagtcggggacgtgcttccgctgccccgacctcgccgaggccggcgagggcgggtcgccggggttcgcgctggcgccgtcggccatgggcggtggcggtggtggggtttaggcgtttgggaaggaatcagggatgctttgggaaggagatcctcgggatcgaggcggactggacggtggtgggttggacttggatcggtcggtgcggttttctttttttcctttttctattcagtttcaataagtaaacccacccccctcgatttagaggtatttaaatagtatctgtcacttgtaagctccacgtagagaagagaagagagaagaaaagcgggctacagatttgtagccagtcgggctaccgatttatagccaccgcagcaatgggttccaatatattgtttagggactgtctatactgcagtcgcatgttttttgtgtcctatttcagtcagatttctgtaccacacgatttacatctaatagctcacaaaaactgctacaataacatattataaaagtctagatttatttttttagaccaatacaggccaaaaaagcccatctgtcttaaaaaaaattgacaagcccaaaataaagtctaaaaatggtcgctagaaaacagagacaaaggcacatgatcaaacagagcccacagaacaaacatatttagaaagcttgcaatccaagttgatgggcacgtgatgacagctaactattacagatcgggatcacaactaggaccacctctttccgaagagatcacacaacacacgctgcaacaatccagattatactagggagatggagctagaggaagagaaagatcccccaaaacatcaatccaaaatcaagatgaattcagcagagatcaagaagagaaagataggcttaggaaaagatcaaggttcagaaaagaaggaaatgtcaggaaagaatatcaaatatatcaaagaaactggtactaaaggtcaatccaaagaactccaaaaagaagaatcgaagagcagaaagagcacaaaagacaagtccaagaagaacaaaggtgagtgaacagaaaaattctccaaatattacctgcttggttcttttcagaatttgattcttcttttggaatttgtttgatcagatctgtaaagaaaagttaatgaggttagaaatgtagaaactgattagatcttaaaaaaatgaatctgttctaatatgaactaaatagagtcaatctgaaagtaaatctgaccactgtaagtaaattgggcaaatcattgtaactgtcattttagaactgggcaaatcactgaaattttcagaatggtaaatagtatgaatatgttctaatatgaaatcataaagtcaatctgaatgtaatattaatgtttctgcatatatgactcaaatccagcaatagcagaaagaattcacaaggaatacaccaccaaagtgaacaaacatgaatcaagaacaggtataaaatgaagtcaatgaaatagattactaatcataagaagtttacttgcaaactttttttaaaaaaaggaaatgacatcagatatgtacaaaaacacatcaaaactctgcatttcatcagacaagaaattaaattaattttcaattgggatgatttattttcttgcctgatgacatgcagaattaagatttgcttaattgaatttatgtttatcatcatctggcaaaaaagtggattgtccaatgattaatttcttctgtcaatttccaatttgcaaactagttacagtgaacagtataaaaaatacatagaaacgacacctgtaattttagttcaatatcaatgtaactacacgaaatactatacaaaaacaaacaaaagcatgatctaaggcaattttattttcaaattgaaatagtttcaaattcaaaaagcaaagaacagctcatcagaacttcaaacatagaagaaaagcagaaaagaaaacaaataatatcagaaaacaattccaaaggtatgcattctttaaaattcacttttatttttgtttcatttgaaagatttcagaaatcaccaactatcacagagtgatattgtgtatttgcatagtcttaatggttttaacattcagatatttgtatagtaatcaatatacaaacaagtttcagaaatcaccaactatcatagagtgatattgtgtatttgcatgtggtaggagcatattaaaaaaagaacaaataatggtcttaattttgtgatatatgtctagaaatcaatatacaaaatctaatatgaactcaatagagtcaatctgaaagtaaatttgacaactctaagtaaattgggcaaatcactgtaactgtcaatttagaactgggcaaatcattgaaattttcagaatggtgaatattctgaatatgttctaatatgaactcataaagtc

SEQ ID NO: 78386 - DNA, 2474 bp, Oryza sativa
  unsure (1)..(2474): unsure at all n locations
ggctgggtcaatagcgatcaaggggaatggaaaacgatcgagaattgacggaagtgttaaaaatgggaacggggtaaactttgggtgctattaaagtgaaccggtatctttcggtgctataaaaccaaaaacgtgaacttttgatgctatataaccaattttgcctataaaatttcaaggaagtcatagctgataagcatgcttcacagtttgttttgcatgagggaaggcaagagtcacaggaaccatataatctgttaaagggcatcggtaggtttcagcatgagagtttttatgagggtatctgaactattttgtgccaaatttatgcctagttaaccagctatgaatgttgtatcctgttgactagatccttcacatgttgtgcaaagtatagaattaactaatcgcagctgcagtgactttgcttattttcttaactaaactttcttggtatggttcagatccaacatcattttttttttgttgggaattctttataggctgacagtccacttgatattttcctgaaatctcttggacttgagaagtactcgattaccttccaggcagaagaggtttgattatttccgtgaatgtgtaaatcattttgatgccctctttgatatttatttggttaatagttgtttgtgttgcaggttgacatggcagccctaagacacatgactgacagtgatcttaaagctttgggcattccgatggtacatgcattgcgcctgagatctttattctgttttctgattattaattcgctcgtcagttagataagttttgggggtccttgcttcatctctcatttagccatttaagaatagttgtaatcacccatcaccccaggtcttaagctaactttttgtataatcgtatgtggaatcaactatgaactagttcacttcactccatttttgtataatcgtatgtggaatcagctatgaactagttcacttcactccatataaattagaatacatgtactggtatcatttttgctgaggaactggactataacctttgactgtagtactgcatatgcatgtatattttgtttcaggatataggtggcaccaaactaatgtaagtaaagttgaacatcagcaagcctgcattctttcttatgcgcaagtgtaaatttgatttaagatggaaacttaaggtgggtgttctttcagggtccccggaagaagatcatgcttgccttggaatcgagagcgtagggagggctggcgtgtaatgtagaaaggctgggcgattaggaattgtatgctcctctgcttgcttggtaaacccaaagtgtccgcatgtcctggatacggcgcaagaacaaaagcgctgggcgtcttgtaatgcgtcttctgactagttgagcattccgcattctcagccagtttaggatgttttagaggctggatgaaggttgacaatgtaatattattagtctcctgttaatttttatctggtcggcttgcttgtcaggactcaggaccagctgattaatcaaattgttcatgcggtacacagtattggagctgtgccgatgttcttggggttgctttgctgctgtatacgattattattccattgttgtcttctctccatcggagggagggggatgacacatttcaaactacctgaattttggtttattattattatatacaaatttgcgatctcctgcgtcggtatcttgtctgttgacttgttctgtggtctttgttatctgatggattgctgcattctccacagttgtctcgttcaaaatttcaattttacttttatgatagtagtttcttattaaacctccccgatacttaacatggtgaattgttgcattctccgcagttttttggacagtttttttttttagcaatatgcaagattttcaagttgctgggagaattataccacgtctttgagcaagaagatctgtgatacaataatccaattccaaatagaacaaaaacactttgcttggagaaatctaccagggtctgtctcaaaaaccagaagaaatcataagtttcctacgatggactactagaggtagcagatgatgagctcagaatgagttcttttcagcaatttgaaacaactttcctcgttttcagttagcatgctttcggtaccattaaatggtactttataaaatgtatataaaagtttctttagaaaatcaaataaatttattgtttaagcttatagtagttaatgcttaattaatcacttgctaaaaatagttcttgttttcgtgtcggagattagctctgaggcccattctaaacatcaaattacccatttttcgttagcatgcttcctaaacttttttctaatggctataaattcaacttttaatcacacatgattaattacttattaattattactacctccgttttttaatagatgacgccgnngactttntctcacatgtttgaccattcgtcttatttaaaaaa

SEQ ID NO: 78387 - DNA, 11181 bp, Oryza sativa
atgtgagaaaaagtcaacggcgtcatctattaaaaaacggatggagtataaattttaaaaaatgggttcatttttctttaatttttaaagaaacttttttttagaaaatactaatttctttgctccggtttttatgccccttaacgattttgctaaacatctcccgcgtgatttttttcctggcatttgacgtttttttgccacatgatctttgcacaaggcatagaagcccacgaacagcccagcagcccatcatcatgcctaaccctgattgctaactccaaccccggtccactcactgccccacacgaccacgcccgcactcgttccccgttcacatcacatcgcacacacgccacgccgcttggatccgggtccgtggccagcactcgcaccgccacagcgcacgatgcatttgataaaaaataatgtgtaagtaaatatgtacttattattttctttaaaatataaaattacagttctatataactaaatttacatttgtaaattcagttgatttgacatgtaagtgcactgtaattttgataaaaataatgtgtaagtaaatatgtacttattattttctttaaaatataaaattacagtcctatagaactaaaattacatttgtaaatttagttgatttaacatgtaagtgcactgtaattttgataaaaataatgtgtaagtaaatatgtacttattattttctttaaatataaaattacagtcttatataactaaaattacatatgtaaatttagttgatatgactgtaagtaaatttgcattagttattttatttcaaatataaaattacagtcctatataactaaagggacaatttcgtttctgcccctactctgatgtctaatattaattttacccctactttttagagttttcgtttttacccttacttttttgaactgaacgcttgtttcgcccctactttggatggtgaagttaacggtgttaagtaattgataaaatgacatttataccctctcatgtatgctcattaattgtgtttttgtccccattttatgcgtgtagctttagaactttatttttttagtatatttcaaattacatgaagcacattgactaatatttaaagggaacagataattacattttacaaaatgttgtcaaaattttgtttaagttctatcaaaatgatgaaattttgtcaaaattccatcaaattcagaattttttcaaattgttatattagtcaatgtggtcatctaattttaaatatactctcaaaaataaagttccaaagctacatgtataaaatggggacaaaaacacaattaatgaacatacatgagagggtataaacattatttatcaattacttaacaccgttaacttcaccatccaaagtaggggcaaaacaaacattcagttcagaaaagtgagggtaaaaacgaaaactctaaaaattaggggtaaaatcaatgttagacattgaagtaggggtagaaacgaaattgccccataactaaaattacatatgtaaatttagttgatatgatatgtaagtgcactgtaattttgatagaagtattgtgtaagtaaatttgtattagctattttattttgtaatccgttggatgcaaatctaagggaagaaaaaaatctgggtcaaaaaatcacccgagtgatgaataggcggtcccgccgcttaaagcaagaacgaacgaagccgctgttgaacgggggcctttgttgggcctgaggcccagaagagcagagcccactcaccaacacgagaaaccctaaaagctagacagagcgtcttctccatccatccatccatatatataaccagcgccgcctccctttctctccacatctcaaacccccgatccaatccgctcctctcttcctgaatcatgatctgtatggagtccccccctagcttctgaatccgctggctgctttgcttttgattttcttcttgctgtttgattttggtttggtttggtttgatttgggttggtggtttgctcgctggtacagcggcggcgagcgcggagtaaccacggcgctcggcgccccttcctgaggccagccacattagttttagccgatcatctgaccgagcgtctcctcgatttctccccacggattcgctcttgtcaagatctggcacatccacaatcctcttcttctccaccaccatcaagtcaaccgaaatcttactactagcttccgcccgcggatttgatttggatggatttttttttctttttatttgtttttggggtctgcttctcgttcatcgtttgagctggtgatgtggtgccaaggatgagcaaatcaatctgttcctcggtcacctcccatacccagcgagatggaaggaggattccggcagccattctttgcagctacgggtgagctcggatttgaatctctctctctcttccctgtgctcacccatgccccggctgccacattatttattaccaactcgcacacatgctttcctttcccatttcgaaataaatctcaatctttcacctcaaatttgattctttttactacattttttttaggattttggcattcttcttgaggaagtaaaaacattattttggagaaaaaacatttttttgttttgcttttctttcactgccttgaattagtactgacgcgtgggacccatgtgtaagtcaggtggcagcgtggcacccctattgggatgagctggcacagttacacgcctgggagatcgatcaccaggtgccctttcgttacatgcgccgcggctcatctcaatcgtggcttgtgtacatcagggcttcacattttttatttctttctttctttctgcttgttcatcggtatcaggaatgctggaaaaaaacagttgatactgatgcctccttgagcagaaattttggggcaagttagagcagtgaacaatctttgaactccagattggacattgtttgtttgagcaaaactttggatggttccgatttggaagaagtggaattcatgcaattatttaaagatgcttggtattcatgcagcatggtgtaattgttccaatatgtttgctgttcgtttcatgagttgattgatgatgccccagtgaagataaagtttcggtccgaagatgatttggattgtctggttttagcttcaagccttcttgtcatctaactttgataattggatggcttgtggctaaaaccatcactgctaagaatcatcagtgatggccaataatagctatgagatctgaggggtaaaactgccacagtacaatatatgcgttctttggagttatgttttatttggagttgccccacgaagataaaaattgtgtttggataattggatttgcagttagttttatcttcaagccatcctcttgaatttttacggtgtgtgttgagccaaaacgctaaatttgagctgtttacctggcacggtttacacgcctgggagaggaacaaccagggttcgcgtattggacaattgttactgtgtggtaaccaatattctttgacctagttatttagactttttaacaaaatgtatatattctttaataaaagcaattgagagtctgcaaagagcagcagcgcatatataacggaaagggcgctcgtctgcatcatttaaatccatgcacagcagcaacaccatagaactgtggtgattctccatagaactctttgagcgccggattggacgcttctgtgtgttgcttacaaccaactccggttattttgtctatacacatcagcaagaaggcccctacaaggctacaacggattgagatcctgtgtagtcgttactacctctgcaactttagctgtggctgtacgttttggtcgttggatcaatgaagcgagatctgtttgcaaagcacctctgacattttaagaagactagtaaccatgcacgtgcaatgcacgaaaaggctaaaattaattcaatcaaatatattgctttgtaaatttacaaatagaatagcattaaacatcattcatttgaagctacgcagatagacaaaccatattctttaatcaattgtacaaaatgcgaatctagcttatacaatgtacctaaccaaattaggaaacccacttcgagtgcagattcagtaccaaatgtgcaaaatttcaagtacatgaccaattcatctagagaatgaacatccaatacccaactctaaagtataaaccatcagaagcaaatgctgagaaagaaaaagtgtagacaaagcttaaaccgtcaaaaatcagacaccatggtctctatggaccatgtgatcgtcaatgggggatgaccatcattgatgggtcaaggttgattccgccggcgcctaggatctgagcaggcattcagattatcacttgggagcttgatgcgtacatgggggacatggtcacagtgttccttctgtcctgccctgattcccttaaagcaaaagaaaccagcaaaatgacatgtatacagtccaaactgctatcgtcagaaaaagaattgagatccgaaaatttagaaatgattgcagcttcaatacagtaacatgaagatatctgaacctcatcaccaaagtttatcaaaaaaaacaaaaccctaattcatgtatggccctaatatcactgtaccagcaaaatggctagtggtttcactggagcacaagcaccttttgataaaatcacaatctatagatttggaaagatcgaaatgtatgatgcagctagagataaaaaatttcaccagaactgtataacaaaaggaacataagtaaaaccacaatctaagacaagcaaattaaacagacctcatccaccatccatttgaagagaggagatcaaggctatggctatggcaggtcccatcttaaagataactgccaaagcctgcactctctgaagtagagatatgtggtattctttccagaaaagagataaaaactgaactgaacacatgcactgtgaatttcaatggacagatagaggaccctttccaagtgaaattaataacaatattatagcccgcttgcataagattacctgaagccactctaaatatctttttcttgccaaatctgaaggcagaactctatgacttaatatatgacatgtttctcctgtgtgggcctaatgtaatgcatatgcctagtactgaatggaatggaatagatttaatagaaataatctatatatgaaagaaggtgctgattatggaagtgttgaatgcatgggaactgggagcaattgatcatcttactccagctaaattttaaaaaacataaatatatttatagatgaaagaggggaaaacatatatacaaggacaaaaactgaccagatcttcatgtagttgatatggttttatccaagggattagacaactgctgcttatgttgtgtgaactacacaaatcagctacctcttcttcaggaaagtatactcatacatcaactgcaacacatgcagtatctgcaatcgtgttaataaatgcatcaccgagaaaatcatatgcctgtaaaaagcaataaatggtcagcatagtcaaaaattcttatcaaggcaaaacactataacaaacatatagtgggcagactatttgtacatgttgacctacgcctccacaccatgccgcctcatatcaaaaaatgtattcatttgtacgacaattgcgcactacattttttggaacatcaataagatattaatattaccctcgttcaattcatatccatgcaaacaataaagaatctctgcatctctattttaacaaaatgattagctgcttgctcatcttgttcttgtaataaatagattatgaaataggatgaaattcatcatattctgtctgagagaggcaatagagaactgaggatatacaaaatgacatgaacatattaatgtagattgcagcactaaaacacactatatctaatgttatggctgtcaataaccacccaacatgtgccttatggaattggaagaaatgaaccaatttgagatcaaatcagtggtggaacaaaattagttgatcctaaacagttataggaacaaaactatatataaattattacttctagaagcaaccaaatatactttttgaaacagagtcatgccattttgccaaaaaagtgtgctttagtagcccttcaaaaatatttttttcacttgtccagtatgcatcatgttagctgaaaagtgttcattactaacattgaataatattgaaagcactattcaaaaaaggttaatcttttaagtgaggatggattatagttggactaaccatcttactttgtcattttgatacagtgtagtttaattgttgttgatctactgtgtcaaatatagtgcatgcgacatcatgtaaaaaatacagctttaccctctgagttgtcattcaggtaacttctcatatatttattctattaggatgactttcaactttacgtgatgcatcaacatataataattgttatcatgaagataaaacatggcagaatatgcattcagcagaacttacctagaagtatattatactggagaggtagatggcatgagggatgagtgttatccagctgggattgattcgcagccaccggggagagattggagaggcgatgcggcgtgcgatggtggtggaggtggtcgaaggggagagagcggaacggagatgcggagggaggcgtctgctttgaagctgctcaatcaatttatccctagacgattcagaggaaccaaaataatcaattgtaaactgaaatgagattaaaaaaaacagtgcacatggaaacacacaaacatatccaaggagtgtatgctgtagcagaaaaagacagatttataacaatggcatcaacatgtactgacaaacatccacatatgaaatgtattatccataatttcaaattacctcaatactgtatagatggaaccgcaagaaagcatgcattttttcccgtaagagacagatgaactattcagatatatagggaggatttaacactattagacagtgaaaccaaacaatgtccatcagctttaagttaggttggacaccataccaggtagaggtgcacgggagggggaaagcgggtggctcccgtcgatctggcggtggcgcaggtggagcggcggcgcaaccgacggctccctatgacagcgcaggtcgagcggctggcggctcccgtcgatccggcagctgcgcagccgatggaggaggtcgatcggtggttcccggcgatggcgcaggtggagcggccaatggatcccatcgatccggcggtggcgtaggttgagcaacagcgcagccgatggaggaggtcagagtgggtaaaatttcaggtcaacgtgtccctcatctgccaagcaaaagcataaaaacttgatgtataatataagcagtaaaactaaaacaaagatagaaagcaatatgaaccatgagtaggtgtagataacagagcaacctagtcagattttctatttgaatttggttcagataaatgcaaattataaataattaagggaggcagagctgaggcaagctttagctaacaggatatttctacttgattgcaacgtcagtatccctgcgaagaaatgctcagcatcgatagtgagctgtgcagcccagcatctcagaaatcagggtacattcaatttcatccaatggaaaattgcatcagttgttcggtatttacagccgaacctaagatttggaaataatagtctcaatctcctatgggaaaaatcagttactctatttgcttcaagtgactctagcatcggtctcactgaaatcaacaaggcacggattgttcaagcataataaaaccaaagctactgcaagaagatagattgaaactgaatgggagagacgatgaaatctagggtttgggcgacaaacacacacctcgagaacagacgaatcgaaagttgtcttctcgttctcaatcctgctcctgtgaggaaaaaaaattgaacacttgattaaaagaaagcaaggcaggaggcgcctcgcccactgcaacctgctcgggcggccgacggcaagatgacactacggcaagggcatccgcggcggcgcatgaggggaggagaggaatagattagggtttagggagggggttggcgatgcttgagagaggaataagatacctgggtggggcgtcggcggcggaggcggaggcggtggacagggaggaatgtttgtgacggcgaccacggtggcgccgatctggctgaggacagatgcgacgacggcggaggggtggtggcgtaggaggcggcggcgggaagcggcgggcgcataggaggcggcgatgggtggcgtaggaggcggctccggcgggagacggcggccacaggcggatccgaggcggcgacggggtagggtgagcggctccggcgggcgggcgtgcggcggcggcgccgacggaccaggcgcgtgattagcgttgcggaggacgcgtgcgaaggagaaggggaggcagttttttttgcgaaatggaagcagttttttttttggcgaaatttttttccgtgcgcgacgtggtctgtgcggtttctttgtccggatgacaggtgggtcccacgtgatagcggatctgcaggattgctggattgtggatgagctcgtactttttatattagtatagataaatcaggagagagaagagcagcggactactccctccgtccaaaaaaaaaggtaaaccctgggtttgcgtgtccaactttgactgcccgtcttatatgaaatttttttataattcgtatttttattgttgctagatgataaaacatgattaatactttgtgtgtgacttgtctttttaattttttttataattttttcaaataagacggatggttaaacattgggcacggaaaccagggtttgtctttttttgggacggagggagtacatatttgtagtcagctgtagcacagactctaagacgtagtgtgtctatgataggtgggactagtattaatagtatagtatgtaattattgtatgaatgaactattagattggctatagatgaattggagctattagttagctatactattgaacttgctctaagagccactgttttctttatttggggaataagagcaaggtcaatagtatagtccacggttggctccaaaaacatccacatcagcaatacaatggtttttcgcgcctaactttgatcattcgtcttatttaaaaaaaattaaaaaaattaaaaatataagtcacgagtaaagtattattcatggttttatcatctaataacaacaaaaatgctaattataaaaaaattcaaataagacggacgatcaaagttaggcgcggaaacttgtgactgcacttattttgggacggaggtagtattatttttcaatattttaatctaactttttctgctgctcacgataaattagtcgcccactttcactctctctccactaatttcttctccagatcattacttttgccaccgtgtacagattatcgcccacttaaaagacctattttacctgctctaagcgaaatggcatatttgcaaatgaaaaatatttcgcgaataaaacttgtatatatgtgtttttagcgatctaaaaataaagaggttgaaaaataaattttgataaaagaagatcccaaaattaactttaaatttaaggttgaaaaatttaaattttggcagataagtataagagcaggcacaatagcatactataagctagctataaacacatgtcgaggagataaaatatgagagaggagacagctgcagcacagactccaagacacaatgtgtgtatgatagataagaccatatattaataatgcaatatatgtttataggtaactgactattaaattaactatatatgatttggagacggtagttggctatactattaaatttgctcaagggaaaagatgagaatataatagtgtggcgtcatggcctgtaacgtctgggcggggcggtctcgcgtggaggggccgtgacagactttgatctttgcggtctctggggacgtggaacgggccggcgtgacacggttgatgatgctcgaggggctaagagcaggaacagactattagccagctataaacatattttaatgagataaacgatgagagagaagagcaacgggctatagatttgtagccagctgcagcacggactccaagacgcaatgtgtgtatgacaggcgggaccatatattaatagtatagtaagcaactattgtataaattggctattagattggctatagataaattggagctagtagtgggctatactattgaacttgctctaatggtgttggagctgatgggcgatgaccggacgtggctcatctcaaaggtgttcgttgtgcgcttgtgctcgtcggcatggactgcagcgtcgtggaggtccgtgcgtggacgcatcgtgattgcctcgagtgcctcgtcttcctccgtgacgaggaggcggacaccgagaggatggcaggcggacctcttaacgcggtcgcatgcgaaaattgatcttcgtatgcatgcgtagtaggaggctcgcttgcgaagatatatcttcgcgcgtggtttggtccgtttgctcgcgaaaatggttatcttcacatacacctgggggcagatggcccagccaaccgcacgcgaaagctcttttcggccgtctgggaaaaccctttctgtagtagtgatgcatcaaggtctacctcaacaacctcctctgtggcgactacaacggcgccgtggccattgtccccgctgccaccgtcgcatacgctgagcactgcctccactagctcatatcggctgacggctaccaagaagagcgcgcggtggtgtccccgaaccctctcgtgtccgtacagagctagatgaagcgtggctacttgtggacggtctcacggtggggagcgtgacaccaccgcccatctcgctggcccactgcgcgacaccgccaccgatctcacgtgtctacgcagcgaaatcgctgccctatcatgccagtgtggagtgaggctgtgttgcgttgccatccccgagaccatgggaccactgttctccacctcccgctccaaactccttcgcgctactgaagcgtgagaccgcggaccatgtttgccacttcgtgagactagcgcacgag

SEQ ID NO: 78388 - DNA, 617 bp, Oryza sativa
ggcaacttcgtccttgtcagtaagcatgcctcccggactattaaattttgtgtaaaaattttctatacaaaagctttttttaacaaaaatcaaataaatctatttttttaggtttacagtaaaacaatactcgtcaatcatgcgttaatagtttatctcatttcgcgtgtcgtcaaaaatcccaaacgaactcagcctaggtttattttggagttgggttttttctagcttcgggaatagggatgataattttgccaatggatccgggtatctgcggatacccagcccaatgggtatagatgtgggtgtgattttttacccgtgggcacgctcacccaagacccgaagatgacatcttaggcaacaaccaggtctcattttttacccatagataacccatacctaaccaaatacatatgtattagcttatttcgatcatctcttgattcttatacccctttctcttagtccatttatgatgctaagtttgttactgatatgatacatatgtattagcttatttcgatccatctcttgattcttacgcccctttctcttagtctatttgtgatgctaacttcaacatcgcctatatatattcgttcatgaacaatgtt

SEQ ID NO: 78389 - DNA, 20682 bp, Oryza sativa
  unsure (1)..(20682): unsure at all n locations
catcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttgtttagcaaatgaactaaatttctatatattctttcttccacacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggatgggactttagtcccggttggtagcaccaaccggggctaaagatcaccgggatctttagtcccggttggtattaccaaccgggactaaagttaccatctttagtcccggttggtgttatcaaccgggactaaagataccgggagggcctgacaggccctgacagcattcgaaccgggactaaagatgatctttagtcccggttggtaacacaaaccgggactaaagatcaaatatgcccgttacccttttgaaccgggactaaagaacatctttagcctcggtttttattgcatccgggactactgtggaaatcggccgaccgacgaaagatggtttctccaccagtggatatagatatagatatagatatagatatagatatatatatgtgtgtgtgtgtgagaaaatgattctatacacccaggtgtacgtactcctggttccatccaccgtccatccgcacacaccacctttcaagccagctagcggatccaataccgagcccgttttgatttttgtttccaaaaaaaagaaatcctcacgatcttaattattccgcactagccggaagcccggaaccctttcgaattgctcgtattaatatctcgtgggtggttctaaacagaatcgatagatcgatctgcaggttatatcgcgatcggacgattcggaggtgacggcggcacgacccatcggcgattcggaggcgccggcgtcttccattactggtgcctccggtatggctgtccccgggcgattggctgggcgaagcgctggtgaccaaacaacggcgccgttattcttcgggcattggcaagcctgtgtgtccgtgcggcgacggcatcgatccaggcccgtgcaacgatcaagatgacgatgagcgccgtccagaactgcaacatcgacgatgctggcaagttcttctttcttccgattttcttaatttgctttttcttgcagatcgataatgcatgcatgtatactctttcattttcctattagatttatctctcttaatagcagaagaggatgcagacatgcatgcagtccccgacctgacgctgatcgaatgataaagcatctaaagaaacgaatttgtttggtgaatgcagatacgagatgcatgtatcgtggacatggatggtgctaaccacagaacagtccagcatgtgcggacgtgcggcgactgcatcagcgttggcatcgaacccgtgattcctagttgacggtgttgatcaaggaagacacattcttggccccttctctggcacgcggtcggcgtgatcccattgatgctaaccgatctgttagcggggatgcagagattcttcgatgagacttacatcgagggtgatcccgttatgtttttttagtctccatgcatgttttggtttccgaaagtcttgcattgtttttcttctttggtctgtccattcagaattcagtgcccttctagggtattttttttattcataatgcaacaacccgatactttaccagtgatccagtctgtgaatctttggtacggtaacacttctatatcattgaatgatacaatttattcatagttagcaacccgacacgtcccaaatgtacacactcttctctaagaaaaaatggtatgtgctattttacttggaaaaaagtacatattctattcatggaaaaaatgccatataccatactctcaatgaaaggtattagcaatataatgctctaaagaacagcatatacccataaaaaatatatacttggtatgagaaagtgtataccggtgctaagttaaaaaaaagggtatatactgcactaaagaacaatatatatatactcataaaaaatatatactggtattagaaagtatatactggtactaagttaaaaaaaggtatatactgttactaagttttaaaaaaagagtacatacgtatactgctactgcagtttaaaaattgtatgtacttgtacatctagtattctagtatataccggatcctccataaaaaagtatatgctgaaactaatcagggatcagtatataccggacataccggtttccttgaagatactgatcgaataacaagaagtagtatatgcagtatatatactgacaaaaaaaatatatatatgcagatactgatcgaacaaacaagtagtagtccctagtatatgcagtatatactgagcaagcaagaaagaagtacatactcaaccgatcgatttaagtatatactgaatacttgagaaaaagtatatactccttaacgtatcaatttagtatatactggatacttaaaaaacagtatatacttttaggaaaaatactgtataatccaaacatatgcttgacgtgattaaagagagcaaagtagactgctccaatgagacatatactgcccgtaattacaaagtagatagtgtatacaggtactatatataccactactttgtgaagaaaaaggattaagtatgtacttaaaaacgtatgctctcttttctaatcattttgatgaagaagataagctccacgtgttctgagtatagttacgtgcatttaaattttgaaacacacatgcactcggtcagtcggttgtaacaaaactaaaagaaaataaaatacctttttaaaaaaatctgactcaccatgaacccattggataatccaatatggagagggtgtatgtactcccggtgtatataatggtcatcatatatatatatatatatatagagagagagatctactctaggcgttgcgcgttactccctccgtctcataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaatttcttgaataagacgaatgatcaaacattgacaaacaaaaactcaaaaagacaagtaatataggacggaggtagtaccaaataccgtggcgcgactaacaacgataccccacagcgcgtcctgtttttccgttcctagcgatatccctcccaatgttatctcaggaaaaaaaattactatgtggatccgtgatttccgtttttagtgtgatcgcttcctgatttttcgtttctgtttttcacgagtgctcccctgaccggaaacaataaatccagttgcgtttgaaccaatcaggctatcgtaacaaaattactgatgttcgctttttccgttccgcatatacctcctgctacttgcttttcatttggtccaagtaaaaaaattactacctatcgtgctccaaaataggccaaagtaaaaaaattactacatcctacgggtcagtaaaaaaataattaaccgcctcttgtataccaacgtagctctagtaaaaaaaatgatatatcctactagtcagtaaaaaaaataactaaccgtctcttgtgtaccaacgtagctctagtaaaaaaaaatgatacatcctactggtcagtaaaaaaataactaaccgcatcctgtatacctacatagctctagtaaaaaaggtgtgcctcggcggctgcggcggcaacaatttgggagggatggacgaggacgcaggcaccgggatccccatgcttccctccctggtgctggctgaaatccgccccaaatgcatagcctccatctccatggcgttcccatccggcacacatggcagtcctcttctttgaccaccgccggcaactacacgtctggtggtggcatgactgtatctaagagcgtgctcgaaccagacaagacactaatttaacaaaacactaaaaaacaagaccataacaaccattgacatgtatagagctagcgtaaccgttggcatagtgcgagtgatttccgagggcactcaatagacttagggtttgcctcaacagaaccccctcatctgtgaatctgtgatgggctatggggggtacatgcctcgtcagtgatgagtgtcctcgccatctccactcattgcccctgcacatgcttcagtgcttcactaatcaccacagtgagctgtttaaagtcaagtatctgacacataaacaaaaactgcttcatcatatatatatatcactgaaagcatccaaactagaattgaatggaaatatatggatctcattctcatataagaatgatagtacagatctttaccaaaaagagatatggggttctcagtcaccacaatagcactacacattcacagaacgggatgatatgaaatttatcagatcgacacaatagaagggaaggggcaatgcaccagatttggtccgggaaaacggatccaagcagccgagtcgacaaggacgttgagcagcctgttgcctcgagctcaagggccgatcgtcacatccgcaccgtcttgtgcctgccatcggatctggctgccctaaactcaatgcatggccactcaatccagatgagctagggttggaggaaacgtaactccacatagagattgatccgtcggtgaaagtggtgcatcgaggtggaggacagttggtggaggtggagaagagccggcaaatatatagcaaattcgaatgtgggatttgggcagtccgtcgacgagagcacgatgagctcttgggccgcaatgatcttagagccaatggctcgccaccaaacctcatcctagttctctgggggggggggcctaatacgcgactagtcgcgtggcccccatgcgcgcgatcagttctagtactagtagtattagtctagtactggtactactgtagtactactactattactacactgctattactactactactagtgttgttatactactactagtattactactataaataaataaataaatatatctatattttttgatgtataaaaaaaatatgcacgtatacaaactttgtatacgatgtgtacaaactttgtatacgatgtgtacaaactttatatacgtacgtattaaaaaataaaataaaaactagaaaatacatcatgtatacaaaatacaaacttttgcatacgcgtatacaaactacgatgtgtacaaactttgtatatgatatatacaaactttatatacgtacatattaaaaaaataaaataaaaactagaaaatacatcacgtttacaactttgcgtatacaaactttgcatacgcgcatacaaactttgcatacgtacgaatacaaactttgcatatatacgaatacaaactttatattcatgcatctttaaaaaaactagaaaaaataagcagaagagaaaccggaaaagaaaaacgaaaaaacctaacaaaaaagaaacgagaaaaacggagaaaaaaaaagggaaaaaaacaaccgaacagaaacgacaaaaaagagaaaaacggaaaactcgctactccctcctcctctcgcgcggggcgtccgccgcccctctccgcgcgcgacacatgtccagtcgcgcggggaggggcgcgcgcgactgatcgcccattagctttttcgtagttctccccctccacctccatctccgcctcccccttcacaggaatcctaattggcgcgtacgcgccggcccacacggcccaagacacggttagttttttttcccgaattttttcatatatgtgtaaactttcaacccagatttgaatactttcaactccgacttgaaaactttcaactccaacttgaaaactttcaactcagattcgaaaactttcaactcgagattcaaaaactttcaactcagattcgaaaactttcaagtcgagatttgaaaattttcaaatcagatttgaaaactttcaactcgagattcgaaaactttcaactcagattcgaaaactttcaactcgacatttgaaaattttcaagttatgatttaaaaactttcaactcaaaacatttagaacaaaaatacgtgtgctaaagtttttaaaaaagtaatcagaaaaaagaaaaaaaagaatcagaaaaaagaaaaaaaagctaaaagaaaaaatcaaaaaaaaaagaaaaaaaatcacgaataaaagagaaaaaaaggctgatgtgtcttgtgggccggggggcagctgcgcgcgcgccaactagcaacccccctccccccctcatggacaacctcgggatgacgagcccatttctaccattccgccctctgcttaattccctccttgtctctcccaccgcctccatccccgagcaaccgcccacactgctggccttttgctggctcgagagagagttcaagagaccgagagagagcgaaacggagattaaaaaggaaattggcaaattgcctcgtcgtacatgcaggcctcgtcagtgacaaataactgctcatctatgatggagttgtgtctcgtaataaataagcgcagccataagtttccgtgtcaaaaataagcgcagccataagtttccgtgttcaactttgaccgttcgtcttatttgatttttaaagaaaaatctaaaaagcatcagtcacataaagtactatttatgttttataatctaataacaataaaaatactaattataaaaaaaatttaaataagacagacggtcaaaattagatatggaaacttatggttgcgcttattttgggatgaagggagtttttatttaacccgatagaactaacattatctgtgacgggtcataatcatccgtcgatgatgtatcatcacggataaacgggaaaaatatgtggtgaaaacaaaaaatatagtggaaacttgaaaactaccgttggataaaaaatggacgtcggagattcatcaacgtcatcacgagtaaaaaatttactcgcagtaaaatttttactcatgagtaaatccgtgagtaaaatttttacttgtggtgacgtggacaaatcttagacatccattttttattcaatggtaactttcaggttttcatacgtggtttccaccacatattttctccggataaacagttatgtagcagtgtatcttaaatgtcgcccatatgtatacaatcattgatcatgtagtgtctccctaactaatgctataagaaatttgcataatgacaaattgtttgtacaactctcattaattctaggaaaaagtataaaatacccccaaactatcacggtcgaccgaattaccgccctgaacccgaaaatcagacactgttcaacctgaactttcaataccggacgaagtatccccctcgacccaatttagagcggttttgttctacgtggagtacacgtggcaaaccagccagcattttctttaaaataatggtgggatccacctatcatacctctcttcccctctctctctcttgcgcgaatggcgcgcgcggcggtgaggggacaggtggtggcgcagatgatggcgcgaatggcggcatgcacggcggcacgcacatgatggggaaggggtggaggggagtggggagggggacaccataaggagtagcaacccggtggttggcggcgggcagtcagtgaaggtggacggagtagcggcgagtccagcaccccgaggctgtggcctggaacaacggcgcagggatgagagttgtccatagcggcttgatggatagaatttggtgtctggtgacggagacgggcttgaaggcactgatgacgacgagccccgagcccacacgatcctgagtgaagagcggaaggttggcaccggcggagggcgggcccaccctccacctgaggacgcagaggatggtgccggtggcaggccggtgatggctcgggcaagggaggccatcggcagagaaggagccggaggagggctcggtgcaccggcgggggtagaggcaaagccccgtcagcgaaggagaagcggtgccggcaacgggcttccatgagacataggttggaggctggtggagaggaggcgtcggtggtggaaaatctggtggtgggcgacgggtgaggaggagccgatggcagggagatccgccacacccgtctctggcctacgcccccgccacgctcgtcgccggccacggggtcaccactcccaacggctcacaatagagagagagacaggaggggggaaggnaagaggggaaagagaggggtgagagagtatggtaggtgggtcccaccatgtcacgccccgaaccagttccggcgggaactagcccgtgacgctccaaattaacctgttaatcgataccagtcccaggaaacagtgctggtatcacagggagacagaatatcatagcaacagaggtctctttattatagagtaggagtacagtcatgttgggctgcggacagatcctgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatctgcttcatcttcttcagcaactgggggggggatatttatatagagcaagggtgagtacgggagtactcagcaagccaggggaaaataagtgtttaatgcaggcttcaaggaatggctgttgtttttgcaattgattttatttgaactcttttctaaaagcaactaagtgagtgcttctcaaacgacacggatgaggcagtgcgtctcgtccggtcggagtatgtgcaatgtatcagtctttagatttgaacaagattggcacccggccaaaggccttttaaacggccacccgggccaacaccttttcaaacggccacccgggccaacaactttttaaacggccacccgggcctagctgatcccgtcagctgcggattcttttcaaacatcgaacccgatttcacaacagcaatttcacaagcagtagtcaaacaaaactacgctaggaatcacctcacatccgcccatgaccgtgggcacggctgttcgaacagtttgttaacctctgcagagggggtacactttacccacacgtcattactaacccgggtcacccagcccgtggggatcagccacgtcgggagacctccaagctttcatgacaaggcatttcgaaagccgatgcaggtttgccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcacgagtatcgaggcgcaactgggtggttacaaggggacatggcatagcaattaacaatggaaggatcaaatgcgacaaattaggtaggtctgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgagaataaagccctattaatgacccctaagcgtgccattagatagatctcgagatttgggaaattttggaagttgaacggagtcaaacggagttatggttggaaagatattgaatttctaagattattggatttttggtctaaaggaaaaaggatttaattaaatcctttttggaaaaaggaaaaggaaatgatgaagggagggaatctagactttcctcgggcggctagggcgcggcccaaaggtattcggctcggtccggccgagctaaacgggccggacggcccaaagcggcccatttacgcgcgcgcgcgggagaggagagagagagagagagccggtggaccgggctcacctcgcgcggccccgggtgggacccgcttgtcagcggctcggcccaccgtgcggagggagcacgcggcgcacgcgcgcgggcgaaagggggaaagcggtgcgcgcgcggtttacggaggactcgggtgcggcgggcccacgcgcagcctcacggcttgcggtggaatgcgcgcacggggagggatcggccggggtcggcccgtcccgagctcagccgagctggcgccgacgtggcgcctacgtggcggccacgtgggctggcaggaggtagacgacgaccggccgcaaatgaacggcgggcgacggcggcgagcggtagagcgggccacggcgataccggcgaaggcgagcacgccgggcggtagtacgggacgagaggagacgagccaacggctcggattcgccggaggttgctcggcggcggcggattgcggcggcggcaaccggcggcgggagaagagggaaacggcgacgaggccacgagaggtcgatctccggcggtgagagcatctacaaggccacgggaactcgatgctagggttggattggacggagctatgccgagctaggctggcgacgtgcggctacttcggagctcgggcggcgacggcagcgagcacatggcgagcaacggcatcggtcggggcggcgccggccaactacgggaggtctactcgagctaaaaccgaagtctaaggggggggagacggagcgaggagggagaacgaagcgaaacatcaccgcgggaaggagaggcgctgtgacgagaggccgacggcgcgggagtgatctctccggcctcgggccggggaagaggaagaagaggcgcggccggagtcctcttcggcgtcctcgctcgtgccggctcctccgacacgcgcggcgacgattggagacggcgaaaatagagacggcagtggaggaggcgaaaatggggaggaaaggagaaggggaggccgggggtttaaggaggcggcaatgtcggtttggggaaccgacttgcgcggtcaagagcgcgagctggcgctcggctagcggccaaagcggtggcagacgggatgacgccggcgggagaggaaaaaggaggaagggaaaaaggaggaggagaaaggaattctctcctttgccgattcgggaaaaggagagtgggcgcggggcgacgacgcggcagagggaggtgaggcgcggcctccgggccttggcggctagcgcgcggagtggcgggggccggcgatgacgacggcgggcggtttggagcggagcggcgacagcggcgactggcgcgggcagagctgacggcggcggcgaccgggcggtcgcccactcggcttgcgcgggcgcgaggcaacgggcgacggcgcgcgggggggtgggggaaaaaggcggggcgcgggcggctcacgcgcgcacgcgcgcggcgcgcgggcaaagcggcgggatcgggagagagcgagggagcgcgagggagagagcgcccggggagggagagagagagagagagggaaatgggccgggggggagagatgggccgggggggcaaggtagactttgcggaggaattgattcggaagatttggattcggaatttgaactcgacgatagatcggggattgagatcttgagatggcacggacactagacaacaatcaaaggaacaaaatttcgcaattagggtttttgagagataattttcccgctaggcgccacgacggaacgggcgctacacaccattttttaaataaaaaaatactgactggattgccatgtgtacgtcccataggataaaaccgcttcggattgtgtcgagggaggttattcatccagtatagatagttcagggtttaaaacgtccgattttgtggttcaagggataattcgtaccgtcagtgatagtagtgatagtcaggggattatttgtactttttccttagtactatcgtttggcagtacgccagtaccttatcagtccaacaaattaaatgtgctccgtctttaacgttgggatgccacttccctgttcctagattacgttccgatctttatcccataataacaaaaggctattccccataaagctcagattagtggttatgcctcgcctcctaatgcaagttttatagtggagatgatagttaaccttaatttagtccatatcatcaacttattaattaagaggcaatacatagaacaaattacctctagcacacttgtcccaatacatcgtattaaggtcatctttgtttaggttaataagccaacttataagtcgaaaagtctaagcttaaacaaacttttcatttggcttttttgaagtcataagccattctaacaccattaagtcaaaagctaggttggagaagctttttttatcttatgtgaggtcgatgtatgactccaccactaaacttaggacattaaatccactgcttacaaaatcataagccaataaactgatttaaaagtctaatcctaaacaaagagggcctaattttactttatttgtttcctatcaattcattggtctcttgttcttatctatcttagagtttgtgtagaggtagcccttgcatgagaggtggcttcttctctcttctttcatatctctcatccaccttatcgtatgagcttacatggcacctagagacaagtgcgtagaggcttgtagtacttgccttaataaactactcgtattgtatatattactatgctagtgataactgctacaaatacatcattgagtatgcaacttatactgattaaaaagaactttaccccggctaactaaaatataggagaaccctctatacaacatatataaacaaatttacatatactatataacacgatgtataaatcaattatcaccaaagtcaacccatgtactgtaatctgccctttctgtcccccaatattcttttgttgctgctccgtatgctaattcataagaccaaatgtttgaaccacatgtttcaaggtacgtatctgcgcagaacggtaactttggtacgaatgccaattggccatcgcgagcaacaagatcaacgtggacggtctcaggccacttatagaatcttggaaggaatatcatattctgcatccacttaaatttggacctcttcatcatcgtcgtcagcgatccagtgaatattgtttggccttgcaagctctctacctcctcccactccatcgtttgatcattaagcttgacaacatggacaaccttcccacggcgtcctattagtacaaccatcaactcacctttattggactcgaccaagtagctgtcttcacatttgaatccgaagccgttgggcttgttaagaatctcaaacccttcatcaggcctgcaaggattatacaccaccaatttcccgtcttgagcaagaaggtatagcaaaccgttatggaggacagggttggtgactggtgatgcccgaagccgtggacagtagagatgattctccgtcgacttccagccctcccactcatcactggtgtgtcgaatggagctagcaaccttgatggtgatagttgccttgacaccaaatagcctctcatcatcacggtcggagacgacaaaattaaacaacatataaggttcttgcggcaatacttcaacgagggcgccggtgacaaggtcgatatcatacaccaaggctttgtccgcgcacatcttgaggtgccgtcccgtggagcagcaaatcttcgcgccaggcaccttgagagtgtcatcgacctcgaaattcttatcgtagtaggggctatagtatcggatgttggcggtgccaacctcggcggtgttgagcaggagcggagtgatccacgccgggtaaaagggacagagcgacgcggcagagcgccagtgccggcacaccaacgcgacgctcgggtggctcgaccaccgcagactccccagaatcaggacgagcacgtccgtcgggagagacgaccagccccgagcctgtgacgtcgatgccatctcgatcgcttgctcgatctcgccggtttaaaccgtacccagtgccggcctgatcgggagagacgacgtgagcgcggtgtgtatcttcgtctgcctatggcgttaattttcttccacttatgacttgctaatatgtacgtagggcgcagtggagcgaaaataccaatcggtttacatgtgggagttgcaatgcgatccgagttgtccggggaaaaacaaacctacacgtaaacgtacatacgtgtgccgctggccggcacggtatagctctgctgcacgtacggtcggcaatttggaacggtgattttccttagaaagggatcggattttttttctactagaaaaaaatgcccgtgcgttgcaacgggtgaaggctattttaattatattattgttatgctagaaaaatgcacatgcttcgttatgggtaaagcaacagttaaatgctataaagtctagagttaacatgtatatatatataataatgtttcaagatagataaattattcattaggctaatgataatcacgccggataaaaacacgctctctctctctcaacccttgtgtgacaaactgtgatatcattgcactgggtaatggtgaggtgaatgaaatttgacctcaatgatttattgaagcacctttatagttatcacaaatgcatatttgtgtttggataattaatccgctctacacgtgcaggatgtgaatgatgtccctaacacatggtcccgatgattgtagcattggagaaacggacgttcgagcaacgcacctttacgtataagtaaataatgaatttttttgggagttcattaattattttaaactacattttttatgacacttttataatcttttttcataattgatgattgctataacattgcattgattataatcacaatgcaacagtacagtgctatgctctaaccgacaaaacctgaacagtgccagccgtaccatgccgttcctttttcttttgtagaaaacctcttagcacataattaattgagttttattattaaaaaaaattaagaaaaaatatctagtattttatatcaacttgtatatagaaagttttaaaaacacgctaacaaaaatcgagatagaaggaacggagccatggtgtgaagtttcacgccatgcacatattcaattttcatgtatttttaaaaaataccggttggttcacgtgtttatactgatttttttatataatataataatctttatttttcgaattaaaaactggtgcactataagatttcagaatcactaaaagtctgttaaagaaagaggtgcagaacttttgatttttcagccatcggatgtgcatgatccgtgctagtggttgagagaaaaaaaaatacgcgcaaatatgatttgggacgagggagggaaagtagacttattctagggcctaggtcaacatatatttatattgatttttgtgaatataatttaattgtttttaattttcgaattaaaaactgataagataaaatttcataatcaataaaaatctgttgaaaaaagagaaataaaatcgaaggcaaatataatttgatgtgggggaggcaaagtagacttattttaagagaggcctatacagtgcaagtaataatacacatgtaagagatattacggtatatagattgaaaccgagaggagcggtggctggcctgtgctgctgtgctgcctgtctattttataagaaggctcgtgttttgcgctgtgaattagattccaactcgactgaataatcgaatcagattcgaactcgccgtaaccgcgtggggttcgcgtacgcgcgctgccacaaaacaccataacaccagtccgaccgcgctccttattccgacctgatgctcagctctctaccgatattgtactacatctcttctctagtatctctactactccctccgtattagaaacataacaatcgacgccatcagatcagataaccaacattttttttttgaaccaaaagtttgcatagacatcctgtcacaccccaatccagcactaccatacaacggcacctaacgggaccgtgtcgtaaaaaaaacggtgtaaaccgcttcctacgaaaccgcgatatcggtagcagtcccagtacatagtgctggtaccgacggtgacaataatgaaccattgcaatccttaaattaaataaatgacttatctaccttaacttaagttgcaaccctagtaaaaaaaaacggaccagcccaacggttgaaccggaaaaaatcggaaccagcccctcagccggttcggtttgctgtaaggaccggatatgccatcgaaccagtcacaaccggatgaaccgggcggtttttggtgaaaaccggcgaacaggacgcatatgaacaagcggttctggcgagcacgtggaccaggctacaaaggcccactaggcttataattgagaattgtcaccacccctacattcacctcaaacctactgcgggagacggagcaattaccgggaattaattacctagagctagctaaacactaaagcaatcaatatattttactggattacagggaacaagatcccgcacgctaattaggaactaaccaagagttaattctcaccgagcaaatcttaattactcagaatgataattatattaaagatgagtaattaacaaagtaaaataaataagaagatgattaccgacaactccagaattcctccgacttcttctactatactctctccctaattctagtatacaaaaaagtacaataaaacctcttataattcagctcaagcttggagtgtgtgggtgaagtgagaatgggagctcaatttataggcaggtaatggtggttataactatgtgaattgtaggaattgccctacaaccaccatcaggagaccatctagaacgtccattacaaaacctggattcaacggtgatcaccagggttcagccgaacctgggctgggcccccagatttggtctgggcctcctcgctgctctgccttatccatttattcggtagttgggcccatgttctgatgttttgatggagtttaggagcccagctcttgtatggatagaattcttcttcacttaagtctaaatttcctcccaactttggtggtttatcacctgcatccaaatatacacgaaaaatgttagaattaaaccctaccactatgtttgatgtattattaactatgttttatgcaggtattggcagcatagaattgtcatttaatagctgccaacactggtattttgcaatcagttttgttttcgagttttcaacaatctaagtgtgtgatttccacgaccagagtgagacgagtcttagctcggtcgggggtgagaagttacaaattgatttgcatgttttgcacaactccctgagttgacctcaaagttggttttcccaaccaaacgaatttcccaatctttcagagtttggttgtctccaaacaaccaggtacttcttgggactgggcaacaaccagttacttctagggactccctgtcccactgtctccttgatagccacttgcttttccaaacatcaggtttcccaaaccacaacaccttttcacaaagcagggtaacacaaaatctacgctaaggaatcagtccttaaaagtgaccgcacaagcatcacgcacaggaatggacttgtgtcgcgagttttgtttttaaaactcacattctttcacaaggcaccgacctaggcgtcgggttttccaaagcttttataaaccaagttttacccaagatgtttctcatattttaaatttgcaagcgaccgtcgatactcgcacaacgtgcacgaatatcgaggcgcaacaaggtggttacaagggaacatgatataacatttaacaatggaaggatcaaatgcaacaagttaggtaggtccgccagtctgccttgcagacgaggcaaacagttccagtgtgtcacgcccagaaattcacgaactagaatttctaagctgaatgtgcattaaaccccctgtccaggaccagccagggtacacaaacgacaattgttgacatacagatccacgtcttacaaaaatataaaagattacaaatgcagcggaaaagataaaagcgagataagcctgaagacttgactcctgcagcgggcgattccattccacagacaacccttgacggcagcgacgaaaccaacctcttcgagacatcaccaactgagaagaatttcaactctggtgtgggggaaaagagagcaagactgagtactacccactgtactcagcaagtcataccggaagaggaggtatgatgcaagatatatccaagggaggctaaagattcttttgcaaaaagccggcatttcaaagcagtagttgaaaacagtaaaacaatttcagtaattaatcaatattgaccaatcactgctcaacgctacaccacgttgagacaggcccaaaccaccacctgaactaaccagttccaaaggctaactaggggtgagactaatcacggtgaatctggtcgaccgcccataaccgcgggcacggctattcaaatagttttactctgatcagaggtgtacaactgtacccacaagacacagccccacgacacgttcccgtgcgccgacatgccaccacgacataccggaaagaggccgtgacaggactcttcgcataaccccctctaaccgatcgcaccacaccttagggttcgcccccgtccccagcaggcaacgggcagcccccctttcgtgccgtggtgaatccggaagccgatcaaccggacacctcggccgacccatgtaacgccccgattttcgttcgggattaaaatttatttaataatacattttctagaaattaaataaaagttaaagcaatttaatcaagtgaaattatggaggaaattaaaatttcctttaaaaatcattggctggaaatattttgtaatattctttgtgccctaatgtactctccggaattttccgtgaattttcggagctcaagaagtaattttaatagcacaaagttcatccaatcaatttaaataaagagaaaacaaattaaatttccatcctcaccttttgggccggttttcggccaatccacccctttcttcattccccccc

SEQ ID NO: 78390 - DNA, 12062 bp, Oryza sativa
aatttcatatggtatatttctaagaaaaaaataagataaacaatattttcccttttttattcaaggagaagccaaattacactcgatacccattgtcctcatagttacagcgtagtgttgttgcccctcctctatatttaaaaggtagaataggttacatggtttgactctagctctactgtcatataccataaataaaactctaagtccacttgtaacaaaatatagaactcatgtatttgatattttttaaaacaaacttcagcttagcgaatataccatcacgcctactcttatctttatagctgggtttaaaaccaaatctagtatcttatctcgaaaagtacttgatacaaggtttaggttgttttggactaatggattgggaacctatacccagctcgcaaatggagcaatagattagcggacgatttattaattaagtactcccttcgtttcagattataagatgactttaacttcaaattgctttaagtttgaccatgtttatagaaaaaaaatagtgatgtttttgacccaagataaatttattataaaaatttatttaattattagtttactaaaactaatttggtaatataaatattactccctccgtttcatgtaagtcattttaacatttcctatattcatattaatgttaataaatatagacatatatgaatatggtaaatgctagaattacttacattgtgaaacggaggaagtactatagttatctataaacttagttaaacttgaagcagttttaattttgaccagtcaaaacatcttataaccggaaacagatggagtattagctaaatacttttaaaatggattagtacgattttttaaagcaattttcctatattttttttaataaaaacacaccgtttaacgttcaagaagaatgcgcgtatgtgaaaaataaggaaggagaagttaggaacatgcatatacgaactcgggcttactagaagatttatcataatggccacatcatttctactgagttatagagctcaacgtaatgcagatgctgatatcccttttttaaagtctatatcagcaagctagttcccaaaccggtcagcattggagtgaatagtttggaggcctttgactgatgttcaagaagaatgcttcctaagctacgtttacaatgttgtcctgagatttttggcttaaaaagattgtgccggtgaaacactatttctttttagactttgcttccgttaagagagtagtagtgtagtaccaccaccaccaatttccgatgtttgtaaccttgccttctttttccatttggttatgcgtacccacacaactttggtttctgtttgtcattgttcttgagctatactggtaggtacaataggttcgtatgaagtaaagattgtttagtactcctacgtgaaccagttctattaaagtctatttggcacaacttcatattcgagatttcttggagctaagtattcctagctttacaaatctatgtatccggatatatgattatgttgataatattcgaatgaatcagtttgtttttttacttttaaagaaatataaaattttaaatcaatctaatttaatttattaggtaaggacccgcttggtagagttttaacttctaaatttaattacaggagttagatatatagagtgaagttgtgaagctatctaaacttgtacatttatatagtttactttgtaagaacgctctacctatatatctgttgaaaatataaataaagttacaaagttctgtcgtcatatcattttctatatatctgttgaaaatataaataaagttacgaagttctatcgtcatatcatttccttcaagagaagacgttgaaaattttggggagaatattccaaaattcaataattaccaaagagcatcgaatatggtaaatattatctcaaataatccaaaccagcatgaatgcagaaggcaacaagtcacaatatgctcaaggtaaaatccaagttctcaggaataaatagagcgtccgtgatcaaaagaagacatttaactctctgaagaacccgtgatgccacaatatgataaaaataagagtgaaaattgagctccctctccagcttctataaaagggaaagctggcaaagccagaatgacacagagaggcagcaaccctcactccctcagccagagtcccagaagccactctctagctcgtaatctgttaagagtccaccttgctagtatattggagaaatgattgtaatataatttgtgtaaggtaagcaaactttgtttatatcatccctaggggtttccgaaagggaaaaccatatgtatgttattttgtggtaatgtagtagttttattaagttttctttgctaagcccttgttctatttatgtgagtttacataaaaataacctgtagggtccttaccgtagaactaagctactacattaccacaaaatagcatacataaggttttctctttcaagaacccgagagatggtataaacaaagtttgcttaccttacataaattatattacaatcctagctccaatatactagcaaggcgggctcttaaattactactactagagctagagagtgacttctgggactctatcagagggctgctccacttcgtgtccttctggcttcgccagcttctccttttatagatgccagagagagagagagagcgcgcgcgcgctcaatcttcactctatagttatatgtcttcttttgatcacggggcgctctgtttcttcccgataacttggattttaccttgagcatattgtgacttgttgccttctgcattcatgctggtttggactatttgagacaatatttaccatattcgatgctttttggtaattattgaattttggaatattcttcccaaattttttaacgtcttctcttgaaggaaatgatatgacgacagaccttcgtaaccttatttatattttcaacagatatgtggtagcttcacaaatctacgtatatggatatataattatattgataatatttgaatgaatcattttgctctttactacttttaaaagaaatataaaattttaaatgactctaatttaacttattaggtttaaagacctgtttggtagagcttcaactcctaaatttattatagaagttgagtcaagagtgaagttgtgaaacaacttaaatctagctcaaactctatagtttgttttgtaagaacgttccacctattttcaatcttattttaggtggaggttaaattatttggctgaactccaactctagaagaggtggagttgaaggttaaccactgccagacctctaaatcaatgtgcatctgaaatagcagaacctgtaaacaggttccaaaaggaggtccgtaaacatggttaacgtccgcgcagcccaatattaattgatccggaacgggattcgcatttgcattacgtgtaagttgggccgggcttggtcaggatgaccgatacgggcctagatgggcctgctgctgctgctgcctgctccccactccgctgcctctgcggcgggcggcggtcctcctcctccgcgccggcgtccaccgcccggccgccggcaggccagtcccccgtccgtctcctccattgaaaaccggaacccaggttggaaggagagagagagagagagagagagccagcaggcaagaggaagttgcccggaaattttcggtaagctctgctctccgctccctttctgcccatgccctcttcctgttcgtgcttatgtctgcttgaatttagtagtgctataattatactgtactagtgtactggttctaataaacctttggagagagttcctcttgctcactgatgcttactagtcagtctagtccatagatttgctaggaagctcccaagaaagaagggagccggatcggtaaagaatgcagtattcgcttggatctacccgtttaattaggtagtctattccatcactataagcccactaagtggggcttgtcacgacctcacgacacatcacaccactcagttcttggtcaatgatcggcaaaacagaagaaatttcatcctggagtcgctttcgtcggttgggctagtgttgactccagagaaaaaatacaattcatgcccagattactactccaattccagtccagctccttatctttcgttttattgctgaattgccagctacaagatttcctagcagctacttcaatacttttgctaacccccgttctcaattctcaccgtctctcctaccatggccttggctttcgccggcaaatcggtggctgtgtcggccatctccatgattgtccgcaagtctttcgattaccttgagaagtatgcgaaggcggaggggatgaagtcggtgcaggagcggcttgagaggactctcccacaagtccaagttgtctttgatgcaattgatatggagaggataagggatcagagcgaggcgcttgatgcctggctttggcagctcagggatgccgtcgaggaggcagaggatgtgctcgatgaggtggagtactacaagcttgagaaaaaggtgaaaactagaggtaacaaggtgagcagctctctgtacaagtgcaagagggtggttgttcagcaattcaatagtacttttaaggctggaacttttaagagattgttggatgccatcagaaaacttgatgaaattgttgttggtgtggagcgttttgttctactcgtggaccggctggattcttgtacttcaaggcacgtatgtcatcaggaggttagtaatcctcgtgagactagctccttcagtgttgatgaaattgtaattggccgtgatactgagagggttaagattgttgaatggctgattgaacaagacaacgttcatgaccatgatgtttgtgctgtaaatgctttttctatagttggcataggtggcatgggcaagaccacgctagcacaggcaatctacaatgatcaaagagtgaagcagtgctttgatcaggctatgtggatttgtgtgtccaatgactttgatgtccctgctctgatgaaaaagattatacaagaaatcactagagaaggtactaatgttactaatttcaatacacttcaagaaatcgtcagagagaatctgaaatccaagaagttccttcttgtatttgatgatgtatggaatgatgagagaaggcctgactgggagaaactagtagctcctctgaaatttggtcaaaagggaagcaaaatcttattgacaacccggatggaatcagtggtagatattgttgaaagggtactaggaggaagaaccaagtctctacgattggagggactgcatgacaaagatcttttagcaatttttaacaggcatgcttttttcgaagtaaatcctgatgattatttcaacctacaggagataggcaagaaaattactaggaaattgagtggatgcccattagcagcaaagatcatgggtgggctgttgaacaactctctggatagcatatactggaacagaatgcttagagaaaatatctctaatattgagcataatagtgaaggcattatgaaaattttaagattaagttatcatcatctggccccacatctacaggcttgcttcagatattgtggcatgttccgagaagattactggtttcgaaaggatgagctgattaacttttggatgggttcaggactaattcagctatctgcaaatgaaaaccagaggccagaggatataggagagttttatttgggtatactaacaaagaagtctttctttgaactgcagttaaacaaatccactaatttgtatgaaggctatggtgagtgtactaatgaacactatgttatgcatgatttattgcatgaacttgcacgtacggtttccagaaaggagtgcatgaggatttctagtgatgaatatggcagtattccgagaacagttcggcatgcagcaattagcatagtaaatcatgtagtgatcacagatttctcttcgcttaagaacttgcggaccctcctcatatcatttgacaaaacaatacatgaaagggatcaatggattgtactgaaaaaaatgctgaagtcagcaacaaaactgcgtgttgtgcacatacagaattcgtcgcttttcaagctgcctgacaaatttggtaatttaatgcaccttcgctatctgtatcactcggaatcgcagaagaaagtggggaaatattccttttggtgtccatgttctatatacaaattatatcatcttcaaatgatacagttgaatagatgtctgttggtatcctggcgattgggaaatctaattagtctgagacatatatacttttctggtactatatatggattctccccttacattgggcatttgacttcccttcaagacctacatgaagttaatgtcccacctaagtgtggtttcatagcaagcgagctcatggatctgaaagatctccgctatttgtgtatccgttgtcttgagaatgtcaatgcagacgaagctactttggctaagctgggtgaaaaggaaaatctcattatgttgtcactcacttggaaaaacagccaacaggaatcagacacagaggaacgagtactgaataaccttcaacctcacatgaacctcaccaagttaaagatcaaaggatataacggttccagatctccatgttggttgggaaacaccactatcatcaatttgacatatctctatatctctaattgcagttactggcagcatcttccacctctaggcgaacttccttccctgaaatatctgtacttaatctgcttgaactcagtgaaaagaatagatagttccttctacgggtgtgagcgaccttttggcttcccatctcttgagtatctatttattgaacatcttccagcactagaagagtgggttgaaatggaaggcgagcatctgtttccccggcttaaggcactagtcgtcagacactgcaaagaattgagaaatgtaccaacactaccatccactgttaattatcttgaaatggatagtgttggtttgactactcttcatgaaccctatgtgcctaatgaaaatgcagaaccccaaaagccatcactctccaggctgaagatctgtcactgcccatacctggaaacacttgagcaacttaaccagtttctttctctggaggaactacatattgaacattgtgaaaatcttgttcaattgccgatggatcacttacagatgctctcctttctaaaacacatgacagtgttgggatgcccaaagttaatggtccctccggcaaccatcaggttgccgttgccaacgaaaaaacttcatgttgggtcatgtggtacttatgagacttgtctggttaactcattgtgtggtcttacttctcttactactttgatgctatatggttgtgatatagcagcacttccacctgttgaagtgtgcaagagtttgatagcgctaagttgtttggaaatcgtaagctgccacgaacttgcggatttaaatggcatggaagagctaacatccctcacagagttgaaggtgattgggtgcaacaagcttgaagagcttcctgtcgtttcatctcagcggtttcaagcctctgaacacaaccaagttgtcactgcctgtacttcataccttaggaaacttaagagactgcaaattagcgatccatttgtcttgcaatgggccccactgagaagcgtcacctcagttacaaatatgaccatcaacagctgtagatgcttacctgaggagtggttgatgcaaaactgcaataatcttcaacgcattggagtgagggatgcttcccatctggaatttctgccctcaatcatggcaagcctcacctcccttgaatccttagagtttacaagagttatgttaatccagtcacttccagaacttccttcctccttgcggaggcttcaaatccttggttgtaacccggtattaatgcggcgatgtcgaaagagtagaggtcgtgattggcacaagattgcgcatatcccagatctgcggattgtagaagatataccatcgtcatattcatggaattcatacttgtaatttttctatatgcaagtcgtcccttctttttcctgagctggttcctgttttgtaggctaagctgatgtctttaaagtttaaccctaacttatttgccccttggtgtattttgacacatttgtaacatttaaggcattttcactgacgcctcctatttgatttgcatctagcaatatggaacagagtgttctgattatttccgtgggtttcgactatcctaccattttccttttgtgtttttgctgaagttttcttgggtatcggttaattcttcgttcttacagtcctgattgcctgaacaactcacagaaagtatgatgttgatgactacctgatggttttctgtgatcaaagctaatgattgatagccaccacttatagttaggtctttaaataattagattccttaaagctgtcaccaggaacttcggatctgcttttctggggatcaaaggaatcatgtctgaattccaatcagaggccagtcacctgatcgatcaagttcacttcttgtatacataggtttttggcattgggagtgctttgaattctacttccatgctctactgttgcttatgcttagatcactgtattcgattgtctaaatgcaacttgcatgaccggtatcgatcaatccttaattaaacttcctgtgacaaaacaaagccccagagcatcagaggttcttgctaattaatctgctaggggttcaagaaccggaaactaaatatgtactcgtggtttttcgttgataaatcatgagtgccgtcatcaaagtacaaggtgagagtcaaagtgggggtgttgttgacatttcggtttatttagatgaatttacatggtacaaactagaaaatgtgtttcttttgagactagaataatatcccagcctctacacctggagatacacatggaaatcaatacttaagttttacaaggctttcatgctgagcagaataataaaagaaatgtaaagcaatatttttgtagcatttgatgaattaataaatttaagcctgtgcacaacctaccatttgacccagttctttttgtctttattaaatgtatgaatggttgatagattatcagtttttctttttcctaatatatgaggatacaataggacgacgaacacagcttacgaggtttggagtgttcaatgcttctcatctggtgtttctaccctcaatcatggcaagcttcacctccctagaatccttacaatttgcagaagccatgttaattcagtcacttccagaattgccatcttccttacgggctctacagatctttggttgtcaggagagcaaaggccatgactggcacaagattgcacatttcccagatctgcggattgagcaagattctgcatcacagtgttcatatacatgggttaagggcccctttgatttgtaggaaaagtgttggaaatttgaaggattttaatcctatggaaaaaattcctatgataacctttgaaacaaaggattgaatcctatactatcctttaaaattcctatggaatgactaatcctatagagattttggagaaaagttagcaagagttccaacctcttggaaaaattcctttgagtctatctctctcatccgattcctgcgttttttcctgtggtccaatcaaacggtcaatcctgtgtttttcctgtattttccaatcctctgtttttgcactgcattcctgtaagaatcctatgtttttcctattctttcgtttttccattcctacgattcaaagggccctaatagttctattttttttccccttcgatcatgatgctgtaaaaccctgtcctgaatgtaagtcctcccttctttttatttagttcattactgtacacagctatttagcacaaaacattattgaacagatcaagcattctggttattcacttagtttttttttgaacgactcgcacgagacggtgcgaagttctattgatagagcaagaaaaaaatacaagattacaaccctggagggtcgtaaccaggaaaaaggaaaaaatataccaccacccacgcaccgacagcgccaacacacaagaccgggagaaggctaacaccagactggccgctgctaagcgtgaccgactgctgctagaccaacaaaggaacacagacgagatcgcccaaaaaaatcactctcacaaccaacacaaagccaactcttagagcgtgcttgcaccaatccatcgagaggcttcggctaggggatgccaaaacgatgtcttcaagaagagaagcgacggtaaaccgccgccgccgtccgtcggggctcacaggagccaggattgggctttcgcccgacaaccacccttgagggatgagacagcacgacaacgccctcaagagggagaattaaccatcgttgtcggcccggccatggccgggctgagttttcacccgctgctcaccacctgcgaatccacggctgatgcaccaatgctcccaccacccctcaacctctgccgacatgtgggacccctgcaccggcgccccccgccggccagccttcgagcgccgaagaccgcaccacatccaccaacagctcctcctcgtaccgaggtcgcctcctccaccgccggcagcgcctctcgcgccaagccggcctcctccaccggatgcgcctctcgtaccaatccggcctccctccatcggccacgcctctcgcgccaagccggcctccatctccgctgtccgcgcctctcgcgccgagccggcctccgctgccatcggctacgcctctctacgccaagccggtctccgacccatcctccaaacgctgccgcgccggccagatgcagccgtctcctacgccctcggctagccgtccgaggccgccatgcatcttcccaccttaaccacggtggtcaccaccgtgcctcctcccaccacagccacggtcgccaccatgcctccacattcacggccgccgcaagccgaccgccgtcgccgctgctgaccttatcattcctgaactgctctcataaatttttttcccctcccataaccagataaaaacccatcgagatgacttctgaccgctgtaggtcatgcaagtgaagttgctgctgcttcaactcatcatcaattcatcaccaccaagaggaacttggatggatgcttctcgggggtgtaagggcattattcagggaagtccatggtttctagcgaagagactcctctaacgcactgtcctctgatatgcggcacgctagtcatgagcacatatgtcagccacttaaagttagagagcagtaagttagaggatctatttctggttgctagagccttttaatgctggtacttcagggcccaactcttgaggatgggttatggatttattcagtgaggattgcagttttattccacaacatcaaatcctatatccctgcaaagacacaagttggggaagcgctctctcaacaagtcagcagcagatgagatgcctgtatttatagtgaattgatcgtcttatccgtggcgcatcaccagatgatatttctactctctccgttttaaaatatagcggcataataataggtagctatattttaggacggatgaagtagctatttcacgcttctgtcgttcacaagccgatatgtcatactactaccacttcatgtctgatcagtggtcacaaggctcagactctcggagtcctgatcagatgcagttatatttttattttcagaaattgacactggataagcattttgtatgtatactctacttctttactctccttcagctcatgcttagttttattgtaccgagtgggcgcaacctgcatgatcactgtcaaatgtggatctccctgtaccaagagcccaagaccacagatcatgtttatttaccaaatcatcaaagctgatgttcctgttacatgtacctttagtaaatcgtgtatactccctccgcttcatattttaagattttctaacattgtccacattcatata

SEQ ID NO: 78391 - DNA, 24201 bp, Oryza sativa
  unsure (1)..(24201): unsure at all n locations
ctctcccatttccccctcctccccgagcccgcggcgccttttcccgctctcaccgcgcgagccccagctccgccgctcctcggcgaactccagccacgccgcgccgccgctcccgttcaccccgcactgcgccgtcgccctccccggcaccgcagcagccgtgcgcaccccgtccaccgctccattttccctctccaccttcgaagcgccgcagccacgcgcaccacctnttttcgccgccaccgccggctccagccgcctcttctcgccgcttcagccaccgccgtgccgtgccgtcgccaccgtcggcatctgcgcgccgagctccaccccgtnctacacctctttttcccaatctcccaccaaaattccacctncactggtcacccgagccgccttaactataccgnctccagccgncgtctntcgtcgntctagccgtcgccgcgccgcgtcgccgcgctccaccgcaccctggctgccgctccattccgtccagaaccccacgggagccgcttttccaaagtcaaggtgagctccactccgtatcgccgccgtcggcagtcgtttttggtcgctccgtgccggctcttccctccctaaccgctccaatatcttcccaaggtcttgccggccctcggccgcggctccgttgtggtcgggcgtcgtcggaacgctgttcccgtcgcctcccatcccggccgccgccatcctttccgccgccggtcgtcgccgaggccgcccgcgccgtcttcccgagaaggcgtcgccgccgcccgttgcccctcgccgccatggcgctcggtgagctctccctccgtctcccctccctttttccctgcatcggccgcttcccgtgcccgccgctgcgccgcgtcttgtcgccggcagccgtccggccatgcgccgccgccggcgttcgggtccatgccgctgccgcgcgctggccgtggcccgttgctcaccgtggaccactgtggtcttggtccacggtgtagccagtcaccgtggtggaccgagtccaccgtgggccgcccccttggcctgctgacgtgtggggcccgcctgtcggcgccggccctttgctgacgacagcgcttgtcatttcctttgagaaattaattattaattgcgcaataattcggtttaattctagaaattcatttaaatggctcaaaacttctaaaatccatatctaattcattcgaactccgaattgagccgttcaacttgcaaaattcatctaaaattgagctctacatgtttgtttactttttatgtactgttttcttggtttttattagtgtttttcctcattttgcgtgccagcgtgtagaatccgtcgtttcggaggtccgcggtcgcgaggaaaagagttcggaagattgttttgaagaagcaaggcaagtcacacattccccttgagcatattgagcctattttataaatgtttcaccgtttgcaaataaatatgcatgttttgctaattacatgggatctgggtatcacctatctgctcgcttgtgccatgtttacttgatatctgtcctttgtcaaccttgggtaataaataaactagctcatgttacttatgtgacctagctagaactatatgcttagccctgcttaaataacactagctcagttgatgggataattacaatattagacctttttagtatcagaatgagctgcgtgctcaagacatctggccatgcttcatggtcgtaattatccaactaaaatgcgactacatggtgggctgtgggtgcatggttttgctagtcgcacccatggcaattaaggaccggttcgcgggaaaccctggaagaatttatcgtgcttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccggtatgtcgtggtgacatgtcggcgcacggaaacatgtcgtggggctgtgtcttgtgggtacagttgtacacctctgatcagagtaaaactattcgaatagccgtgcccacggttatgggcggtcgaccagattcaccgcgattagtcccaccctaataaatcgacccaatgcaccgtagttcaggtgggttggttgggtctgttcaacgtggtgtagcgttgatcagtggagatttaatgttactttaattactcaacagttttactgttttgctcaataaaatgttttacaactgcctttatgcaaatggccacaaaccgtccttgtgttccccttgcacgtctgcatcgttggtgtggctgctgaggacggtggttgtactcagccttgctattattcccccttttcagaagtgtagtgcttctgagctgaagacgaagttagaagaccaaggctcagaccccagttgagttttgcctgtggggtggagctgaagccccgctaggatcgccttttccgctgctgttgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaacccaactccatcacgcccaccctcgcctgggtacgtcggctagagaaaagctacactacaagcccaaccgttgcccacgctggcttgtggtaagtacgataagttcttccagggcatcctgcgaaccggtccttaattgccatgggcacgactagtaaaaccatgcacccacagcccaccatgacgtgtattttaattaaccaacaccattacggtggcactaaaccaaaactatgccgataatcaagtctatgctttaatgtgatccccctttgtgcactagttgaactaagcatggctaagcatctcctaaatcaacatctagtcattttaatacccaagttatcaatggcgtaagggaaacaacataaagctgagtaataggacccatcccacatgatattgtaaaacaatgcaatatttaatagaaatgcggaacatttgtaaattgggtacaatatgatccattgtaatgtataacttgccttgctctcgcactgatggaaccacagcaacgtcttcgagaaaccgcgaatcgacgaaacgaccgaaatctacgcgacaaacaaagcacacaagcaaaacatgctataagactactgaaacaggaaacaaaaccagtttttaatggattctatacatttttatgaatttactgagacttgaatggacttaatcggagctcggatgaattagatatgaattttagaagattgtttgtgtttttactaataaagaaaagtccttaatgaattattgagcaataaagcatcccagtgctgacgtcagcacaaggatgggtggcgccgacacgcgggacccgcgggtcagtgattcaaggagagagaggggcggctggcaagcgggccccaccgagcggcggctcatgggggaggaggagacgcccggtcggctcggctcggcctcaaaccggccgaccggttatgcgaaggcggcggcgcgcgcgcacggtcgccggcgacggtaactgcggcggtaagccgctggcgaacagcgcaaaggcggcggcggcggccgaagcggcggctcagcccggacggcgctaggagggagaggaaggggaaaagagggggaggggcgcctcaccgcgagttggccggcgtgggggaatacgacgtcgaacggtgacggcgagcggccggggacgggcgacgataggcatacgagctctgagacctcctagggaccaagatgggagggattagagggagaggggtggttaacggcgagcggattcgccggtcgaaggcggcggccatggggtactcaccagcgcgcgaggagaagcaagctccggcggcgggattgatcggggaaacggcggacggggtagcgcacaagcttgcgaacccggcgccggcgacggcccggtgcggcgacggctctagcggtggcggagtgcggccggagctcgcggcgaacggcggatggcggggtgaccggcgcgggagcaatggagagctcgggagggcttggctgaaaaaggaaaagagagaggaaggtgcgagcgtgctaaaataaaagggggggcggcgagtcgtggccgggacggcgcaatttccccggagtagtggggaaggtgaaggagaagagagaaaaagccgggattcaaatttgaatcccggccatctcgcgggcccgggggtgagcgggagtggggcgtgggcccgggaaagccggggcgcgcgggggagtggacgacgtggcccggggtagcagggagcgcgggccggcggttgagaaggaagcccgcccctccggctggaggttaggggcgatcccgacaggtgggccccacctgtcggcgcccgggagaaggtggggaggccggatggacttcggggagggggaggacaaggaatgggccggcggcccaaaaggaagaaaagaggggaaaaaaagaaaaagggaaaaaggaaaataaaaggatttctagggattctttaatgcttgtgctctattttaattggttaaaattatttccaaggctctgaaaattccactaaaaatcccgttagcttattttgacatgtagaatccaagaaaaattccacatgccgattccgattatcatttgcatttattaatttgaggaattagctctaggttaaattgaacaatttcttcggacgatttattttacaaattttaaagctggaaaagggaacttcagggcgtgacacagtgcaatcctatcggtgcataaatattttgcaagcaacataattaagttcaaatattggctcaatatgttcaaaagtggcttgccttgctcaaggacttgagcttcacaaatcttcaagaaattcacgcttgaagaaaatccggtaaccgcaacttggagctgaggtggcggtgcgggcggaggggggcatccgcggcgacgcggccggaggggaggtacagctcccctccctctcctatcccgcagctctactctccctctgcgctcggcctcgacaacgacgatgccgccgccgccttgatccgaggaggggaggagggcaccatcagctggaggggaggccagcggcgccgccggtgggttggggtggtggtggcggatttatttattcgctaaaaatattttcgcaggcgggtggttctacctaatgattttcgcaggcggtccgccgggccgcctgcgaaaattatctattttcacatgcctttacgtgcagacggtctcttccccgcttggaaaaaaactatttttggccgcctcgaaaaactatttttctaagtagtgcggattgtatgtacaatctatcacacctagaaaattgcataagtaagtattttatttaatactgttgtgcccgttagagatatgggattgtttatgaccatgactgatggttaacgacccgtcacaaataactactcatctatgatggtgttgtcaatgggtatttgtttaaccgatagaagtaacgttatctgtgacgggtcacaatcatccgtcgatgatgtgtcatcacggataaacagttacgcagaagtgttttttttttttagataatgagttacgcagaagtgtatcttaaacgtcgcccgtatgtataagatcattgatcatggagtgtctctataactattgctataagaaatttgcgtaatgacaaattgtatgtacaactctcattaattctatcgtttggcagtacgccagtaccttatcagtccaacaaattaaatgttctccgtcttttaacgctttgataatccacttccctgttcctagattacgttctgatctttatcccataataacaaaaggcttgtcgaaactagatttcggcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacagtagcccccgagacctttgcagtcaaccatcgtagccatctcaaaaataatccgagtgcttcaaacttttcatgccaaggcccgccgagtagcgaagacgaagactgtaaagggcgaaaagataaagaatatggtgcatcgaatagatgcacctaattaggtgtagcccccaactatgtgattagttaacaaactaaacatatagttgagaacaaaataacagcacaatcatgcatcatatgacaaaagcatacgcggcgcctaaagagacattcttgccgactgctttctagccatatgagtccgagtggtttacactctaaaaggttcacgaatgaacatactggacaggcatccgaatataaaactctaaagattacccaccaaatattataaaaattatggtaatgaataagtctaatagcctaggctatgactatttaccataatgaaaataggtaaataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgcgcgcataatattgccaaagcaaaatatgcctaagtccctaaggaacacaatgggccacgctgttaaaagtattgggctgaagtactgttcaggcttaggcccatttgcacctccgatacccttaacaagaaatcccgagatccaagcgacgcttcgtcttccccgccggaactctcaccattttccccactccttgctacagtgcagcactgcgccggcgaactagggttcaccattccactcaaatccaccttcgaaaagtgcaccaaaatccttcccgtgatccaccgccttaatccctcatttctcccaagccatccctcgaatcagatcagcacatttgagaaaaatcgatggcggaagagagagaaagcttcgaaagccaatgggtgccgtccgacatgacggaagaaaacctgaaggagatggtggcgcacggcgttctccctgccaaggagatcatcgggtggcggccagcgtgcggtgaggcttttccaacccctgatacacatgagatcgtagtcttctcgcatttcttctatggcggcttcgctcttccgacctcgaaatttttccgcgggatcttgaacttctatggaatcagcttgcatcacctaaacccaaattccatagtgcatatcgccaatttcgtccatgtttgtgaagcctttttgggaatcaagcctcactttgccctgtttcgccggatcttcttcctcaaaccccaaccgaacaagagcaaaccgtgcgtagtcgggggggcaggattccagctgaggggaactctgagccaaaagtatttctctatgcccttcaagacttcgaacaaagggtggcatgcaaactggttctatgttcaaaatcctgagcctgctcttcccgggtactcttgtcttcctccggtgtaccaagatacctggaactctcttccaatcggagatgaagcagtccaagccttggagttgatggaccgcatgttaaaacttaaagaacaaggcttgcaaggagagcagattactcggcatttcattaaatgccgactggcgccaatcaaagaaagatcccgtacagcattcgagttcgacggcaagcatgatcccaaccgtgaagaaccggactctctggacttcaaaatcatgaaggagagaatgtataaaattttctcaaatgctattgtcgtcagctactcgcatcagctgccagttgtgccatataatgcattcaatccgcctccgcaggtatgcatctgaaattcttcaacccaaggtcaaaacataatttaatcttcatgttgagttggctaactgcagaagcatctcattcaggaatatgtattgatgaaatctgatcccccaattgctcagcgccgatctccccgccagcacaccgttcagggaagtggagggccgacaatcaggtcagacccgcaacctcaaacttcccaaccgactgggcagacaggttctcgcaagagaaaactggtgctaaacgacgacgaaggcgacgacggcgacaaatctggggacaagggctcgcctcacaaactcccaaagcgtaccatgcccaagaagaaactggctggccgtcaaatgccaaagattagaacatcctccaggtaaaaactcctcggtaccatctctctttgacatgcctctctcatagaaattatgctgaatatcaaaagaacacttggcaggaaaccatccgacatagatccaaccgggaaagaccctgatccggctgtggcagaaccaaatatatccaaggatgctgagccgactgccgaaagccagccgactgccgaaagccagccgactggcgcccatgcttcggatgacaaggccaatccgagtgaccagccgccgactggaaaccagtcggcaacaactgaaactgcaacaacccgagagcccccaactagaaaccagtcggatgtaggtcttgatcaagaaatccctgaagttgaagcgcaagcgacagcttctcaaggaccagaggctggaaatgactcgatgattggttctcctgataaagaacaaggatcacctcgcgctcagccaggcacatcctcaggtaactcatcttctcaagtgatatcgttctgaatagctccagcttgctcgtctaatgtcttggaaatacatcaggaacactaggtgatgacgaagaaacaattcctcgcataaaggcagctgatgacttccgtcctcctatcttgctcaaatggtgggacgagaactcgcaagctgccggcatcgttataaatcgtcagaaagaagatgaggaagtgtgccagctgaagaaagcacttggagaagccactcgcattgtaaatgtaagtcttctaggtaactgcctttgatgactttattgtctcgttagcaaaactaatccatgaaccaccatgcagaggatccatcttcgcaatgaggccaagaccacaaccttagaaaagctggttcctcatttgggaactcttgaagccgttagggaccagctgcatgaggccaaggagtatgctaaaaagacagagaaggagttaagggaccgaattgcccagctccaggattcaaacttcgagctaagtggttcatcaaaaggtaaccttccagatctattccattgatctatgctgtcataactgtatcctcaaatatttggatttcaaacagcacaagctaccaggatggcacaaatggagaaacagattgaagccttgaaaagagacaaagtagaactagctgtgcaaagggactcagccttgaaggaggtcgaaggtactgccaaccgacaatttgaactttcctctcttttatgcagcagattcttattataaatatgttttgtagaccgtaaaatcaaatctcaagctcagtttgatgtcctgattggtaagatcaagaagcttgaaggagcaagagacgaagtcgccaatgtcgctacaccactcatccaagctatgttccttaataacagtggtccgagtgcacttgacgcaactgaaatctttgacaagctgagagttgcaccggatgtatacttcaagaatatcaagaaagctggaagcatgggagctagcatggcattggcgatgaccaaatccttgtacccgagaattgaaatcgacaccattgatggatttgcagatgggacaagtgaagaagctgctcttgatcttattagtaatgctcaaagtgcggctgacaagattgcaagtgatgttgtagagcaattccgcaacaacgaccttcagccgagcaataataactctgatgatgaaaggactgattctgactgagtgtaaatgtaacgaatggaggcttaatttgtacaatactggtgtatttatgctgtgcttgatagttctagccaagtctttgatttcttaaaagtttttatcaagctttgttgagcctaaaacccaaataagctattaaaaactttcagtcctcgcaaactaagtagaaaaagccaaacaaggcaatgatagaccaagtaagcaaattaaattgataaaaaatcacactccattattataatgatagcccccgactgacaacttcaagaagaaaacttgatgttgacagtcaagatagggaagtacaatgataaacttaagcgtagaaacgacgaagatgctcaatattccaagagttgtcgacaagagtaccgtcttcgcgcttgagtcgataagaacctggccgggtgacttcagagataataaatggcccttcccatagaggagataacttgtgccgatctcgtgtagtttgaattttccgcaaaaccaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcctcctcgtaactttcttcacggaaatttcgaaagcgcaaagactcgaattcaacttcactcggcaacattgcttctgccccatagacaaggaaaaaaggtgactggcctgtggcccgactaggtgtagttcgcaaagaccaaagtactgatggcaactgttgtacccatttgccggcatagggttttagccggtcaaaaacacgcgctttaatcccttgaagtatcatgccattggctcgctccacctgtccattgctcatggggtgtgccactgaggcgtagcaaatcttgattccgaagtcttcacaaaagtctttaaaaactccgccagtgaactgtgtgccattatcggtgatgatccgattgggcactccaaatctatgcacaatgttgatgaagaagtctcgagcattatccgctgtgattgtgacaaccggtttagcttcgatccacttggagaatttgtcaatggccacaaagagatgcgtgtagccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgtgcagcagcgtggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgaggaagctcttgagaagttaaaaatcgtatgaagggctctcgccagtcggcttcaaccatagctacgtcatgagtgtcggcatcttgagtagtatctttatgaggtacggtcggtgtataaaggtgttcgacgaaaacatctgagggcgccgtctcgcgcttggatccaaaattggcaagtctgtcggcggcttcattgttgtgtcgaagaacgtgactgagctcgagtccatcgaacttgtcttccaatttgcgtacctcttgtcgatatgccatcatgttgtcgtcaaggcaggaccactctttcataacctggttgacgaccagctgtgaatcgcctcgaacaattagacgctttatccctagggaaattgcaatccgcagcccatgaaggagggcctcatactcggcaacattgtgggacgccgaaaaatgtatccaaagcacgtagctcaatctttctccagttggggaaatcaaaaccactcctgccccagtgcccgaaagtcgtttggatccgtcaaaatgcatggtccagtgctccttgttctccgcgggggtatcctcctggcactcggtccattcggcgacaaaatcaactaacacttgggacttgattgaaattctgggcttgaatgatatgtccaaagacatcaactccaaagcccacttagcaatacgtccgtttgcttcgcgattgtgcagtatgtcaccgagtggaaatgatgtgaccaccgttaccgagtgaccttgaaagtagtgagatagcttcctggtagtaattagaataccatataacagcttctgaacttgagggtacctcgttttggagtcggctaggacctcactgacaaaataaatcggtcgctggactttttggacatggccttcttcctcgcgctcaacgaccaagactgtgctcacaacctgggaggtggctgatacatacagcaacaacggctcctgcgggtgtggtgaggctaggactggtggctcggtgaggagttttttgaaatcttcaaaggccttctgtgcttcgggtccccactggaaatcatctgttttcttcagtagcttgaagaagggcatcccccgctcgccaagtcttgaaacaaatcggctgagcgccgccatgcatccagtcagcttctgaacatctttctgggtacttggcggtttcatgttgaggatagcagtgactttctccgggttggcttggatgcccctatgagacaccataaagccaagcagcttccctgacggtactccgaaggtgcacttttcagggttcaatttcatcctgaaaacacggatgctcgcgaaggtttcttctagatccaagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtgatgaatgaagtcttcaagcagtcggattccttcagtcggatctgatgataccccgagtagcaatccagaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggttagccagccagtcgggatgaaggacttctttgatgaagcctgccgctaacagcttggttaattcctccttgatcgcgtctttcctgtcttgtgcaaatcggcggagtcgttgtttgataggcgttgcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagttttggcttcgctttctccactctttgaaatcttggtagcgggcacttctccttcgctcgccgtggctgcagccagtcggatatcctctcgggcagacgccatctcgcgagtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtaagctgtctcgaaattggcgacttcgaagctgatattctctgtgcgaaagttttcccgagtgccgaaagtgaccgggagggtgatctggccgagtggagttgcggataatcctggaatcactccgtgaaaaggcgcattgcttggttttagctcggagcgagggatctgcatatcatccaaggtcttggcgaagaggatattgagtgcgctgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcgtctttcttccttgacgtgctttgttcttcgtcggagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcaagaagagtgactggcggttgcaacaagttccgcaggcttacgcttgcgatccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccgactagttcttcgtggcgaatccctttggtgaacgcggcgatgatgacgtcgtcggtaatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccgcggggcaatccatggagccaagatcgggcggaatccgctaaagccactggtaaatagttcgccatggccttgttatctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggtgacgttcttcggtctcccgggcttggcgttgctcctccgtctcattattggccatgaaaacgccaaagtagagaggagtgtagttgtcatctaggcttccgtcgaagtcgtcgaagtcgttgaagtcgttgtagcgagaactaaattcgtcgtactccacgatgtcagtaggacgtgagtcgatggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtggtagtggagacggccgctaaatcgtcggggagcttcatcaggactggtgggtaagccccatcatcttgatctggtgttgttggagaagatgcgatctcggccgagtggtttgaagccgactcggttgagatggtcttgaagtagctttcagccgcgttcgggaatccgaacgagaccgaaagccggttctctcccgactggtctgattccgagtcgaggagagaaatcttgccgaagttgttggtgacgaagtcgaggctgccgaaccaaaacgtctgcccgggagggaagacgaggtcgtcgatgccggagacggaacccattgcactgatcggcgaaaagcttgacgcaacccctacctggcgcgccaactgtcgaaactagatttcagcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacaaggctattccccctaaagctcggattaattagtggttaggcctcgcctcctaataaactactgtatgttaagtatgcatgttatactgattaaaaataactttacccggctaactaattaaaatatactagaaccctctatacaacatacttcctccgtttctggacgccgttgactttataagtatatatttgaccgttcgtttattaaaaacttttatgaaatatttaaaactatatgtatacatataagtatatttaacagtaaatcaaatgataggaaaaaattaataattacttaaattttttaaataagacgaacaatcaaacatattaaaaggttatcggtgttaaatatttagaaacgaagggagtatataaacaaatttacatatactatagaaaacaatgtataaatcaattatcaccaaagtcaacccatatactgtaatctgccctctctgtcccccaaaattcttttgttgctgctccgtgtgctaattcataagaccagatgtttgtaccacatgtatcaaggtacgtatctgcgcagaacggtaactttggtacaaatgccaattcgccatcgcgagcaacaaggtcaacgtggacggtctcaggccactggtagaatcttggaaggaatatcatattctgcatccagttaaacttggtcttcttcatcatcgttgttagagacccggtgaacactgtctggctatgcaagctatctaccttctcccactccatgctttgctcgttaagcttgacgagatggaccttcttcccacgtcgttcaatcgctacaaccattaattcaccttggttggactcgagcaagtagctgtcttcacatttgaaaccgaagctattaggcttgtcaagaatcttaaatccttcatggtgcctgcaaggatcataaactgctaaccttccatcttgagctagaaggtatagcaagctgttatggagaactggattggtgcccggcgatgcctgaagttgcgaccagtcgggactgttctccgccaaattccagtcctcccactcgtcactgtttgttcggatggcactagcaacctcaattgtgaacatcgcctctataccaaatagcctctcatcacggtcggagacaacaaaattaaacagcgcataaggtttttgtggcaacacttcaacgaggacgccgctgacgaggtcgatatcaaacaccgaggatttatccacgcgcatcttgaggtgtcgtccggtggagcagcagattttcgcgccaggcaccttcagagtgtcgtcgacctcgaagttcttgtcgtagtaggggctatagtatcggatgttggcggtgccaacctcggcggtgttgagcaggagcggcgtgatccacgccgggtaaaagggacacagcgacgcggcgtagcgccagtgccggcacaccaacgcgacgatcgggtggctcgaccaccgcagactccccagaatcaggacgagcacgtccgccgggagagacgaccagccccgagcctgtgacgacgatgcggcggcggcctccatctagctcgatcgcttgctcgatctcgccggtttaaacccagtactgccggcctgatcaggagagacgacgtgcgtgagcgcggtgtgtcttcgtctgccaatggcgttttcttttttaaacattacagtgttatggagtatatcgtggtgtcccgcgcgcgcgcgggagcttatatatgtacgtagggcgtagtggagcgaaaataccaatcggtttacatgtggagttgcaatgcgatacgagttgtccggggaaaaattaacaaacctacacgtaaacgtacgtacatacgtgtgccgctggccggcacggtatagctctgctgcacgtacggtcggcaatttggaaaggtgattttccttagaaagggatcggattttttttaatagattagcaatagtgcacgtgcgttgcaacgggaaaaacactgtttgataatgtgacaccttgaaaacctcaaatctatattaacaaataggtagaaccgagtctaatttaatgaattagcataggatttaggatttagttttagattttatttttcgagcctacttaggagtttatccgacggagtttaatttaaaatatctgagccatattgtttgatcaaatatactttcggcccaggtcttcccaagccggcccaaacttgggctggcccatcttcggcgagccgagtcagttcgacggcccgcaagctgagcagctgaccgcagcacatatgcggggatggtctgatgcacttccgcggcccattgggcgcagcgtaatctgctgcggcggcggtgacccaacgctgggtaaatctgaaccgtccgatctaatatggacggctctgatcgtccccttgccggatgaagtgccgaccaggagagaggagcaaaaccctagctcccaaatccctctttctcgatcacatttctcttcggcgatgagcgagcggaacgacggcgaaggcggtccggcgagctggtgtgcgcgtgtggtgacgcccgtcgagcagctcctgcttcgccggctgggggacgcaaccgagggcggcacaaagccgtgccacggcgtcggtggtccggctaggcgggcgcgcaaacggcgatgagcgccgagcggcatggagctctcggcgggaggggcgacgccaagccgacgcttcccgtcttcggcaagggatggtggaggggtgctccaggacaacgcatgcacaaggaacccaatgtgactgcgaggaggtgaaggtgcggcggtgccacttcccggaaaactccggtgagctttgggacttcaagtgcggtaagtaacccgaacccttagcttaattgatttggatttttgactcttagggttcttacccgaaattaggtttcttcgaatttggggaattttgtcgggaaatttcaatctattttattccctcttttcgagttatgcgagtttcaatatcgtttatccacttttaattttgggaacttcaatctagtttatccctttgctcaatttattttttttttttttgctttggccggcgtttcatcacgcgggcggggacggagggcgccgctcggtcccgtcgaaaagattgagattaagataagatgatattttcacagacgacggaagtaaattcaatttaattttgggaacttcaatctagtttatccctttgctcaatttctttttttttaactttggccggcgtttcatcgcgcgggcggggacggagggcgccgctcggtcccctcgaaaagattgagattaagataagatgatattttcacagacgacggaagtaaattcaatcgtaagatactattttattcttttttgttttaatttttttaccctgttttggtttcgttattacggatgatggaagcgttttcaatatttaagcagtagagatagagatatataggctgtatttagatccaaaatttggatccaaacttccgtccttttccatcacatcaatctgtcatacacatacaacttttcagtctaatttcaaccaaaatccaaactttgcgctgaactaaacacaaccatagtacaatgtcacatataatagtattcgatttttttaccgcgtcacatataattccttttttttaattggacagaattcatttttttattttttttccgccctttttttaccctgtccacgaaatcggattctttttttttccctttttttcacctgatttttttcgcctgattcctttttatcggacagtcggttttttttttcgccttttttacacaggatcggattcatttttttccccggttttttctcactcgatttttttatgcctggtttttttattttttcgccctttttttaccgcgtccacggaatcagattctttatttttacccgattctttttttctatcggacagattcgattttttatttttttttttgtgttttttacacgggatcggatttatttttttcccggttttttctcacctgattttaatcgcacccggacgaaacggggagaagtgacgatctgaaaaatactaatcttttaattagttaagattaagataagaaaagaaaaggccagtgattttccttgtatttatatgggtagcgtttatgtgcaagctagacatttcgcatggatatataatttgtgttgattataacctgtcacactaatcaacgataaaaattaattgtatttaaaacttttatatttatgtgtttttagcgacgtaaaagctaatgttacaaatctctactacttaaaaaaaatttaaatgattttgtcgtccattctatcatggcaaaaaaaatcggacctgaagaaaaaagagcgaaattaaaataatcggtcctattcctaatcacaaaaggacaaaagatctaataaaaaagataaaaatatgtcccaccacaccttgcgcttgcttcgcttctcccccttccgatctcttttttgcccttattgttttaaaaaataaacaaacaatttaaattactaatcacaaaaagacagtgatctatctatctactactttacttaaaaaaagaagaggtgcttccatcgtccgtcaaaaaaaccgggtgaaaaaaaccggacaaacaaaaaccagtttgtccgataaaaaaaccggtaaagaaatttccttcgtccgtacagagaaaggaaaaatacgcgcgaataaaaaagtgcgtgcaaaaatagtttctgtccgattccaaaataaaaaaaattccaagcgaaaaaagagtttccatcttcctacaaaaggaaagaatagtgcgaaaaaaaaagtttctatccgaagggaaacacgcgcgaataaatacctaattaaaaataaatatctatctctaaaaaaccttctgtcgtaaaaaaagaaaaaaaagaccgactcccgtagagaaaaaaaaagtccgactcgtgaaaaagaggttttctcgtccgtaataaaaaaaaggaaaaatacatctaactcaaaatccgtaaaaagaaaaggaggaaaaaacgacccggccaaacttaaagtcgccttgttgtccgtatatatctctttaactctaatctaatctatcaatctaatctaactttttagagagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacaaaagaaaaaaaactgtttataaaaaaaagccgctctgaaaaaactaaccgatgaaacactgtttataaaataacagataaaaaaacaaaacgactcaacacgcgaaaaaaaccgctgttttaaaataaggttcgagaaaaccgtccgacttaatgcgagaaaaaaaccatcatttcaaaaaaaaaatagaggaaaccatccaactcaatgcgagaaaaaaaaaagccgccgtttataaaaagaaccactccgagaaaccgtccgactcaaagcgagataaaattgatggacgcttgggtcggataagatccatcgatttttttccatctcctacacatcatttcctacacatcatttgttttctcatctaatccctgcactttttgtatacaataatcattatcagactttttttaataacatattatatgaaaatagtattaaaaataaacatatttttaattgttatttagagaagagtgcactgtgactattttgtgtagacttgatcctgagtgtaggatttgattaacctattattggttgcaagaataagattgaaagaatattttagattatatgtatattgttatatgaataatccaattattttagttaaagcaagcattggtaaaaagattgccatcatcgagtttggtcattacataaagatgctctaattttctaattgtgttagctacaacgatccatagaaacattatcattgatatgggtacgcttgaaaaatgtcaattgtcattggattatttttttacccgttgcaatgcacggggcatttttactagtatataataaaagaacgaaaatatgtctcaccacatcccgttcatgctttctttcctcgtgatctcatttttttctttatctttatctttacatacatatttaaaatatttgtagtgtttctattattcgtcactgtctagcgtacatcgacggttttcgtgtttctgcattggcgccctagcagcacgtgcgagcttgattgcttccaaaccaaaattcaccgcttccacgtcgacggtcaatcatcccatgtgtcagaatccaataggctccacacgcatcacatccgatttgccttcccatgccaagcaattttgtgaatctaccatttaaacgatgtcaaaggatcgccaactcgtgaattaggaaataacaaagtcactaatataacaaatatacaatagtaacaagcctcataatccatatgacaagtggacccataataattagaaaatctaaattaataattaattaaagtaggtccattatgcacccgtggattttatatatatatatatatatatatatatatatatatatatatatatatatatatatatatatatatatatatatatatatatatatatatatatatatatatatatatatatatatatatatatatatatatatatatatatatatatatatatatatatatatatatatatatata

SEQ ID NO: 78392 - DNA, 23130 bp, Oryza sativa
tactccatgtgtcccataatataagagatttgggtgaatgcgatacatcatgtctagattcatcgtattaggatgtgtcacatccataaaaaaatctcttatattatgagacagaggaagtatacaaaattagagaccgtacccatatcgatcgtaaacaatttttttctaaaaaaggtaatcagagtgaaattaattatgtatacaacgacctacctccctagatcgagatccatggcgatcgacagtgcatgcagctagctaggttttggccgtcggttcagctccggcggcggcggcggagagcgcggcgagggcgtcgtccatgagggcgaggtagttggcgcgcatggcctcgaactcccacccctccatctcctccacggccgcctccacccgccgccgctcctcctcctccctccgccgccgattccgccggtacgccgacacgccggccaccaccccggccgccgcgcacaggaagcacagcagctcgttgctcgggctatcccccttccccatcgctcgccgtcgatcgatcgtcgtcggcaattaataatgcaagctcgatcgatcgatctagggtttatctctctctcttgttttggttgtggaaagagcaaaagtatatattcgtgatttcgtctatatatattcgatcacgtgcacgaagtcatgcaatgcctagatggggcacgtttggcggctaaactaaagggctttctgttattcctagcaaaagggggaaaaaaaggacttctgttttggtggttccgtgatctaatctacgtttaaaccggacgattagacttttttttatataaaaaaattatacgatagagtcccctaacggttgggcgggttggcaggattggtcctgcgtgttcgctggctctggcttcagcgctcagggcacccctactgggatggcctgaagctcaagtcgagcagaccgtctctgacatgttcgcggcatccactttcttcgtgcgggaaaatggtgagtctatgctcttctggtctgaccaatggatcgacagctgctcggtggcgtccttggctccagatctcctcttcgttgtttcccagcatctccgaggttcgcgcacagttgcttctggtctgacgaacaactcctgggtctctgacatctgtggtgccctcactgtcccggtcatctcctagtttctccttatttgggatgcggtgcttcatgtacagctctcgccaggtgtcgaggatcgtctcgtttggcgttggatgtctgaccagcgctactcagcgcgttcggcataccaggctttcttccatggccagcattcctttgcctgtggtgatcttctctggcacgcaaaaggtcctgctaaatgcaggttcttcctttggtttgcattccagcagcgctgcgagatggctgatctcctccagaagcgtggcatcgatagtcactcagcctgccctttttgcgctcaggattttgagatggcgaaccacatcctcctcgaatgtgtgtttgctcggcaggtctggctccatgtgctgtcgcctcctggctgggctgccctctctccccccgtggcagctggttccaggactggtggtcttcctccagggcctgcttacctgagcatctccgagctggcttcgactccctggtgttcctggtctcttggtagctgtggaaggaataaaactctagggttttcgactatgcgctctcctcggtcttagtggttctggagtccatccacttagagggccatctgtggtctttagctggcattgccgcttttggggacttgttgggagtgtagagtggctcggccccttcccgctgcttggagtttgtatttagccaccgtagttttttaagctccagcttcttttttgcttttattttctccttccctttgcataagctggtctggctgattgcgtcgtgtaactataactcttttcttctaatatattgacgtgtaatccttttgcccgttcgcgaaaaagatagtcccctaacacatcttctaagagacatatacgtacattcttgatctcactaaaattcttatacgtaggcaccaaaatttaaaccctgatgggtggagtcacgtacctacgactccatcaccgcactattggttttcctcggattagacttattgatttttaaatattagtacttaagatagatatctatggttagttagcatggaaaccactacgaaaattgtccgtttaattgatatgcatatatctcacatggttttcttacaaagttaacaaaatgatagttttctttagaaatatagtataaacacaaacctttacaacatgcgcacattcacctatatgaatacacaccataccatacccgctatgagcatatttgtatttgtatgttacctacgactgaaagaataattagctgtatgcccgtaaaagcaagcaccagggttcaaatggattggtttcacaacaagaaactaaccagttaagttacactcactttgcaaaatgatcgttttttatctgtcacagcatataagacatatctctcctgccttagatttttttcgccaattaagtaaagctcactttgcaaaatgattgtttttagatctatgcacaatatatgagacatatctctcctccctctcttgccttagagactcagccctccaattccattatcagaaatgatgagttttctacaagatatctacgggttgagaaggcatagaatgagccttcaaaactagacatgaaaaaaaaccccaaatgatgagttggcatgcaatcctagccttcgctcacccatccctaaaaaaaaattgtggtaaggcggcaatacagggccaatacccctcttgctactaaaagtcataaacaatgtggtaaggcggcaagtatctccacagtaccacattggagattctgttccacgtctaagtgaatgcacaaacagcacaacatgcgtatcacttacacagttctttctaagtatactatagccacataagcccacaaagtatttttctacgaatttgctagacctaattaataagaaataaacctctaaggaaaaaaaaagaaaacaaatgcaaatcgcaaatttaagaggtcgaaaaaataaaaatttcggaagcaacgcttgtggccattaactgaaaacatcaaagtgatcgatatattggtgatgcaaatgcgtgaagtaaatctcttcaaagtttccaagccaacaaattgcatcacagccgcctacgaaatccaacggaaattcaaatcaaattaattaataactagaacaaagatctgtaataatgcgcatgatggatcatatcaatcctactactcgatcttggcgagcttaattaattagctccagtctgcggcggcggcggcggccttcttgtgcgccgaccaccagtcgaccgccttgccgcggatctcccgcttgaggccctcgagccgcgccgccctcgcctcggcgacgtactgctccctccggcgcgccgcccgcctcttctcctcgcggtggccccgcgccacgagggcgcccagcctcgccaggtggtacagcaggaccccgccggcggcgaccgcgatcaccaccttctccagcgccggcgccgccgccggggccgccgccctgcaattcgccattaattagttaattggtagagctaatcgatctgtgttaattagttacgagttacgacgctaagctataattaactaacctcttcgtcgcacacacgtatataatgcggccgtaccgtattatccgttagtaattttcccgacttacggggcgtctcgtgttaaaagaggcatcgaatatatatattttaataatataattattttgtgttggaaatgctcgtatatttttctataaactttatcaaagtgacttaggctgagttcgtttggaggagttcccaacactcccctctaaaaaatgacgggtcagacatacaagtgctagcttgcttctgttagttctaaaaaaaaaaagcttgactctgttagagtaatttgaacagaatgggtggagggagcaatgacgacctaattacaaagtatgatttcttaattatatctctcaaatacaacttatagaggtgattgggaaagcacaaaatgtatacgtatggtgtggaatctgggggcaaagacagagagtagggattggagctctactccccagcctaaataccgattgaaattacactttgaaatttcaaaaaaaaaagagataaaaaaataaacttgtgtaaattacactaatcctgcccttggcttcatctgattttagctgtacaaatactggggcactaatatcatgcacacacaccgttgtttcgctctcactgggactcccgtcacctgcaggatcttcaagcccgcgagttgaatgtttcaagtcatagatttaggttggtatgggtacatttatgcacggctaatttttttcgatgttgacttcgtcaatcttaacataacgagagagctatatatatcttgagatattttaagttcgtcaacttgaaaagttactttctttagacgcacgttcatagtttaggaagcacaataaacgagggagttgcaaaaactaaatgaagttttaaacagagccatggatgatggaataaatattgtggctttaatttattaatttttaatttcgatgcagtgaacaccgtaaggatgcaggttcagactatactctgtaccattgtcacagtaaaacttcatgaacccaaccgggtaatattcatatgaaatgaatgaaaaactaagtttacacacgagatggtctttttttttggagcaatccaaagctaaacaatttaactgaactaataatcaaaaacgatgaatctgtattgaactgaacaacttcgagtggaaaagtaaaggattgatggtcttcgaatctcacgtagtagtcctttttagcatgtgtgtaggcgtcgtatacaccgagctgtgacacaatcaaattaaccgaagagaataaaacatcatgtcagggagtaaattaaaagaagaaattactaaaggatatatatgtgctccttctgttttatactagtataaatagttttgatatttttctaatcgaatttcttttaagtttaaagaagcttgtagaaaaatataaaatatattcaatatcatattaataagactaatttagtatttagatgttattatttttttataaacttgatcatacttaacaaagtttgagattataggagaaaaggcaataaaacctaacaaagtttgattggtaaaatagtcgaaacgaaatataatacgataaaacggaaaaagaggatcaaacttgatcgaagaaaaagttggtatattatctcgcttaatcaatcctcgatcgatctaaactcgatagggggtgcagtggctacgtaccttacatgatcagtccaagacctggttgaggatggccatctgcttggcgatggccatctcgacctcgccctcgtcctcgtcctccccgacgccgccgcggcggcggagctcgccggcgacgtcgtccatgaacctcgcggcctcctcgtcggcggccgcctgggagccgatgagcgcgaggtcgacgagccaggcggcgcagtacgacaccatcatggcggcgccgaagcagaggaacccgtcttccattgccctagctaattactccagctatatatctgccttttcttttttcctttctgtgtgaaaaaaaataaaagctagtactagtaattaacaataattgggtataaggcgccgtatgtaacaccggcctccctcagcttcacggtgcgtacgtgtgcatgacacgtacgtacgtttatacggaacccgtaggatgtacgtatgtacgactcatggaattaggtaacaaaccctaaagtaaatactagagggccctttaaatcaaaagaattatgaaggaatttcatagaattgaaatcctgtaggaaattttccaacgtagtcctttgatttaaaggattgaagttttccaaatcttacaaaattcctatggaatggcttattgcatataggttttggaggaaacttagccggaggtccaacctcttggtaagggcctccttgaatcacagaaatgaaaaaacggaggaataggaaaaacataggattctgacaggaatgcaagtgtaaaacagaggattgcaaaacacaggaaaagcataggaatgaccgtttgattggaccacaggaaaaacacaggaatttgaggagagataaagactcttctatgaggttctacctcttgttaaaattcctccaaaacttatataggaagatcaggcatctcataggaattttataggattccatagggttcattcctttattcaaagggctttgtaggaaaaattcctacaggaataaaattcctatgaatttcctttgaattaaaggggcccaaatcgtaggaatgaaaaaacggaggaataggaaaaacataggattctggcaggaatgtaagtgtaaaacagaggattgcgaaacacagaaaaaacataggaatgatcatttgattggaccacagaaaaaacacaggaatcggatgagagagatagactcaaaggatttttaccaagaggttagacctcttgctaaatttcctccaaaacctatatgcaataaaccattccataggaattttataggaataggaaaagttcaatcctttgaatcaaagggctacataggaaaatttcgtataggatttcaatcctatgaaattccttcataattcctttgattcaaaggggccctaagaatccttttgagtctatctctctcatccgattcctgtgtttttcttttggtccaatcaaacgatcattcctatgttttttttgtgttttacaattctctgttttacgcttatattcttgtcaaaatcatatgtttttcatattcctctgttttttcattcctacgattctaaggggccctctacttatgtttcccttgcccaagaaacaaagggtctaaaaatttaggtaccgtttgacatgatttcagattaaacgcggacgctcacacatacacacgcgtgcacatgtactttatccagtattatccatatacacacctccgagatattgtgccagcatatccgattagatcaccattgacatatcttgacattgtggtggcgtgagttgcgaacttacaacgattgtggtgacgtgatagtgtgaggtgtggacttacaacggacatgcagtatgagggctagttcggtgatgggggtggggggggggggggttattacttattaggtgatgaggaaggcatacaagaaagacggattatgtctttagataaggtattggcaggaaacaatatgtttgttgtatgatattgttattagttaaaaaaagtatttgcaaaagaacaacagttttttttattaacttttaaaattttactaactgttacaaagttttatatgtaaaataacttgttttccttctttttttactcttttcagaatttgatctgttgcaaatgaccattgggcctaagcagcacaaccagcccattaagcctaccaacatgagatgaatttttttatttataattttttttattaaaagttttacaaaaataattttccattttgaaaattgacggaagtagtcgcctaccgccctctgggaaaaatcgccctctcagagggcggcgaaaatgacgtggcagacggccgttcgctctcgggcgacggccgtcaacgaaatttgcaggcggcccccttgccgtcctccgctagggcgattttatactgtgcggggggccgcatgcaaatgggcggcgagggggggcatggaattttgcaggcggcccccttgccgccctccgcttgggcgattttgtactgtggggggggccgcctgcaaatgggcggcgagggggcatggaattttgcaggcggcccccttgccgccctccgcgagggcgatttttgcctctccccctataaagcccagtccctcctctgtgaaatttcattatattcactaaaaatcaaaaaaaacgaaagagagagaggggagggcagcagaaggggagcggcgaagccctgctggttcgctcaattcatcacgggtatgctcccatacatcttttgcatttgtactaatatgttatgtttgagtatatatgttgcgttttagttttagttccatatattttagcacatctgtaacacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttgatccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggatgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaatatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaaacatcttatggagctctttaagaggctctgtgcacagaaccaagagaagaaatttaatgagttgtgggacaagttggatgagttgacaacgaagcaaacagatgagcaatctcgcagatcactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatcattcacggcacgcaagcgtactttagggatcgatacaagaaaattcgtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcatacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgacaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgtttaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggacccacgatggagacttactggtgtcgacgtggggttagtgcaacttcgctgcgttataagtttatcagtcgtctttttttttcttcacataacatgtctaattccgatcatgtttattgcaacgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccaatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccatgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgtgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattacttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactggagtactacttgtgtttgtctcgtctacatagttcttttaattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatattttctttcccactagcacacaacacacgaaaatgaaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgcccgagcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcctatttgcaggcggccccccgcacagtacaaaatcgccctcgcggaaggcggcaaggggggccgcctacaaatttcgttgacggccgtcgcccgaaagcgaacggccgtctgccacgtcattttcgccgccctctgggagggcagggcggtaggcgactacttccgttaatttttaaaatgaaaaattatttttgtaaaacttttaataaaaaaaattaaaaataaaaaaaaattcgacatgagatgtccagagccctttatctccctctctcgtctcactctccataacgccaccgctttgactgctgtcgatacgtttcaatgtctcggctttgactgccacttgagctcgggcaatcttcatgccctgtttagatgggactaacactaagtccctatcacatcggatgtttaaatattaattataaatattaaacgtagattattaataaaacccatccataatcttggactaattcacgagacgaatctattgagcctaactaattcatgattagcctatgtgatgctacagtaaacattctctaattatagattaattaggcttaaaaaatttgtctcgtgaattagctttcatttatgtaattagttttataagtagtctatatttaatactctaaattagtgtctaaagacagagactaaagttaagtccctggattcaaacaccacctgaaaccacacactttttactgccatcccccctagtgtgcagtcgctggcgttgcccatctcgatctatcttccccaagcttcaagtgtcaaatccagacaacgaccgacgacatcaaccttcatgtgtgtcgggaagccagggatccggaccgggctttggtaagcttccctccatggcttgtcaattcacggcgataaggtgttgcctgttgtcatctgtccatctctagttctattgtgcgaggcggatagcaatgtcagagagataggatgttcacggtgtttttttttttccagagtattatttgtcaacttcctagctaatttttttttcttgggaagttgttctggcttgtcccgagtcctgacctcactctttagtctaggtgtttttagtgagatgtggatttgacggtgattttcgggaaggctcttgttgacccatcttttttttttttaatttgcatgaccatatccaacggtatatattgaatttgtgttgcatgtgacgagtgacgactattattcaacatgacgtgggttattctagaattatcacatgattcacttttcactttgatagttggggctgttgccagtcaaggctgcagctacggctgcacattgcttctgccgtacttgcttgactgtttctgttggctgcagcgctattgttgaccaggcaatcgaactaccaccatcttgacatacctcttcaacttacttctctggttctctagtatctagtatcactctatagccatatcttaatttgtacaccacccctacagtacaccttaacaactctttttttataactataccataacaacttgcacctgtgttcgttccagtgacattgggtgagaaagctcctcgttttacgcgcgcacgcttctcaaactactaaacggtgcgttttttaaaaaaatttctataggaaagttgctttaaaaaatcatattaatccatttttgcaatttaaaatagttaatactcaattaataatatgctaatggcccacctcgttttgcgtatcttctcaatctctccaatccccttctcctcaaacacaccctaagtagcctttctactattccctataataatttctaaaaagaaaaataaacagaacaaaccaagattctatcaagtcacatcttgctttttagacaaaagtgaactcacatctatctagtctgatttaaccaaccatatgaaatttttttcacaaattaaaattccatctgtcgaccacataaaatgtagccaagtcttagacgcatgacatatcatattcggtagatgtatttttcttataacggggatgcatatacacatatagagatatagtttgatttatcaaggtggagcatatcaatttgatactaattcagtagaatttagtcgattctgaatttgcccttcctttcctactactactcgtggagaaatttgcatatgtgccatccttaaaaactggcttcactagaatactatcgttaaaatggcattcgcctcttaagctgtgggaattcgcaacaatgccattttctctatttgttgcacttgtaaatcattttccatccatttatttttttctcggacctttttgtccctggttgcaccttctctcttctcctctcatcctttcttctctcttttctctcctccacacgcagggagaaggcgaggtgacggcggcgcgccgcgagccgaggctgtgcgccggcagagagagggcaaggtggtggcgacgacggggaggtaagaggatgctcaaagctcgcacgtccatcccccaccggatctgcctgccacagcccaagcaccaccgccactcctcgtcgttgctcgagctccactaccaggaccaccgccttccttcctctgcgcgccggcaactcctcttccctctacgatgccagtggacagcgccgccgcctccctccttccgcacgcctgccgcagtcgccgccggcccatcgccgcctccttccttcctccttccgcgctagcgccggtgccgcctccctccttccacgcgcttgcaccgccaggttcgcttcctggtttgctgcgagtggaggagagagaatagaggagaagagtgaagatgcagccggaggcaaaaaggtctgaaaaaattaaatggatgaaaaatgacttataagtgtataagaaatagcgaaaataatattataacgaatgctcacagcttaaaagtaggataaaagcgaatcccattttaacgatgaacatcctaacaaagccagttgttaaggatggctaatgtgcaaatttcttctcctcgtgcaattcgtatctcatttccactcgtgccattttcgctcccaagtcccaaaccacggcgacccgccgccatccatccccctaaacccctagctagggtttccaaccaccatggcgaccacgccggcggcagcggcagcggcggcggcggcggggggcgcggcgatcctcgacactctcggggacttcacctcgcgggagaactgggacaagttcttcgcgctccgcggcaccggcgacagcttcgagtggtacgcggagtgggacgacctccgcgccccgctcctctccctcctccatggcggcggcggcgcggagggcggaggcaaggccccggagatcctggtgcccgggtgcgggagctcggtgctctcggagaggctctacgacgccgggttccgccgcgtcaccaacgtcgacttctcccgcgtcctcgtcgccgacatgctccgccgccacgcccgcgcgcgcccggagatgcgctggcgcgtcatggacatgaccgacatgcaggtacggccacgaccccccgtgcgcttcatccgcttcggtgtatttgttggctgctttggagctaggattttcgtagtgctgttgcggtgtgtgtgggggcgaatctatacggaattgcggctctgcttggaattgattttgtactggaccacgcaattaggcattagccaccgaattgaggataaatcggcaccgaccatttttggtactcgttgtctttagtggaatggttaactgaatttcgtatctgatggctagaatggaggctcttgctaatgccatgctcttggaggttgatgagtaggcaatgctgagaattcaagcatatttggttgattgtgaatgcttctgaacatattgtcatgcaaatcatctaaatgaatgaacgcatgtggtgtgttattttcacccttgggcagcttgcaccagatgctcatgattttagtttgtcgcgtgtgtgacatgatggatcaagcaaattacagaagggggcaactcatttggttgaaaccctgaatgagcctagtggaataattgtggggcttttatgttttatgcttcttacaatggtagcgaactgttacattctcaatgttttctgtacacaatacacttttaaagagttcttttcattttcccttgccattttttaagaattagagggttcttcacttcttctgactgagtgtttttttttttgttttctgtttgtccatcaacctgtaactcgatatcttattgaacctacctgatgcatcaaattgccagttcacagatggatcatttgatgtcatacttgataagggtggactggatgctcttatggagccagaggctggcacaaaactagggatgaaatatctaaatgaggtattaagtgtaacatgtttccaaatttaaatactgatgtttgatgttgtaatagaaataccattttgaattttaaatggtgcatgttagtgttgcattcttgattttttatatatctaatggaatttatggaaatgttttgttctttatgttatgtctgacttagtaagcgcctcttgcttgtcttacaggcaaagagagttttgaaatcaggagggaaatttgcttgccttacccttgcagaatcccatgtcctaggtgagcttctgtcaattattgagagaactgattacctgacaattgaagtcttttcctgttacatagttacacttaggacctccaatatgtcttacagttttgaagtattctagtgaatatactttcaaattttcagctatacttcttttgttttgcttttagttgaccaaagatatcgagtattgatttttcatgtttccatagaaactttgatcattgcttttatgactgcatcaatattcttcttatacatcttagtgactttgactattcttaataaatatacttccaatgtttccagggaagctttaataactatattagcgtgaaactataagttaaaaaaaaaaactttatgattatgaatgtgtttttaacaatagaaataatggtgttttcttctcttctttcttggaaatcaatgatgtactttttgcagataatctgcatactttcatagatattgtggtctgaatcaaaatttcaaaactgttccacaaatgatataaataaccaatttaatatctcggaggttattttcgtaattgactaacagtgttttgctcctttctctcctgcagctctgcttttgtctgagttcaggtttggatgggatatgagcattcaagctataggtaatgaatcctctaagtctgccttccagactttcatggtggtcatggtaaaaggaaagatgggtgtagtacacccaatacaatcactattagaccaatctggtaaattctgtaacatgaaacaggtactgctatattcttctgatggaaaacaaataattaattcctgtcggtactcttactcttatattttatattggtgctgcaggcaaatgatgtgattcattctcttgagaaggaaaacaccatccgggagtcatacagttctggtgttgatattactttgtcattacgcgatcttcagttaggagctgtaggagatctgaaggtgattatcccaggacgacgaaggatgttcattcttggtgatcagggaaattcactttattgctataaggctgttctcttggatgccagaaagcgaactgagacctttgtatatcattgtggagtttttattgtgcctaaggtcagctatatactgtcaatatgcagctttgatttttgttgcagtacttactgttatttaattttactcaatcccctactgatcattttcttgatctactatgtcgtataagaaacaagcatatgataaaatgatcagaaaatatacttgaaaatcaaattacactagatggaatagaaaactgtgttgatcaatgttatttagggtccacatgtatccatgttgttcacttcctataccaatttcaatgcatatatcaaatactacatcattttcaaaatatatgacgccgttgacttttctcataacatttgttttattaaaaaagttagtataaatatgtaatactataagttaagattatagtctctttgatgataaaacaggtcacaacaaaataaatgatacttatataattttttgaataagacgaatggtcaaatgtcatgcgaaaagtcaacgacatagtacattttgggatggaaggagtattgtgttacttttttaagcacatgcctgttgcccgctgaaatgtgattctgtattgcatacttggtgagggatgcatccagtttattcaaattgtatgaaacacaaatcttgaggccacccaatctatttccttcttggcatgatttatctttttatgtggttttgacctgccgtaccttacattgaagtattacgagggagatggtaaaccttcatgcaaatatgttaattgtgcatgttgcaatggaaagattatgtggtgcaacagaagtttaggatttgggacaagtaacatcactgcaagataataattaacttactagtacacaatatggtaaatagtattaaaagaggtgtgcgctgcatattatagggaaattgtaacggaagaaataaattatacatagctgaatagtatggagatgtgcgcatagtggggatatagctgagagtggggatagggtaatcactcctgtagtcctgctcccatccccatttatagtggaaggtatgggacgcacttcaaatttgtaaatttgagtcttgtataggcttaaagtctttctctatctctatttcaccgttttgttcctctgctttatgtctattgtggttctgcatcaaaaggtttgctatgtgggtactagctaggcttcttttgacaaccagagttgctgagtagccctctagtatttgtgttctcttccattaagctatatgaaagccaaaacagttactctggcactcatgattgctaatgaacataatttgctttcaggttcgagcacatgaatggctttttgcttcagaagaaggacagtggcatgttgttgaaagtgcaaaggctgctcgtctaattatggtacaactgtgatggatgcaagcctagtgtgattataatttgatatttgggatcactttacagcattttcattgcttatatttgtgccatgaacttacctttaccttaggtattcttggatagcagacatgcaaatgctgacatggatgttatcaaggtgattgtttgcaaattaggatgttgtgcaaattccacaggctaatacacactatcctaatgttattgttttgcttctttttttttcagaatgatttatctccccttgttaaggatctggaacctggaaatcctgaagaggaagctcgtataccgtaggtgtcaatgcattctatttgaaattttgtcagcatttttttcctagaattcgtgtttccatgttaaggaaataaaaatgtcaatttctttggaagtacaactgtaggaaaaggatcctaatgaaaatgtcaaattattaagacaaactttacagtttggtagttagtaaaagaggggtttatcagtgcccacgattatagtaaggctttgcaattggtccagcatgaaaactcaatctagttctaatagaaattcgctgatgccaaattagtctggtgcacctatcctgtatgtagtcctatttgagacagcatgatcatcaccattattatatctcctggtgctgtttgtttatttcaatgcacattccctggttattatatatattacatccccttat

SEQ ID NO: 78393 - DNA, 14145 bp, Oryza sativa
tcgtctgggcctccgtcgtgccaatcgttgtcgtcgccggacttggaggtttcgccgtactcaagtaatcaatggtgcagatgagttacgttgggtgcctgcttgttcttgccagtttaatctgcagtcgtttgcttagtgccagtaatgagtgtgtttttgtagcggtttgatatcaaattactgttttatttctgcactgtatatgctgtttctgaattaatttacctatcaatttgtgattcgagtgtacattgatcaaaacagagctactgatttttgtccttgacgggcgacaagctcgccggaaaacgcggttgctgcgaagtcgctgaacccggtgtctctcaccacctcgtgttctcgtcgtcgtttgcgcgcggcggagctccggcgagctccggaagcgggggagatgacatctttgttttttatgtgaaccgttggatgtgatttcatcggcccagatggagacggataagctgtacaaatggcagggcacgttaccactggcccagaaaaatacggccggtctggtttagtaggccgaggaaaagattggcccattatgattggcagcgatccatatcaccaattcattcttgtcattctggcccaacttgctctttggcgcatgtaattatcagactattcaaatttgttgttttttttatattattaatacatttaaaaaagactattcaaatatatagtattaggttatgtcccattgaatatttggttgctatatttttgaacggagagattagcctttacgctattgccaaaatttgaatttttaaaaaaataagtttgatgtttttctcatcgtaatttattttacaatttaggttttaaaacactaaaaacatattgtcagggttacgggttaggtataccctttgcccttcgatatacgttacatattgatatggcatacccacgcgcatacggatatttcctgtatattctaaggaaacctttcacggaatctatagatgggaagaatcctactcgggcagaactgggtcgttggcgtatcgtatagggtctgatacctccgagttctatgaggagacctccacatctgcgatataaaaggggccccccgagagggggtttagacatcgaatctcaaagccaacacaacctccacagcctacgaagccggagcttacgaggagccaactcatcgagagctagtcgaatcaactcgactacaatctcgccggatccgacaagttcccttgttctctttgtaacctgtgttttctaccatataatcccacatcaactggattagggctattacctatcaaggggcctgaactagtataattcttatcttttgtttgcttgatgtcgtactacgtagatccttgtaccaacgtaccctaataccttctatatccggtctacgggtatcacccgtcgacagtggcgcgccaggtagggggccttggtactcaaggttctactactatgtcatccagcttcgttgacaacaacgtcagcaccagcctcagccaagtactccctgcttcaacaatgctggtatggactcaagtcggcgaaatcatcttcccgatttacaccacgacgccgatctcaaccggtcctccaatgaccggagacgagaacgcagtggctacgaaccaaggcgattccatgtcgaaaaatcctcccgtcgagacggagaacggaatattgacgacatccaagctcaagaaggattctgatacggccaaaccttgtccttccgatatgaacacgagccgacaaagatgacttccgaagccacaaggtcttggtgtcctatccacaaaactaagaaacacaccctgcaagattgctgggttttcctcaacgtccgtgctgaaattcgtgcctgcaaagaacgtggaattcagcgtacttctctaactcgggatgtctattgtcctattcacaagacaaagaatcacgacctctcgagctgcaaagtctttctcggcgccatgaaagctcagtctcctaagtcatatatccccatcagggataacagcaaggaacaaggagcgactccaacttcagatcgattcgttggggtaatcgatatcgatcctcacgaaccatcggtcttacatctcctcgaggactatgggtcatcgacaacgagcgcgccgcgggaggtattggctatcgatgacgttggcacatcagcgcacgccaacacagaagcggggaatcaatcgactactccagcccagcacatcagggttgttcaagcgatactgagggaaactccctacgatcccgttctgaacgttgacctcgagcgttggacagaacgactacgggaatcggtgactaacctcagcaacgcgtttgaagaagccgctaccgcagcacaccaggagcagccaccaactagcaaggccaatggtgaagatccggaacggagggaatcacctcaacaagctacccctccacctcgcggcactggcgatcttccagatcaaatcaacggccaccgagaagcacgacgcacacgagacaacgtgaatcgctctcggcgtcatgtctcttcacggcgccatgacggcgccatgataacggaaatcgaggaaattgctcaaacgaggaccgggaccatgacaaccaccacgatcacaacgatcgagaacgacgggtgccagacaatactggtcatggccgccgccgtatcgacgacgacgatggagattggcgccgagacaacagtggaagacgacgacaggattcccgagatccaggccgtcatcctcgtaatcgtacgccggaaccaagtgacccatcgtcatcgtcatcatccgcgtcctcctcattgtcagacagacatccacgaaggacacacgaccgccggcaacccaccgcccccaacgctgggagtagggctttcggtcgttccctacgttatgtccgatggcctgagagattccgacccggagcaatagaaaagtatgatgggagcactgacccagaggagttccttcaagtctactccacagtactctatgctgccggagcagacaacaacgcgttagcgaactatttaccaactgcgttgaagggttctgcacgttcatggctgatgcatcttcctccctactcaatcccttcatgggcagacctgtggcaacaattcatcgccaatttccaagtaacatacaagcgccacgcgatcgaagacgacctacacgcgttgacacagaactcgggtgaatcattgagggaatatgttcgacgtttcaacgagtgcagaaacacaattcctgaaatcaccgatgcttctgtaattcgcgccttcaaatccggtgtcagagatcgctacactacccaggagttggcgacaagacgcatcacaaccactcggagattattcgagatcgttgagcgatgcgcccacgctgatgatgcgctaagacgcaagaacgataggctgaagaccgggggagagaagaaaccagccacggacacatctgagtcaagcaagaagaaaaatcgcaaaaacgggaaaaggaaagctcaagcggaagtcctcgcagcagaatacgcgaaccctcccaaacgcccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgtcgagacgaacgaagagacggctcctcacgaatcggactcagcgtatctagactccgacctccacatctcacacatcttcggcggttccacaacgtactcctccaagcgagaatacaagaaagtggaacgtgaagtctgctcgacatggcagggggctgcacccaagatgaagtggtctgagtagaagatagagttctcggaagaagaccaccccaagaccgccgttatcccaggacgatatccgatcgtggtcgaacccactattcggaacatcaaggtagcgcgagttctcattgacggtggtagctcaatcaatcttcttttcgccagcactttggacgcgatgggaattccgcaaaacgagttgacaccaactgatcaacccttccatggaattactccccaatcatcgtccagacctttgggcaagattacgttgcccgtgactttcggtcaagccaacaacttccgaacaaaacagatcacctttgatgttgctgaattcgatacagcttacaacgccatcatcgggagaactgcacttgcgaagttcatggccgcatctcactacgcatatcaagtgcttaagatgccgagaccgaagggaacaatcactattcaggggaacgcaaagctggcggtgcaatgcgaaaagcaaagcctcgacatggtcgagcaaacgcccagcccacccgccacgactgagccacccaagaaagtgaccaagacaaacaagacgccgaaattagacagcgccatcaagattgttccactctccagtgccaaccccgacaagaccgtcaagatcggggcgacactaaacgagaaataggaactcgcgctcatcaccttcctccgcgacaatgccgacgtgttcgcttggcaactgtccgacatgccgggggtccccagggaggtgattgagcacaaactcatggtgcgacccgatgccaagccagtaaagcaaagattgcggagatttgcaccagaccggaaacaagccatacgagaagagctcgacaaacttctcaaagctggcttcatcagagaagtacttcatcccgagtggctagccaatccagtcatgttgcggaagtccaacggaaaatggagaatgtgcgtcgacttcaccgacctcaacaaggcgtgccccaaggatcactttccacttcctcgaatagaccaactggtggattcaacagccggttgcgagttattgagcttcctcgacgcttactctggctaccaccaaatcagcatggcaaaagaggacgaagagaagacagcattcatcacgccgttcagggtattttgctatgttaagatgccgttcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgtgggaaacgttcgacaacctccgacgatatcgcctcatgctcaatcctgagaagtgcacgttcggagtaccgtcgggcaggctgctcggattccttgtctctggcagaggaatagaagcaaaccccgagaagatcaaggcaatcgagaacatgaagtcgcctacaagactcaaggaggtacaaaagctaaccggatgcatggcagcactaagcagattcgtcgctaggatgggagaacgaggacaacctttcttcgctctgttgaagaaacaagacaaatttgtatggacacaggaagccgaagaagcattcattgcactcaagcgctacctatcaaacccccccgtacttgttgctcccccaacctaatgaagaattattcctctatattgccgccacgccacactccgttagcactgtcattgttgtcgagagagagaaagtacagcgactagtttattacgtcagcgaagctctccacgacgcaaagacaagatacccacaaatccaaaagctgctttacgcagttatcatgacatcaaggaagctacgccactattttcaagcccacagagtcacagttgtctcctctttccctcttggtgaagttgtgagaaacaaagacgttgtcggccgcattgcgaaatgggtagtcgagctaagccagtttgatgtccactttgtgccacgaacagccatcaagtcctaggtactcgccgacttcgttgccgatcggactatgccagataacaaatcagacaaccaaggcgacaatgcaacatggacaatggcgttcgatggcgcactcaacagccaaggagcaggggtaggatttatcttgacgtctccctccggagatcaattcaagcacgcaatccacctcaacttcagggcgaccaataacactgcagaaggactactcgccggggtacgagctgcagctacacttggggccaagcgactaatcgtcaaaggggactccgaactagtcgcgaaccaggtacacaaagattataaatgctctaaccctgagttatccaagtatctcgcaaaagtcaggaagctagagaaaaagttcgatgggatcgaggtccgacacgtctaccgcaaggacaacgtcgagccagacgacctagcacgacgtgcgtccagacgagaatcgctcgagcctggcacttttctcgatatcctgacgaagtcatcggtgaaagaggttagcggtgaagtcagcccgaacacccccgacattagctcggaggtcaccgaggcagaacgcgccgttgccgacatctaaaccacagacgactggcgcatcccactaatcaaattcatcagcagcgaggagttgcccgaggacgacacagtggccgagaaaataacccgtaaagcaaagatctactgtatggtcggcaatgatttatacaagaaagcgccaaacagggtacttctcaaatgcgtctcgaccgacgacggcagacacctcctcctcgacatacatgaaggcatatgtgggtcacacgccgccggtcggacattggtcggcaaagcttttcgacaaggctttttctggccaaccgcccttaaaaatgcatgcgacatggtccagcgatgtgaagcctgtcaattccacagtaaacacacaaagctacccgcgcaagcactccagactatccctctgacttggccattctcgtgctgggggctagatatacttgggccattcccacgaggacagggcggctacagattcctattcgtggcgatcgacaaattcaccaaatggatcgaagcagtactcacgggggaaatcaaggccgacaacgccatcaaattcatcaaagggatattttgcagatacggactaccacaccgcatcataactgataacggctctcagttcatcagcgccgatttccaggactactgcatcgggctgggggtcaaaatatgcttcgcctcggtctctcaccctcaaagcaacggacaagttgagagggcaaacggcatagtactacaagcgatgaaaacccgcgtctacgacaggatcatgtcacacgacaaaaggtgggttgaagaactcccgtcagtactatgggccgtacgcaccacaccgacaacgtctaataaggaaacatccttcttcctcgtgtacggctctgaggccatgctcccaggcgagctacaacatcagagtacacgagtacagaagcactccgacgagaaccaggaggagcagcgagatatcgctgtaaatcttctcgagaagcatcgggaacgagttgccgtccgagcagccagctatcaacagaccctccgccgttatcacgagaagcgcatccgtgcacgcatactttcgatcggcgactatgtcctccgacgagttcaaagccaagcagggcaaaacaaactctcacctaaatgggaaggaccttacacgatcacacaagtcttgcggccaggcgcattcaaaatcgcagacggcgacggtcgcgaattagcaaattcttggaacattgaccaactacgtaaattctttgtatgagtcaatatcattcatacctgtaagcacccttacagtatcaataaaggctatttctaggcccatatcacaatcaacgtgtttcgcccgatgatccctcactctgatgacacctagcgttgaaacatgtccttatgtccctttacgccgtctcgacaaggcctccgaggaacctaagggatcttcggctggggacgcccagagccgataaggccttgtcagatcctgtagagacgaaagaccatgtaagatctggtcgtgtaagagttctcaccgtgcgtattaaccacgccgtgaaatcggaaatcaactttccaacttcacggctgggggctaggatcagagcttattcaaccaaggcaggtcaaaggtccaagagccttatcctccgagaaaactcctccgacgacaaggctaggggctagggagagtgtacgaatcaaacggctgactaaagtcgttaaccgagaacgcactcttacacatgacatccagagtaagagacatttgtcaaagatagatttctttattcacaaaatactccttacagttttttcacaaatctttcgctacattacatcttttcctaagatatttgtcacagggtacgagtactaccaagaaggccaacgccagtccatagactggaagatcttctcggccaacggtgacattgaccttgccagatggtctatctccgccggagtcctccgagaacgagcaaaaccctcacgaagatgttcgaggtccaggtgcgggcgatgatctcgtaagcaagccaacacgtgccccccggcatatcggctcgatcaacgacactcctgtttcaaggcctcgtcgatacgcttgccgattccattgagttgggcacaggccccattaagccacgagatgtacccggctgccgactcctcgggatctccgcggactactcgaagctccctgcatactctggccatggatgtgtagcaactcttcaagtacaagttaaaccatacctcacggcctcggagcgtttccacaacctgctctttcttcacggccagcatggttctctcgagctccgccacttcaaacttcgtcttccagtattggatacgacgatcttggctagcaagggcaccctcgagatctgctaaacgtgataaccactaagtcaagctatacatctctttcgggaacatggctgacctagtcaggtgggcattaaggggtgaagggactactaacctgaggaagtcgttgccatccttccctctatatcaaggggttgatccacatggtcaggcgagacgtgtggttcaaactcgagtaccggaattactgccagtgactcgggctgcccgcgctgctggatatcctcgtcatcaatatctctacagaggacaaaagttcccgaggacagcataccaaagtaagccgggatagtaatcgcacgcacaaaggcggtcagagttcgagttttacacattatctaggaaatacaagaagtcctactcttcaaaaagagggagaacggactcccccagatcaccgacttcttccatcacctccttatgcgtgtcgctagccgctccctggtccaagatctcgcgcagatcgagttcaggacgcgacagccttacacacgcgaggacatgacacgccccggtgtagattccgtttgacgtctcctccgcaatcctggccgcatgcttggagggatttcccccatcgccgtcgccagttccgcgagagaggaggtcagcgaaaactcatcgggattcgccgggatcgtggacgtgacgccgcattccccggtgagctggtgaagcctagtgtaggtgaccctcaacgagccccggatctcagataggttgttcccgagttccgacattcagtcctcgagccccttccattgtcgctcgttgccggccgccaactccctcatcttcgtgaggtcttcacgggcttcagccaactcgcgcaccagtctgtcagcacgcgcgttcgccgtcgccgcttccgacctcgcctccgcaatctcgcggccgatgccgcgagcaccggcttcgaggaggcgccccatctcgacttggagctcctcctaggtgaggactgcagctggcaggtcacgacctgccgcggggcactgactgggccactaggtgtcacctcccggctcccggctacgggcacgacatccgtcgaggccacgacgggcgacgcactagaagctccttcggacttggctcgcgcagcctttgcccgcgcctccctacaggacgactacgagtcagacaacaatcgaataagaggcgcggggattcaagaattcatctacttacttctcgccgattgtcacaatgcgttgtcgtcatggaggtgggggagacgcgtccgaggcctagaagacaatcaacgcaaagtaaggaaaaatccttcttgctgcacgatttaacgataaaataaattaccgagggggtcgacgccttgcgacgttgtccgattacagacgagagtttcctcggctttgtcagaacattgccaccgctagtggtggcagcatcagacgcctccttgacgaccttcactttcagagatgacgccacctgatggtccgcgagcggtccgatgatatcagtcaaaggaagggcctacgctcaatcaagtcataaagtgatttcgaaaggagaatgcgggatgttcatcgaatatacttacgttgatggcttcatcacgttccgccgcccccttttcacaaagggacatagggatgtcactcgccgtggtcgggccactgatcatcacttggccgacgcggcgctccacggtttccccgctcagacctgttaatcgagaaccaaccttcgataagtcaagaggaatgcgaacacaagtatgtcaagataaatgcgagaaagataccccgaggagaaacccgggtcacgtcctctggcccggaatagttataagctggatgggcccgagcctgaagcggttggatccgcctaccaacgaagtctgcaacgacttcatatcccgacaaaccccgtactcagagattgtcgatgatgtcgataaacgactgaagagagggggtcaaggggggctttgcggtccaagacggaatcttgttcggttgatcttcgggaaccacgaagtcagggttcgagtccttgatctcaagataaaaccacctattcctccacttgctgtgagaagaagggcactggaagggaatgtaacgcgacttcaggccatcccgaagtcggaacccgacgcaaccagataccctgttggattccatccaacgcagttcatagtaaaagcgaaaaagatcaaggaaaggctctaccccgatgtaggcctcacaaagatgcacaaagatgctaaggaaggcgatggaattggggttcaaatggagaagagagaggccatagaaattcaaaaccaggagaagaaatttggaaggtggagggagaaaaccgcagagaacataatcttcgatcgcaaccatgcgacccaatatgggctgaggattagtacctcctgcttccctctccatggttccatggccaggaagagcgccatcctcctggagtttcttcaacgttgcactagtggaagctgatttgccgaggtccattgccgatagaaggtcgccgaaaagcgagcctaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatgtccgccggaaatttctggtcccgttacgcgcggcggttttttggacttcagtttaaaattcgctcgtgaccgttgagcttcaaatggtgtgctcgactacggtctatctccgcggttctcgcaccgggaatgacaacagtctcgacacccgaagtcgcaaatggttgcacgagttcattttaagcagaagtcgggggctactgtcagggttacgggttaggcataccctttgcccttcgatatacgttacatatcgatatggcatacccacgcgcatgcggatatttcctgtatattctaaggaaacctttcacggaatctatagatgggaagaatcctactcgggtagaactgggtcgttggcgtatcgtatagggtctgatacctccgagttctatgaggagacctccacatctgtgatataaaaggggcccccggggggggtttagacatcgaatcttagagccaacacaacctccacagcctatgaagccggagcttacgaggagccaagtcatcgagagctagtcgaatcaactcgactacaatctcgccggatccgacaagttcccttgttctctttgtaacctgtgttttctaccatataatcccacatcaactggattagagctattacctatcaaagggcctgaaccagtataattcttgtcttttgtttgcttgatgtcgtactacgtatccttgtaccaacgtaccccaataccctctatatccggtctacgggtatcacccgtcgacacatataacatataaaaggttctccataaattacatgtaaaacaacttatcagctataggccaaaacgatagaagattaaatactactccctccgtttcgaaatgtttgacaccgttgactttttagcatatagttaaccgttcgttttattatatttaacaatgaataaaatgataggaaaagaattaataattacttaaattttttgaataagacgaatggtcaaataagtacttaaaaagtcaacgatgtcaaacattttgaaacggatggagtaaaactactccacattaagtaacaaaatttattgatagtaaaaggtaaaattatatcggtcaacaacgacagctatttgaagtcggaggaagcatcaaatcgtccttcgccgcggcggcggcggaggcgtcagtagccgagacggcggcggaaggtgtaccaccccttcttgcacggcgcgccgatgaccctcatgccgcgcttgcacggcttggtgaccaccttcgccaccatcctcctcacgaccgacctgcgtttcttcgccggcagcacgggcaatgcctgctgctgctgctgcgctccggctccgccgccgctcttcctcggcggcgccgccgtacatggcggcgatgaagacgacgccgacggcgagcgcatgaagacgacgcctctctctatcgtctcgccggcgatcgagcagggagatgatggaaacgacgagtcctgtagagaatggctggcaacgcgcggctgctgcggcgacttgtcgaataatttgcgcgcactcgccgttggtttggtttatgtttaggctgcatcgatttgggcggtggttggcacggttagtcttgctaatcctttttttgagtttttgtttttatttattttcgaaagaatgaaaaataatggattaatgcgacagggtacaatgttaaaaaaaaaacgatcagctggaagaaggaaattgttgtcgaaagctggaagaaggttctccagtaatgacgcttcaattaccattggttgatccatgtacaaagtccaatacactcaggactcctttggaacgaattttacaggatttagttgaaatcctctaaaattctccaaaattcctccgattcgaactcccttcctaaagttaaattacatctatctcacaaatagctctgctatgtatgtgtgtgtatgtgtgtgctttgcttcagttacgcgcgtcgctcaggcgtgtcggcgtgccggcgccggtgccggggcaggagcctccgggcgtccgcgtcagcgaggcgaacccgggcatcgacatcgacctcgtcatgccgccgccgcggggcgacggcgacgacggcgccgacagcgacgaggcctgccgctgcagcatcgggtgcgagctgccctgcgtcgacacgctgtgcaacggcgggagcccgacgacgccggggtggcacggcgtgccgggcctagcgctgccaccgccgctgcggagcggctgcagctggatcttcaggtacggccgcgacggcgtggtctcgacgaactggccgtgctcgtcgtcgccgtcgtcgtcgtcgagggagcagacggtgctggtctccgtgcggatggtggagtcgtcgccgccgcggtgcttcttcctcctcctcctcgcgtctttcccccacccatgcatcgtctctctgatccttcgcgggatcagggcagccttgtactttgaccccatctgttgtcgtaccagcacagtgagattagttcaatcttttttttttggggttcaaaattaaatactagaccttccattttcagaatatatgataccgttaaattttg

SEQ ID NO: 78394 - DNA, 15684 bp, Oryza sativa
atatatatatatatatatatatatatatatatatatatatatagacacacacacatggatttgttctacatgaagttatgaacaaacacccaacctaagaatttgaataatacattttcgaggaagtgcagtgcctggtagcttgaagtggccgttgacggtgacccatacgccgacggaggccatgcaggtggtgtcgggtaggcctacgtgacatttaatatggcggtataaagtgtggaggtactcgcaatgggaggcaaagtggtcggtgtagctaggcattggtgaggcccaacagtggaagcggttcgatgaagatggggaagcgatgtagttgaggagacggtgagagtagaacaggagcccacgctttgatcacacaggcacgatcatcatatgctcaatggatttcttaatcattgtgttgtaccgccaccacaagggaccagcgtgtggggttcaagcttttcactccaagttattcctgtaacgtagtaagggcgaaagcagagttttgtatatccgcctactcgtccaaaaaaaaagtttcaaaaaaccggtgaacatacacaaatagagaaaacaaccatggaaaaaaaagttgaaacacactaaaaaactgaaaacatactatagtagagtggaatggaacgtttaacccctcttactagatcccgttgcaaagcacaatatatttgctagtaaactaaaaatatatcaagtttcaaaaaatctaaatgttggcaagaactgataagatgaagcacagaagatggaggcggaattcctccgtctcaaaaacaaattaattacctgctattgaagcggttgcatgacctagtgcggaaatgcaatttgaggactgtcctaaggctgagtttttttcccaactttcctaactcacctctctcgtttttcacacacacgcttttcaaactgctaaactgtgtgtttttttaaaaaaaatatattcaaaagttgcttttaaaaaatcatattaaactattttttaaaaaggtaaatacttaattaatcaaaagaaaatgtgttgctctgttttacgtgcgcaggaggtgagctcccaactcacctcctgaacacagcctaagttcactgtcacaagtcgtatgaacttaagagggggaaaagaatgtgtgcagtgtcctcttccctatcccctcgaaaaatagtcctcttcctagatatcctaacttttccccgacaaaaaaatatatatcctaatttctacaagggattacaaggttttagcttcagctttgcaaccccattttttcacttattcaatgcatcgggagcccagaaaacagaacacaaaacgtagtactacaattcaagatattttcttcaaacttccaactttaccgtcacatcaaatatttggacacatgcatggagcattaaatgtagacaaaaaaaccaactgtacagtttgtatgtaaattgcgagacaaatcttttgagtctaattacgccatgatttaacaatgtggtgctacagtaaacatttgcaaatgatggattaattaggcttaatagattcgtctcgcagtttacaagcggaatctgtaatttgttttgttattagtctacgtttaatacttcaaatgtgtgtccgtatacttgaaaaaattttagcacaccaactacacacacaaatgtacaaagttcagaatttccatcgatccagttcaacaaaaaaagaaaatcagaactcataaacgccgctgaggtagtagtatgtgtataaaaaggaaaataaagcctgtggaagagatatcggatatagaacctataaatttgggccgtgttcgcatatttaactttttcattatattaaaactttcttatatacacaaattttcaacttttccatcacatcgtttcaatttcaacaaaacttctaattttggcatgaaataatcacagccttgttcatgaaaaaaccacgaccttcctgcagaaaaatcggacatgcagacatacagtaagccaacaaaaaatccaggacaacacgtagaaccaatcggagcatcaaaaagtcagagattcgctgccgttcgaagaaggaaaatttagtccaatcaaattaagaatccacaagcgctgacgcactaacagggggtgtttaaatccagggtgaaaagttttggcgtgtcatattgaatttacggatacacatttaaagtattaaatgtagtctaataattccgtatgtaaagtgcaagacgaatttattaagcctaattaatccgtcattagcaaatgtttactatagtaccacattgtcaaatcataaagcaattaggcttaaaaaattcgcctcgcaaattagttgtaatatgtgcaattagttattttttagcctatatttaatacttcatgtatgtgttcaaacattcgacgtgacaaggtgaaaaattttagggagggatctaaacagggctaggtgaaaaaaaataaaagtggattctctgaactcaagaaagattcctgtagagtactccctccatttctaagtgcttgtttaagccgtgtttagttccaaagtttttcttcaaacctttaacttttccatcacattaaaacttttctacacacacaaaactctaattttttcgtcacatcgttccaatttcaaccaaacttccaatttcggtgttaactaaacatagccttagttcccaactttttcttcaaacttccaacttttccatcacatcaaaacttttctatacacataaacttctaacttttttattcaaactttcaattttagcgtggaactaaacacagcctaaatatttgacaccgttgactttttatcacatgtttgatcgttcgttttatttaaaaaattttgtgaaatatacaaaactatatgtatacatataagtatatttaataatgaatcaaatgataggaaaagaattaataatttcttaaatttttttaacaagacgaacgataaaatatatttaaaaaaatcaacggcattaaaaatattaaatttttagaaacggtgggagtattggtgttggtggctgtatggatgaaaacggatcggatacggacggaaactagctttatcatattcgttttcatatttttttcggaatcggaatcggaatcgaaaactcggatacggaaatgaaatcgaatattatcgaatacagatacggagcgaatacgagacggaacgaatacggtagcggatatttatcggtatataaaaaacccctcaaattgagtttcttgatcaaggaagagatatcgcttattattttagttcaacatctccaacatttatatcgtcaattttgtagacggtcccataaccctatgtgaaaatcgattttcatggctattcctcttacagatacatatgcaaatatgattatcattttctattttcaagaccttttactagatgtataacttacttaccattgtataaattggagaagttatttattttacttcacatcttcaaaacttgtaatgtttgttttatactttaaatgctttcaaatacaaatgttataaactacaaagtggtagatcccgttgagctctacaactttgatatggaacacatctccatcagatgtcgtttgaattgtagatctgagattttgtaaaaattaatatggtatattataatgaatatttagactccttaaatgacctcaaataataaaatagtcaataagaaagttgtagatctcatcgagctctacaatgttgatataaagtttgtcgccatctgattccatatgaaaaagttatgtatatatacatgttttttctaaactttgctcaatgtctgcggatatctgaaaaaaaatccggatagtttttccgaccgttttctgattccgacggatagtacccttactgtattcgttttcgtttccgagaaaaaaaaatccgaattcgtttccgaatccgagaatttccggatagttccgacggaaactatccgaatccgaaaaatggtccggacggacggaaactatccgaaccactttcacccctagctggctgtgcttgctccagatctgcaccatgcgacacagctcccagccgcttgatgccctccttcctgcccacgacagcaaactttgcaactgcgctcatcacatgctccgctcatctacagataaaaaactattcagagatcatcagcacaagatggtttcgtggtgtagttggttatcacgtcagtctaacacactgaaggtctccggttcgaacccgggcgaagccaagttaactttttttttccttctttttatcttcagattcaaatcaaccactgaattcaaactttcgttggaattcaaactttcgttgtttttcctccgaactcactgaattcaaagtaactcactatttttattattttttttatcttcagattcaaatcaaccactgaattcaaactttcgttttttcccccgaactcactgaattcaaagtaactcactatttttcttcttttttctcttcttttttttaatcttcggattcaaatcaaccagtgaattcaaattttctttttttccctccgaactcactgaattcaaagtaactcactaattttcttctttggattcagactagctaactgctgaattcaatcttctgttttttccctccgaattcactgaattcaatgtaactcattattttcttcttcgttctttttatcttcagattcaaatcaaccactgaattcaaactttcgttgtttttcctccgaactcactgaattcaaagtaactcactattattattattatttttatcttcagattcaaatcaaccactgaattcaaactttcgttttttccccgaactcactgaattcaaagtaactcacaatttttcttcttttttctcttcttttttttttaatcttgggattcaaatcaaccagtgaatttaaatttttctttttttccctccgaactcactgaattcaaagtaactcactaattttcttcttcggattcagactagctaactgctgaattcaatcttctgtttttttttccctccgaattcactgaattcaatgtaactcactaattttcttcttcgttcgtttatcttcagactcagctaactactgaattcaatcttctgtttttttccctccgaattcactgaattcaatgtaactcattattttcttcttcggattcaggccccgtttagttcacacaaaatttttacaccccctcagactaaatgaacgacttaattttttttcttcagcaccaaactgcatgacatttttcttccccttctttatcaaattaaatgaataagttcatcttgcaaatacactagaaaaacttactctaggatggacccttttctcggtgccaccatcattagcgttgtcatattggacgacggtgccaatgaagtcaaggacctatttggaagaaatatatttgcattttagtccttttgaaaattatttttaattttttatacaaataggtcattgacaccaatgacattggagtcgccatcttgatcatggcaccaatcacactggcgccgtgaaaaggaaccactcctgaaataagtttttctacgggtctatttgtaaaaaaagttttcaagaatgcccccaaaccatccaaccaaaccaatccggcccatcctctcccacgccaacctgttttgtcctcctaccatacatgtcgaagggtgaactcctcaagcgggggaccgtggggaccccctttctagttcagtccaggggcacggttgtaggtctgagagttgatggagagagaggcagagggggttgggcccctcgagagtgatggaaatgcaagaggtttatacaagttctggccgctatggaagcataataccctactcttgtgtgtgattgatttaggtgggagaataaaagtgcctttcttctctaggattcgcccctctctccactggggcatggacctctttttatatcttaaaaggttaccacaaaggcccaaaactagcttcaagggtaaggaaaatattctttacaggcaattaatgcttgtcttgtcttccgacatgtggagccacgcgcgccttaccgcggcatgggcccatcccatcacgccgagagacacgggcggacattccttcttaattatcgacgacttccggccattcattcccaccgttgggtggggatctctcatacggaccggtgcgagaagaactggtccgagctcaaatgcgaggcaaaaagcccctcattaatggcgattagacggggcggtcgcagaccacctcccctgctagcagtaggtgcgtgcgcagggctccctgactgccgtcacatcggtcatttcggccgcaagtttatactggtcagagaaggaggaggctacgcgagcgtttggaccaaacgatctatactggtcaaaccggcggcataggtacggtcaaacttgcggatcaactccggtcagaccgatcttcatcaaattcgagggtaacttttaattccgctaaaagtttcggttttgggtactacaaccattcacccctctctggttggcttagttcttgctattcgatcctacattaacgatgtgaaaaaaaaaagatttttggaacaagttcagctaccaatttacttattgggttgtatatataatgttagagttttgggtctagggggcctgtgcgggcggagcgcacgcccctgggacagccgtgctgcaagcgccgccgcgggtcgacaggtactggcaaagagcgcgcagctgaggaattgggcatgcatgttgacgtatgtcacgccctgaagttttcccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaatcccaggaaaaatcctttcttctttttctttttcctttttcctccttttttttttcctcttcttgggccgtcggcccagtccatccctctcccgcggtccctcctccttgtgggccggcccaagccgcccctccctcctctctctcgggacgccgacaggtgggccccacctgtcggtcgtctcccacctccggccgctggagccgaagctccaaccgcccatgccgccgccgaatccgccgcgccgccgccttctccgctccacgtcgcgcctccactccgcgcccgcacctcgcgcccacgtcgccgccgattcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccggcgtcttcggccacgcgccgccgcctctatagccaccgccgtgccgcgcagtcgccgccgtcgcgctcaccgagcccggccgcacctcggcaccattcggttgccgccaatcgtcgccgaagcgccgtttccctcgcacgccggtgagctctccatttccacccaactccggccggctgctctagccgccgtggtcgctctccctacccctaacccctctttgttttctcctagcgtgccgccgccgcccatccgcacctcggcatcgccggtcgtcgccgccgctttcttccttcgcgccggccgtcgtgctcatcggtgaggaatcccctctcccccttcctttttccccctctcccgtgtgcgccgccggccttcgcgcgtgtgccgtcgccttcagccgctgccgccgcctttcggccgtcgccgccgtttcccgcaccgccggtcaccgccgtcggtggccgtgcctcgccgccgcctcgccttggccgccggtcggctttgaggccgagccgagcccggctggcgcctccctctcccgccctgtgccgctgcccagtggggcccacatgccagccgccccctccctctccccttgtgccgctgccagtggggcccgcctgtcggcgcagccgccccaccccttgctgacgtcagccctgggacttattgcgcaataaatacattaaggcttttcttttatagtaataaacacagtttatcttctaaaattcataagtaattcatccgagctccgtttaagtccattcaagtctcagtaaatcaagaaaaatgcaaagaatccattaaaaatggttttgtttcctgtttcagtagtcttatagcctgttttgcttgtgtgctttgtttgtcgcgtaggtttcggccgtttcgtcgatccacggtttctcgaagacgttgctgaggtctcgtcagtgcgagagcaaggcaagtcatgctttacatttgatcatattgtacccaatttacaaatatcccgcatttctattaaatgttgcattcttttacaatgtaatgtgggatgggtcctattcctcagccacatattggttaccctatgccattgataacctgggtatcaaaatgattagatgttggtttaggaaatgcttagccatgcttagttcaactagtacacaaaaagggatcacattattacttagactttgtctattggcatagctttaggttggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagttgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttatcgaagttggtttcgtcgctgccgtcaaggtttgcctgtggagtggagacacccgctgctgaagtcaagcttcccggtttagctcgcttttatcttttccgctgcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaacctaagagccctctgaacccctttttcatctgcatatgcctttttgcacttggaatttgttttgggaaaatttggagttttgcctctttggtttgcgggaaaaatcttggtcgttcattcggatcggattttttttttttttttaaaaaaaaaaatgagctcagcctagggctttagaaaaattttagttggagtttattcgacagtcagtcgggaatttattgggggttatgcattaggtcgtgtctatattcggtgggggcaatgttatgcgcatcattttccatgcaactagtctatgcattaatttattgtttagttgcattagtgtctttatttgagttcatgaaaaatattctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttccacctatcccctcagatggagataaggaatggttcacgcgactccaacaacgccagtggcagcgaagagccgatcaatggagcacgtgccaacggtgcatctgacaacagtccgtccccaccgcccgagaacccaacaattgctcaggtgttgaacaatcagactcagatgatgacaatgatgatgcaacagatgcagcaacagtaccatcaggtgttgcagcaggtgcagcagcaagcacagccgcagcagcagaacctgcaatttggtcctccgcctcctcagtccaaattgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctgtttggtgggacaactacatggtgacccgtccaactggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaatagtgagcagcacagcctcaaccctactccgagttcactaaagattccagcccaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgggttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttgaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccaatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctacggtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcggctggtacttgaaaagttaaaagagcaccagctatatgccaagatcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccggtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatctttacccaacctgatctgaatctccgacagcgaagatggttggagctaattaaagattatgatatgggaatacactatcatcccggcaaggctaatgtggtagcagatgccttgagcaggaagagttactgcaacgtcgcatgggtagaggaactatgcggtgaggttcaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcgtcaccggtttgcccaggacgtcatcggggcatgattctatttgggtagtcgttgaccgactcaccaaagtggctcacttcattccggtgcacactacctactcaggaaagaaattagcagaactctatctagcaagaatcatgtgtttacatggtgtacctaagaagatcgtgtctgatcgaggaagccaattcacttcaaagttctggcagaaattacaagaagaattgggaacccggttgaatttcagcactgcttaccatccacaaacagacggccagaccgagcgggtcaaccaaatactagaggatatgttgagagcctgtgcgcttgactttggtggagcatgggacaaaagcttgccgtatgctgagttctcgtacaacaacagttaccaagctagtctgcagatggcaccattcgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatatcgggttttggaacgtagaggtgaagttgcttaccagctcgagcttccctccaacatgcttggcatccataatgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaatcccaggaaaaatcctttcttctttttcttttcccttttccctcctttttttttcctcttcttgggccgtcggcccagtccatacctctcccgggtccctcctccttgtgg

SEQ ID NO: 78395 - DNA, 8656 bp, Oryza sativa
cctgtggagtgaagacacccgctgctgaagtcaagcttcccggtttagctcgcttttatcttttccgcggcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaacgtaggaaacaaatggaagtgagggcggtggcctgagctaggaaaggaggaattctatgcagaggccagaggacaatggggaagcgccggagcatttgcgtaggacatggaagcggcgacagacggcggagcgagcgtccatggctgagatcgggacggtgcgcgaagggttgtatgcaggtggccaggctggcgagaagctgaccagcaagacgaccaggttggtggattcaatttctgcacaaccaggttggcactcctgaagtcagagcttggaccggaagtgaggaattcttttggtctaaacaattatgtactccctccgtccaaaaaaaaaaggcaaaccctgggtttgcgtgtccaactttgactgtccgtcttatatgaattttttttaaaatttgtattttcattgttgttagatgataaaacatgattaatattttatgcgtgacttgtctttttaatttttttcataattttttcaaataagacggacggtcaaacgttgggcacggaaaccagggtttgtcttttttggatggacggagtattcgataatgctgttggccagtcgcccggcgcgggcggagctggatcgggcgctcccccgccggaaatgctactgggcgagcgatcactcgcccgcccagagcgatcggttccctccccctccccctccccctccctctctccacctggtttccttttttggcaccgcattactttcctattttagtaaatttatatacctaaagtttatacaccaagtttacacatctaaagtttagagaccaaaagtttataagtcaaaagtttatatatctgattcaaatttgaatttgaattcaaatactttttatatatagtatttctatacatctaaagtttatacacctaaagtttatagacctaaagtttatatatccgattcaaatttgaatttggattatgtccgattcaaatttgaatttgaattcaaatatttttcatatatagtatttctatacatctaaagtttatgcacctaaagtttatagacctaaagtttatatacccgatttcaaatttgaatttgaattatacccgatttaaaatttgaatttgaattatatctgattcaaatttgaatttgaattcaaatttccgatttaaatttgaatttaaatttaaatatttttcatatatagtatttctataggcctaaagtttatagacaagtttatagatccaaagtttataagtcaaaagtttacgtacccgattcaaatttgaatttgaattcaaattttttgtacataaattttttctaacgttttgtttttttaaaatttttgtgtggtgtactgtaataggaaaaaaaaaaggggaggaggaaggggagaaatgaggggcgggaccgatcgctggatcgcgatcgcccatcagacgtccccgcatcaacatgcagaaccactgagccacacatgcacatgcatgggcacgcatacatacatgcatatatactgctcacatgtaaacacacgtatctgcatgctacagtacctcacccatctgtagcaccatatactcttctcgaatttcttccaatctccttcgcagacaccgaaacttgcacacacacctcgtgaaacccgttgcgaagatctctcccacacgatgtccatccatcatgtgtcatgtgccatgtgccatctcgtacctaatttcgtcatctggtatccttgatcgtctagacctcaactcctccctgagtcgactagtcccgatccccaccgttgaccgaagttgacctcgaagaatcctaactctagtcaccttctcacatggtatcctaaccacattagacctctgcttctccctgagcattgtcccgatcctcacaattgaccaaggcggacctcaagccaactgcacataatcagacagaacaatcgtttctgggtacagatatcacaacctaacccacatgaatcacacgcattcacaccaacattcacacatactataaaaccaattctttggttaaataatttgcatagcgaattgttcatcacaaatattaatcataacttacagtaatagaggtattcctcataaaaaacaattatttttttattggaaaacagtatgggaggcccctacaatatattaattttctttaaatttaaatagttcatgtacggctgcaaaagattatgaaagaaaatttttttttactaatagttccaatacttaaaattaattataagaaatttcatacatatattctccaatctattttttccattacttattattattttcttaatttaataaaaaatatgaaaatgaaaaaaaataaagtgatttaaagaacttatcagtccaagatataccgttaaaacattatcttaagaaaaggataacatatgtacaacatgaaggattcaagatggaggcatcacaatctcaagtgcaatgttatctggtagatcttcccctggattgtgtatggtggtagttcctcgttccatgttataaacatataatcccttatctttaggtcttacaaagtaaatgcagttcctcttcaatccaacatcttctgcattgagtgatgctccaaagccagtacagtcaaccaaaaatgccttgttatcaattgtgctaactttcatccaaattctttgagataaattgagtttatgaacttcaatttgcataaccttatcaacacattcaattggatgtttaaatgacaacgtgaacaactctccacctgattctaacaagaaacaagtagaaaacgtgcaccaataacttggatctggtgcatccttaactggcgtagttgtaaatgttggctttggcaggaattcaagtgtcaaaattgccttatcctgatttaaatatgcatggaatctccccccaacagccgtaaggtgtttcacagttgcaataacattttctctgtcctctcctgtactaatcatacttgattggtactcatgcctgaaccatacgtctcctttaggatggcaataccagaacattgtgtccctgcaatttactactagcacgatacagtttggatcagaaggtttatgtgatagaaagcacttgaccacattattattcgcaagaaaattgtcttcatcgaagggtaggttgatcttttgatttgtgatgggactccataggaaaatttcatacaattcaaggtgcaccataagcaaccagccttgtgctgttatccaatataagtggatgccgaattcatccactcttttggatagcaattctcttttagctatactgtagaagaaaagagtgtcatcttcctcctgatcatcgctgtcatcactttcctccgttccagcatcatcgcttccatcataatctctttcgcacgtgtgattgtcatcttcatccccaaggtcacaatcatccttatcgttatcaacgatatcctcatcatgtgaattttcatccccgtgatctaattcttcctcttcatcatctatgggacaatattcatcatcggtgttgcccttgtcgtctgtatcaataatgcggtaagcaaccaacagtagcaccggggcaagcttaggatctagaagagctagatgttcttggtcttccttacaactgtctatactgtgggatagcattttttttccctgtgacagtgctgcagaaatttattgaaaggttagactgctttgtttttctttttttaaaaaaaaaaagaacgagctaccatgagccaagtgtgctaatatcattgaataaataagagggttagacaacatgctcttactaacaaaaaaaaggttgaattgtattttaaaaggaaaataaacaatttaaggattcttattgtttttattttttctttttccgtcaggacagcaaagacacactggccagattttattaaaaacaacacgtaggtacaaacgcaataaacatagaatgaatttactgagtaaaaataacatccaattaaacacataaaagaccaaaccaaactacgggccccttagaaaaagattattcgcctgattactaccgtggattatctatttgattagaaaaaaaatggattatctatttgattagaaaaaataaattaaatattttaagaaataaattaataagtactctgtagcttaataccaatgataaaataatgtagtaaaagaaatctctaataaatatttaatttattggctaactaactgcatattctcttcgttttaaaataaataaatctataattttaatatgagatatgacagcatagtagggatgtcttgtatggtttattttggaaagggatagagtaagggtgtgtttagttcacgttaaaattgaaagtttgattgaaattggaacgatacgatggaaaagttaaaagtttgtgtatagaaaaattttgatgtaatagaaaagtttaaagaaaaaattcgaaactaaactcggcccaagtaacgatattacttagtatgaagtagtcggatgtttgatgccatacctttacgcgtcgacagcagctagccagtggcctagtgcttcgcgctgcctcgccgatacacttcgcgctgccctgtgtctatttattggaactcctcgtcgtcgtgggctgaactggattcaccaagcggatgagaattggatatggaatcggacggatagttggtgtatacacgttttcggctatgatgcgctgatagggcaagctaggtgcgtgtctgtgtctgacacggatccagtgtcccgtacgtatctacgaggatacgttaggtaaaactccaactcttaaatttagcttcacagattagggatcagtttagcacagctccatctctagctccaactctggagcttgagtttaaccaaacagatttaactccacctaaaagaggagtggatgtggtttaatttgcatgtgagacgagaggagccccgtgtcacttaggggcaggggcgacacgggcggcgaccaccaccgcctcctcctcacccccgccttactccctcctccgcttcgttgtcgcccaagcagacgccggaaaacgcacggctacaaggacggggcggggccttccaactccctcgaggtcgcggggtcagtgctcatgaccccggccagatcaaggcagcgacggtgtggctgcgtcgagtcgtcggggtgtcgggcagggcgagcggaggcgggctaggtgcgggggtggcgacggtgccagactttgtgtccctcgccagatccgggccccactcggtctggccaccctctcgcggacaacggcgacaaccaaaggtggaggcaaggaaggtagatggcaggcgccgaggaagagagcagcggcgacgacgaggccagatccacggcgggctctgccagatttggagccggcgaaggtggaggaaggggaggatgaggtggcaggcggcgagggcgcaggagaggtggcggtggggcggcggctactgcaatgggcgcagccagagcctgccagagctagcgcccctcggacgtagtagggggcatgaggtggcgctgaaggcgccgtcgcgacatggcggtcatggcctcaagcgcgcggcgacatccatcacagttggcgacatgcaggggagttttctaggcgctggcgtcggcttgtgctccactggtggcaaggcatcctcttcttcatgcagctcctcctcctatggccagctcagatgtggtcgcggagagatccatggggaggatggaggcggtgccttgcagaggggagtggcttgacggcgttcaaagcgacgttgttactctgccggaactgtgggcgatggcctaggcctaatcgctgaagagactatgtagtagaccggcgacgatccttcttgtgcggattggttgtgtgggtttggacgggtaatcgctggcgaaagcctcgccgggacgttggccagctgacgatggcaatgccttttggcgtcgctcccctcttggaggcgtcgttatggcattgacccctctcatttccttacccaggggcggatctacagtatagtcattggtgtcaggcgacaccgatgactttcggcaaaacctatagcaaaactacttatccatatattatatcatcatattctaagcataattaacatactatgacactgatagacacgttatgataccaattaaacgattttctagatccgccactgtccttaccgctctctgggtgaaaaccttactccagcttccgacgagccgtggcggcaatctatgtcatgtccagcttgggggcatcgctttgtagagacttcttcgtgcaaggatatcgttgatggtctatgcattggcttcgaagcttttaaatcctaggttttgacgaggccttcgctttctggtcccaccttttgttttgcggtgggcgaccttcgctctttgtttgattttgctaggtggagtcagagctggttcgtcggggtgacaaagctgggcaacgatgacatgctacattctctttctaggggtgttgttgttggctgtgaatagaatgtggcgcttacgcggctttggctgaagttcatcgtggaaagtcgaagccacttgatcattttggcagcgagcttggtttggatgatgcatctggtttgaagtcggtgctactctgtcgcttggcagcaagctcggcaacaatgacacggttgcaaagtcagaacccctatgtcttttcggtcaagcttggtaactataccctaagttgggctccgttagtggtttcagttgttagtgagttatggcatgtgctgtgtagttattcagccagccggtggttgttttttttttcttttcttgtaacccatctagggttttactcctgcttattgaaaatataattgacagttctcctgctggtttagtttaaaaaaaaggagtggagctgagtaaagcgctctcacaaaataaactagagaggtagagttgggtttagatagctcaacaactccactccagactcaactcctggagataaatttaggagttagagctttaccaaacagtccctaggtctggagtatagttatggagcagcctaaacccaaaaccacctctctagttcgttttgtgatagcgctcccccagttccactctcattttagatggaactgaaactgtttggtagaatttcaagagctcgagctgtgctaaacatacccttattttcatgattatcacatctatatctactaaagaatccataattttctgatcgtactaatacgcttcgatccgtcatggtgcggcttcacccgtcatgcatgttgcgcccgtcgccccctaataccggtcgttcctttgcgtcatcagaatcagagaaagggaaaaatcataacaacagaatgctcataagaatccaatcttaaaaaagcactttccaaaataggtgttttacagcttttatccaaccaaatcggatacataacaccacaagggaaaaacaagaaccaaagctaaaaagctaaccaaaagttccctaagaaaacccaatctttgttatacctccatccacatgagaggcatcatcgacgtcacatcatctaccagccactgaacccctgttctcatcacccttcctctgctcccatcaccactagatgtagaggtacttgtggaggcagcgacaacgatcatcggacccctggtagggcataggcaagcatagagatgactggcgaggagacgatatcaggatggaggaggaggagggggaggaggtggtggagggcgtaggggcgggacggaaccgtgcaagaggaggcagtggatcaaggtgggtcggcggcgctacacggaacagaggagaaagtgttgcgccgtgtggagtgggggagatgcgtcggcatagatgtagtgggtggaacccttagggttagttttagttgggctgccagagctgctttgttttgttttttttttgttacaaataggtccactttacatcccttaaaattcataattttccaatcgtactaatacgctttcgtccatcacaatgcgccttcacccgtcgcacgtgttgcacccgtcgcccctaatcctggtagttccttcgtatcatcagaatcggataaagggaaaaaatcataacaacagaatcctcataagaacccaatcttacataagcactttccaaaataaatgtttcatagcttccatacaaccaaatcgaatgcataacaccacaaggaaaagacaagaaccgaagctaaaatgcaaatccaaaaattccttaaaaaaaatctttgttatacctcaagccacatgagatgcatcatcgtcatcacatcatcagctaccagccgctgaaaccctggctcccttcctcccgtgccatcaccactagatgtagaggtacttgtggaggcagcgacaatgagcgtcggaacccttgtagggca

SEQ ID NO: 78396 - DNA, 1282 bp, Oryza sativa
caattagctcaaaatatgagaaaagtatgtggctttcagtaaaagtagctcagtagttactaaaacttacccatcaaccaaatacttttgcatgttgccctggaacttctggttcatcttgtagctcacctcctttcttctgtagaaaaacatagtctactatgtagtaaaattaaagtaattcataaactgagtaagctataagattcatattagctatgcctctgcacatgcaagaaacagaacatgtgacaaagtacacatgaaattgatgttccagcagtataattagctaaaaataatcgactaccccaactagagctgaataaaacttgttcacgtccaagggtataatcatcatgatggtttcttctcatgccaacattgattcataattcttaatgctgttgcatatttcaccttaagagtttgcactttgcagaccaaatgtggcatgccaaatatattgctgtttcctttttacaataaataaaagcattactagttgcatagcatccttagggccaaacagttacaccaaaatttcagtaagttgacatatatgataacatatcaggccccccggcatgccaaagacagcgctggcaaaccactaaggcaaaattagcaccagaaatctgacattctggattgaaattatacagttggttcatcgacttctgatctatagaggaagttgcaagtctgcggcgcacttgaagcacccagcgctggtggagatggatgaggccttaccgatcgcgcacctcgacaaataccctcagttggagcagcctatcgatggcgaccctgtgcttggcggcgtactcgtcgagcacccactcctccatggccgcagcggccaccggcgccgacacgtacagcatctgcagcgcgtacttcttcgcgagcggcgggagcgacctgcacaacgaagtggcgaaaacactcgcgatgaaatacagcacggaaacgcatcgccgcagccaagggcaaggccggcgcggagtgggcacctgagcacggcctcgcagatgaaggcggagtcgtagagcatgtcgagcttggcggccggcagcgcggccaccatgtccatgaagttccgcgcgaccaccattacctgcggcatcttcgccggggggtggggggttagctcccagcgccgatccggtgcgccgccgtgccacacacgtagagggagcaagagcgaggaggggataggatgggaatatccggcgaccaggcgagagcgtcggcgggagccctaccggggagatagcgg

SEQ ID NO: 78397 - DNA, 3922 bp, Oryza sativa
  unsure (1)..(3922): unsure at all n locations
tccctcggaggttttgctaacgtgtcgcatacgtagcagcaaggactcggtcttctttccatgtagcgttgatgtggcgctcaagtggcactagaaataaaaaaaaaagtgtggggcccatttgtcattcaaaaaatatatagtgtgggacccactgccatgtggggcccacatgccatcctctctcttcttcttcctccgctcttcctcccttctctctttctttccctttctcttctctccccttcggccggccgcggggagcacgggctggagcggcggcgagcggcggcggcggcggcggcggtggaagctgacgcggcggcggcaagattggaagttcgggactcgctgctctgtgggctgtatgcctcgctgctctgcctcctccaccgcggcgctcccggcgccggcgggtccagatccttcgagacggtggactcgctcaacatcttcagggccaaggactacgacgccaccatcgagttatactgggcgcccatgctcgccgagtccaactctgacggtgccgctgtcctcgacgaccgcctcatccgcagtgcccccatgaacaagcactccaccttctggaagggcgccgacgtcctcgtcttcaactcccaccgctagtggatgaccgacgacaagatccagatcctataagctgctagctagcaaacacatagtcatacatggcgtgaacgattgatggattcgtttgtgagattgtttgtgtgtgatttgtctggatcgatggattcatctggcggcggcgactgctacaaccagacgttgccggtgggcgcggccaacgcggcgtcgtaccgcgggagcacgagccgagggatgctgcaggtccccggcgctgccgctttagcttcttggggaagaaggggagagaaagagagagaagggagagagggaggaggaagaaggaagaggactaacatgtgggccccacatgtcagttggcccacatttctttttctgtgaatgattaatgggttccacacatatttttaattctaatgccacctaagtgtcacgtggaacgaagactcggtcaatatcgtcacgtaggcgccacgtcagcaaaaccgccctccaaaaccgccgagggagttaaattgcaccagttttaggagtttgggggtcgaaatatccggttttgtggtttagggttatggattagatttcgatcacagttgagggtcacgaagtgaacttattcccttttatgttagattgggctacaggcctcttgaatgaaaggattgggctacccaaccctagcccattttggcccattggcaagtttgtgtttcaaagttgtccatgcatggataattatttatattttttttcttgttttttttcgtttagacgaaagactcatgcataactacacagcacgctcacgctcccatgaatgtgcttttattttaaaactacccatgaacgtgcttaacatactcctaactacaatttcctatcctaactaaaatctgatgaaaagaacccccgaacgtgtataatatttgctcgtttttttcaatttcagtaccgtactcgtactttccaggatcaatccgtcaattagccgtccaattttttttccatgtgaaagaaataaaatgtactagaaaaatgaaatcatttcacaggtatactggcaccaacatgacaatttacaagtctagagtctggacatcaccaatgttgacgtacacgtacgtgtcaaatcgctttccgtgttaaaatcttcctcgccacacaaaaccaaaggtgcgcgttacatgactttcgccgagcactcgtctgctgcgacgtcaaactccaaatttatacatcaatacatgtggttttgaatttttgctaaaaggaaattcatgtgtggtttaagtagacaagtagtagttggaattttgaaatggtgttcctgtactacttcctactaccaagtactacgaaccaatgaaaaaaaaatccggcggacaagttgaagctggaaatggtcagatcaaaagtcaatacgaaaatgaaactgatacttgccgactgtcacgcaattaataccgataccaagcactacccctgtttaaagaattaatagtaagattatactaagaaactagggttggcagccagattttagcatataggagtagttcgatctttgggttttacaaatacatctttctcaaatcctagactgtcatcagaagcttgttgttgacgaatatcgtctaccaccgaaaaaataattagccacaaatacaagtaataatgtcaagtttagaatttaaactcaggtgagctagttctatcacaggataatcattttagttacgcctattttgctttgtaattttttttagacatgctaccacaaggagtaatatagaatttgttttttttttcttttttctactttggaaaggatggtttttacacgaaattttacatgaactgactatttcctaataaaatcaaataaaaaaacctacgatccaatagtcacaaaactccaaacctaattcattttccatgtgactggggagatcagtcggttgatgaacgataatgtttttctttttctcaacacaatttcataaatcatcgtagcgttacacacaagctagcgcgtaatgaacattattaacccaggtgcaaaatcacaaatcacattcacccaggtgcatatgctaactacaggtgccaggattaaaacctactccgtactcattgtccgcatggccgtgactccacaccacacaagtactacttccctaatttacgcgctaacttttcttaatcaaacactctacacacgacttatttgattaccacgtaacagtagctagtaatttctcccccaacttgttctccggtctccacatctcataggatttatagcacatcattacgtatatcatcataacaaaacatatcactccccatcaaacattatgacgtagtactatgtaataattagctcccttcatttttaataattaagatatgccttttaaattgttaaatagtacatttctatgtgaaaactttctatataagaatttcctctaaaatatatcaaataaatataatttgaagtatgtaattattgaaacgcaattgatcatacgctaatgctttctcattatgggtgtacttacttagtcctcttgttcgtcttgcgaagagccgagagatttgtcattttgctatgtctaggtgtttcatattataagttgtttattttttttctctagccaaacttctttaaatttaattaagtttataaatgaatatagtagcattttttaacataaaacagacatccaatgctggattttattaaactaatttgttatttttgatattactaaatttttctataaatttagttaatcatcttaaccaagtttgactaagaaaaaaaactacaagtacacttcttttcaaggtacagcagcgtcacggcaaacccgtatttccacaagtatatacggtagtacaaaatacaatagagtagaagcaacaatcatttaatctttcacggaaaaacaataataagtaatatataaaataaaaacaaaataaatgaagcaggcagcaattaactcatgtcacatccgtgccgaaacaatccaacccaaaattcccacatccatttctccagcgaccatccatccatcgcctcctctttccctcccacctccacacgtcccctcctcttccccaatattccacgccaccgccgccggtcaacccctccgccatnncatgcagcagcagcagcggtttctcccattcccattctttgctcccacgcgaggctgcgcggagaacagccgcacaggtggggtgggggtgcagaccgagctgaggagtagccggagttggtggtgagagacgcggg

SEQ ID NO: 78398 - DNA, 7043 bp, Oryza sativa
ggtgtgggtggaaccctaagtgttggttttagttgagctgattgggcctattgggtaaaatttgctttgttttgtttttttgttacgaatatgtccactttacatcccttatctttctgtcgggtttaaattgtatccctgaactacaacaccaaaaatcttgaaaccccccccagaaaaaaaaaacttagaaaactagtttaaattagatctcctggtagtatgaagttggtttcactaatgtggcatcccggtccggtaaagtatgaagaaaataaaaaaaaacataggaggagtagctaatcaatcatattacctttttttttctaaaagaattatcgaaataaacctattcaactatctaattgttcatgttataagattaagaacctatccctttttcatttgatttttgacctatgtaccttatatttgagctcattgagttgcatatttttaattcattttaagcattttatcatgggatttgagctaatctagttgttgagttagcttcatgattttttttcatgacttttgatgatgcagtcccatccaccacgaaatattttttgcagagcatcctactttgaattgaagcggttatagtaattttctttccttgctttactgttatgtcatgaaaggtagatccgacacctacgtttggattgatttctttgtaagttatgagttgtaactgcagatttttttttccctaagagtaaattttacaaaactaagggtattttgatcataatatcataaaactatatatttaagacattatattacaaaactacagatttagcactaaatttatcacaaaattacagatttaaggttaagtatcataaaactatatgtttaatactaaagttatcacaaaattacatattttaaagtttaaatctctagcactattgttagttttgtgactaaatttgttctaaatcgttttatgataattttgttactaactatgtagttttgtgacaccctattttaaatgtctagttttgtaatacatcgagttaaatatgtagttttacgatagtttgatcatgatatctgtagttttatgaaatttactcttttcttaaagtgaagttaatcatctcataaaatttgagtattcccgttgtaacgcacagcactaatttgctattaaataagacaaacagttttactatatttttgtcgccagatttatggctccatatatagcagtcagttttatggccattggattcgctataagattcgtgtccagttaaatccgttgcctgtgctcataccaccgctgctcgctgcttgctgcttgctgtgtttacacttttacacttcatgtttcacacttgcatgtttgcgtctggcgtctgccgcggtccgcgggctgtatacagtttcgcacggatggaattacagattttacagtatgtacctggtgtttacagtgtagttacattatacatgtagtataattacactgcacttacatatgtaatttttctatatttgaatgtaaattttgtgtttgttagttctctaaaatggatttttttttgtattttgactaaattaagttatgccacaacttattaataattaatattttactactccatgtggttcttgtcttaatcatatagggttttaatctcataggctgaaatccgatggtttttggctaaaaaatgtgttgcatgaagtttaggcacacccaacagattcagactatatatatacatatataaagactcgtaataatgcacgtggaaggcatgttttttacaatttatatttaaaaagtaaaaatatgaaaaaaaaatacagtacttgcaagggcatattcatacattgacttgagaaacatggcaagggtatgtccacacagtaaattcagatacattccatgtaattctgaaaaagaaaaagatatattccatgttcaaccttaaatggtaataggagtatattgtttacacacattgtaagggccaaggtcaaacactaaacccacacaaacctttacatcgacttgtgaatatttcgggatcgtagcgatcgtagaatcaggatactaatatttcgtaggatcatataaaaatgaatagtaagatcatgatactataaaaattaagatattagatgagatcggtatcgttttgatttgataggatcgtaatattataataagatactagagtacaaaccggtacactgataaccttgagcgcgacaagcaaaggaggtgaaagaatgcaccacaactccggcctcctgtcctcccttacccccacggaccacgcatgcagcagcgcgcggcagcgatggtgatactacgtgttgcttagaaagggatcctctgactcaactgcctgacatgtgggccatagaaaagtgagacccacatgtcagtgactcaactgcatgtgcagttaagtcagaggatctgcttccgtgttgcttctatgcttcctcgatcgatctccagctccccctatctggcgccaggtaccgcgcctccatgctgccgaagacgtcgatcgatgcaggggagctgatccgtcgccgaccaccgcggggaggccggatccgtcgcctgccgccgcggggacgacggcggcaggtttcaggcaaggcggcaacgacgacgacaacggtggtgacggcggcgggcttcgggcaaggcggcggcgacgacgacggtggtgatggcgtttttgctttttttttttttattttttttcccgtgcgtatgcgtcactcgcatgcgaaaatcgggatcttcgcagacacctcattccagatgggtgaaagatccgcccgcaaaaaccgattccagccgcacgggaaaatcgctgttgtactcgtgacagtcatgtagtatatggagatcaaagagcactatggctgtgccagattatttgaaaacatggacactcggctcaagctagacatttgcacgatttcccacgatttcattatgtaacacggaaatgaaacgaggattattcttaaccagtcgttatcaccttatttcatatacataatactttgcacctcactttgttttaaaagaaaagttttgttattaatagttccaaagctcaaaattaattgtaaaaaagttatacacgttgtccaatctaatactacctccgttattatcagatgaacccgttaatgtttagcataacatttaatcagccatcttatttaaaaatttagtgtaaatatgtaaaaatgtagatcacgtttagtttcttcaataataatgaaaaaagtttaaaaaaagatgacacttacttttttttaataagacgaattgtcaaacacaattaaacagttaacaatgtcatctgttaaaaagggagtacttttctatcacttattattctcttataatttataataaaagaaaaaaatatattctcttataatttataataaaagaaaaaataacaaagggaaatgtatattcaataatttaaacaaccaacattcaagatgtatcattagaacattattaaacaaaacaaggggaaacatatgtccagcgtgaacgattcaaaatggaggcaccacgatctgaagtgtcatgttatccggtaggtctgcccctggattatgcattacagtagttcctcgttccatgtcataaacatacaaacccttatcattaggtctcacaaaataaatgcagtttctcttcaatccaacatcttctgcagtgagcgatgatccaaagccaatacactcaaccaaaaatgccttgttaccaattgtgttaactttcacccaaattcttctagataaatcgagtttatgaacttcaatctgcacaaccttctgagcacataccactggatgtttaaatgataacatgaacaactctccacaagattctaacaagcaattagtaaaagtggtgtaccaataaattggatctgatgcatccttaactggcgtagttgtaaatgttggatttggcaagaactcaagtgtcacaattgccttctccttacttaaatatgtgcaaaacctccctccaactgcagtgagatctttcattgttagaatgacgtttctacggttttcatgagtagtgatcatacttgactggtactcatgcttgaaccatgtgtgcccttgaggatagcaataccaaaatgatgtgttcctacaatttaccactagcacaacacaatttggataagtgggtttatgtgatagcaaacaaacgacctcattatttgtaaggaaactatcttcatccaagggtagattgatcctttgatctgtgaaaggactccataagaatgtttcatgtgattcaaggtgtaccataagcaaccagccctgtggtgttctccagtatgagtggcaattgaatatatcacctcttttgcataatagttcttttctggctatactgtagaagaatatggtgacatcttcctcttggtcatcggtgtcgtcactttcctctgtcccagcatcctcattgttttcattataatctcctttacaaatgtcatttgccgcctctccaagtttatcatcatccttatcgttgtcactaatatcctcgtcaaatgaattatcatcctcgtgatctaactcttcatcttcatcttctatggagtagtcttcatcctcggagttgacctcatcgtgtgtatcatctaagttgtaatcaacaaatagtagcaccggggcaaacttaggatcaagaagagttgaatattcttggcctttcttattggtctccgtactgtgagctagcatgttttctgtgacaatagcataaaaattgaaaggttagagtgagaaggttgaatttatattccaaaaggtattaagagtattgtgttactgttgtttttcttttctcacaggaccaacaaagaaacagtggccaggttttattagggaagaaacgaagattttacacacaataaacaccaacgatattgctgagcaaattaaaggacaaataaccgaacacggaaaaggccaaacagattacgtgaatatacactagctacatcactgtccgagagaacatcaacaacaaatcacccacgccacgtttctttttttgtttgtttgtttttctgaaagtagaaaagacggacataattatgtttccacaaatatgtcaaaggctctcacgctaaataagtacgaagtagctaatctcctcgaaaaaaactacagtagctaattcattaatactcctatatgatataatacgaaattataaagtatagtaggttatagaggtttggtgccatgtaccttcttcacgcgtgttaactgcagactcgtactttgcttgatcgatcgatcgcgttgcctcgccgccttagtcgcctatatatctattctatttattgggaagacttctggtcgtggtggcgcgctgcgaatcagattagaactcgagtaagcaatatgatatttccttctccgatgccaattagattagaactcaagtaagcaatctgatatttccttcttgaactacatttacgttataacggacagcctagacggaatacgataggaaataatgtgaaagatctgttatagattttgagccgtgtgcgatcttaacaaagatggattagattacacccgtatgaaatacgtacaagaacatataagtcatggcataagtatatatcttgttgaaatacacaaaacaaaattaaattctgtaaaaaaaactagaaaaagaatttacattcaaacatactatgtaagtcacacggtaattacaattacaatgtaattaccatataataactatgtaacttctgtatttgccgccattgttttatgcttctctatcttctcatggaacctaagagcatggccaagagaggcccaaaactctatcccaaaattctggttttgggatttgtaatcgggctttgaggtgttgagtatattgctcgcttcaaaagatgccttaaatttctcaaatgaaaaggtgggggccaccggttaatccatccacataaatctcggttgtttctccccttcccatctgatcgctcctctccacgatcgttcacgccccgcgatgagcgcgcaggaggccaattgggagtgagacttcttccatacctatatatggagagcgataaacccagtgaagggaatcctgattttcggtttcatgtttagggccaccgttcgatctatttttttcaacaaaattcctaaatattttgtgtgtctgtgtgtgaaacaaagacgagagtacttcctccgtttcacaatgtaagtcattctaacatttcccacatttatattggtgttaatgaatctagacatatatatctatctagattcattaacattaatatgaatgtgggaaatgctagaatgacttacattgtgaaacggaggaagtagtagatatttttatttagagggatttattcactaggtaaagtcctaattatacccctgaactattgagtgagtacgaagtaccccgaaaatcagatatcttttaccctcaactatcaataccggattgaaccccctcctcaaagcagctttgcaagtggtttcggtactacgtggcagtctagtcagcaattcttttattaaaaaccaatgaggctcacctatcggatctctctcctccctatctcttaatctctttcccctctcatacatttctttctcgcgcgcgtcagatgccgaagaggaggcgcgccagcaactacaagtgtctcgcggtggaggccgaggacgagccgcgtgccggcggccgcgagcgtcctcgcggcagaggctgaggatgaggccgaatgtcctcgtggcgagcggcggccgacgtcggacttgcacgagaagatgatggtggtgggagggggagcggcggacggcaccggactcatcttggaatgacacccacacgaacaccctgtcaccggcgcgtcccaccactgcgaggctctgctgcactaccgccatctgcccatcgccaccctcagctccccctccatcgccccgag

SEQ ID NO: 78399 - DNA, 2037 bp, Oryza sativa
tgtaaccctgtgctaactgctaactgtcccatatgctttgcttccgcgaaacttcgagacgaattcgtcgaagcaaaatgcatatactccatactgtttcattggagaaaatggttttctctatacagtttatctgaggattccgtgcaagaacagggaggtttggaaattgcgtgttagccgaacccacccccaccacccaaaggaaaaagcaagcacctctctttttctcctgtggaagttaaagtttaccctttttctgatgggtgatggacaatactcggctcagcataccactattgctccaaatttgggtacagtgatgcggaagaaaagtagtggatgttagaatttagagaatttcggtggttgaggtgatcaccatgaagtagtattgtttttggaatcataccccaaaaatttaggtggcggctgcaatgtagctagggccatattggagcatgacgcaatggcttaatgcaatggatggcccaaccaaaagggacatgcgacagttgattggatctggttgggcgatagcacttgcgaaggagataaacgaataatttttgggttggacaatcgctttcctagacttggtgcctgcttggctgagcttcagattagattttaaactttaggactaattttagtggttttcttcgccactttcttgtctggctctagtttcatagtaattgctaaaatggaaagctgaaaaacctatctaaaactagtctttagaaatcaagctttaaaattcgaaattgttttaagttataatctgatgcagaaacaagcaggaccgatgacgattatacctctccgcacctttttttttacaataatgcccctccacatttctattactgctaactaagatggtagtataaatagatctaaacccttcgatcaaatgagattaacggttcagattgctttctaatgccaatggagagcaccatagtggggctccaattaatttgggctgttattcatacctttcttgccgttaggatgtcaaaggtgctattctgtatactagatgcatactttaccatataaacatctagacatttacattccttgtaagtttgtgatatgaactagtaattcttttactaaaactttcactcaccgtgcaggtttatctacacttttattggcctgggagtctttatgtgcttgttgacttgctctggtcatattgcagctgaaactgcaaacagccactgtctctcttgtgtatccttcaagcagcttggtttatggagttgttttggtgcctaactttacacttttatgtttttagttaataaagtgaagttacctgcgtgttcgttgaccggatatgttctatagtacagaactatgtttttttactggtttatataattgaaatgccacaaaaaaaaatttcggttgagcagatctttctttttaacatgagcagatcatttctgaaatgacagtgcaaacttctattcccttttatttgcgggccaactcttgatccatttaagcctccaaccttacatgtaactcaacctggtgatgcaaggactattttgccttaacctgacattcagtacatgatttttgtgtttattattattatattggaaggagcaatcaccactgacgtatttctgaatagcaactgggaggaggtaaggatcatttccttctgttgttttttcccctctctctctctctctctctctctctctctctctctctctctcaatacaacattatggtttttaactgcttcaccaacattacggtatgcatgtatgtattcctttgtaatggcatgtattttcttctattcgatcggtgattgtttggtattttccaacccttcaggatttccctgatgacccatctggaaagtttgaagaattcaaggattttataagatcaaattttgagatttgtgaatggataggcctctcggttgtcgctgcccaggtgatattttctgctcctttgctgaactaggacccaattcattttttttccttctataacttg

SEQ ID NO: 78400 - DNA, 10675 bp, Oryza sativa
tagagaggggagaggaaaggacagagagggtgggagactgacaagtggggcccagtgattaaaaaagaattgctgactgaactgccatgtaggatcaaaaccactccgattcgagtcaggggataattcgtccggtattgattgttgagggtgaaagatgtttggtttttgagtcaggagccgattggtcacaatttgagagctctctagagacatcatgaaaggcgactggaaaaaaaaaaaaacaccacctctcctagtaatcctagattagcatagcgtgagtcggtcggtcggttcctcctgttttcaagaaagtgtctttaccatcgctagggctatgtcccgtttagcccgaggtcgctagtgcagtcttcatggcggccagccttacaaataattgatcaggtggtggtgggttttagagtcagttgtccagtggatcagactgcctcaacttcgaggcttggtgttggcggatcaacgaggtgagtggttacgtgtagggtgaaaacagtatgtgtattttctgaccgcccacctgactaaggctcactggaagaatgtgggaaagaaaatggtatacccgatactatctaagtttaaatccaaattcacaaaaaaaaatataggttaggatacgaggagagttgtatccgtccgtttgtcccatattatgaaacatatataaaaatctattataaatcaacctacaaacatgataaaagattggttaatcactattttacgaggtcacatgtaattttgtacaatttttttctcaatatatctcctctagcacttaattatattcttatatttaatatctataaattagagatacaaatacatatatgttacccaatcctatttagaggaaataatatgggctaggattcaagatggttgatatgttatccagcgttacctgtaccggtttcgaatttgaagaaaattatgagttagaatatgagaatgccaccgaacccgtccgttttcaccccttgcaggtgctctcttccgatagatctcgcatcagcgatccctccgctcgttggctttgctggtggggagatgcacatctgctcacacattcggccggcggtccaggagatccaacagggcaggagcttgatagcgacgaatctgctatctcattgacgaacttcgtcgatcggttgtgggcacagaggcagcgatttgtgccttcgtcgtggtgaaatccttctgattcaatacgcaggcaaatgttggtgccttcgtcataatgagatccttcttattcaatgcccgtgttgatctccctggattctttttttgaacttcatctccctggattcatgaagcacctgtttgatccagataatattagatacagtgaatcgtcaccatgctagtgctagcgtgattatgggctgctgttttatgggggtttcttctgttactatcgattgcggtggtcaacaacttaattaacatgtcgattttaccagtgaagtgtcagccacaaatgcgactttggtcagcagggatgaagctagcgctcctcagatttaacgtagagccatggcaattctatattgagaccgatgaagcttataaaaaatcaacaattcaacaataataaatatcaaactaataaatctcaaactgtgctttactctgtgaaggcaatcgaagagatcgccagtttctcaagcggcgtgcacgtttgtaaaggcctctcgatagaatcatcgcggcaacgctggtttcgtctattactactgcacgattgtatttggaagattataaccataacccagctatctttacctggatggctttatttatgtctttatgttgtactccctccagtttataacatttgactattcgtcttataaaaaaatattataaaattattatttattttgtttgtgacttgctttattatcaaaagtattttaactatgacttactccttctatttcacaatgtaagattttataatattcccctcatacatatagatattaataaatttaaacacatgcatatgtctagattcattaacatctaaatgaatgtgggcaatgctagaaagtcttacattgtaaaactgaagcggagaaagtatcttttttatattttccctaatttttttaaataaaacgaagggtcaaactttaccagcaaaacatcaaaacgacatataatttgaggtaacataagttaagacaatgtactgtgcatatttatatttccctaaactcttattaataacgtacaaattaagttattttttttagaaaaaagaaccggcaatggggcaatatcacgcggggagaagcaaggtacgtcccaatccggggcagacttcgcgcgtgcgttccgaattttttttatttttagatttttttaaaaaaaatatttacagaaataatctatcggccaaaaaaattgcaaaaatagaccctgccgcccacctctggggcggcaagctgacgtggcaaacgggggagggacgggcggtgacggagggagggtttttttgcagtaaagcccttgccgctctcttttggggcggcaaggggcccgaatgcaaaaaagctagtcgaggccggtcattttgcaggcggccccttgccgccctctggccgggcggaaggcctcgctgcctataaaaggcctgccgcccagcccccagccctcattcctcccctcaaatccagtgaaaaaaaacaagaagaaaggggaggagaagagaagaaggggtgaagccctgccggattcagacgccgatttcaggtaatattcatagatcctatatgtgactattgagttaaatagtgtattttttaaaactttatttgaataaatacattatatttttagggttttagttgtactaatctagaagtgcgtattgtagatattgttaactatgtagatctgctagtttggaatcaatacttttccgttgcattggcatacacaagaagatattacgttgtagatgtttattgcatgaaagagtaatatgatctagttattttgttgacagatatgtcgaacaaacaaatattccaagtttaccatggcccaggaaacgtctgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacacgggtggcctctagctatggttccgtttgttcacccgaaggatccatgtgtgcagatgaacatggatgatggcgagggaccaagtgctgaagtaaatgagacttctgtggaggaggtcaacgcacgagaggacgggggtgtagtagctccagtgggcattcaaccaggtgtagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggttggtcgtctctgaagaggatagtgtgagatgggagtacaaagaaaatgagattattcaggaagcgatttatagtagagcagaagatatgaaggaggcggtaaaacattttgcagtgtcacttcatagagagttttgggttgccaagtccaaccggtcgcaatatgaagttcggtgtgttaaggaaaaagatggttatccctggagagtgcacgtgtataaggggaaatagaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagagccaaacagaaaataatagagatgagatttggaacttacgaagcctcgtacgacaatttgccacgcctgcttggcgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagcaggtactggttcctgaaattggttaaaacaaaaattgttggtatgaggccaaatgtgtgccagatacatgataggcacgctggcattctgcgagcgatagaagagttgcagtttgggaatatggaacaaggataccctggtgagtgggaagatgtacagagcaggtggtgcatgcgtcatatgggagctaatttcttcaagcaattcaagaacaaggagctcatgaacatgtttaagaggctatgcgatcagaaccaggagaaaaaattcaatgagctttggaagagattagatgagttgacagccaaatgcagtgatcagcgtgcagcggctccatcaaccgccgatgctgaccctccttaagctcttggacctctcccaacggatagtccaacattggttagaagaactggattggagattcggaaattttctcagtggattctgcatgaaccaaaagagaaatgggccaaggaatatgacacaggtggtgctagatatagaataatgacaacaaatttggcagaagtttacaactaggtgatgcgcggtgttcgtggactgccactagttggcatagtggagttcattttacatgggacatgcaggtattttagggatcggttccaggcagttcttccctctatgccgaacaacagcattttgtttggaactttcatgcagaaaaagctagaagagttgcgtaaaaaggccatgaaacatcgagctctagtgcaaggtacccaacagcacaggtttgagatactatgtcaagataaggcaggcaggggtatctaccgcaagagagtgaagcagtagtgtgttctcaaagccgacggcacatgtcattgctcttgtgcaaagccgaagctgctccacagtccatgcacccatgtcattgctgccgcagcggagtgtggcataccagatgcagtatatgtttcacagtacttcagtaagcaagcaatatatcatacatggagcggcgagatttatgggttcggcatagctgggtagttcacagagactaacgatgaagtactcaatattcctgacacatcgaagctccgaggcaaggctggaaggaggaagactcgtcgcatccgcaacgatatggacgagtcggaggctggcagggtgaagcgttgcagcaaatgcgatgaacgtgggcacacctacaagcattgtcctaaagacaaggagaaacctagtgcggcagaggcaggactatcaggatcaacagcagatggagctcgccctacggatgaaggcactacctccactcgaccacgtcctaggcgtcgtcgtgccacgtctggctacatggtgtagttcttatgttctatgttggcatgtggctttgcttgtaatttgtttcgaacttatcgatgtgtttatgtttcgtcgtgaaatgtcagacttcggcatgtcatgtctttaggtctcgtgatgtaacgtcagactaaggcacctagtgtctctctttctttctatctgggcagctgagaggattgcgatcggccgccctgaggtggaccagcacgcgtacaaggagtcactgtacgcggagcgaccagaggtcgactaccctacgataggtactctgtggtgccgtcgtcaggtacgttgcatcgatcttctcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacagtctgcaccagggaccaggcgtactggatgactacggttccgatggtcttcgacatctgcgttgagcctcatgcccctttccgcgtgatgcggcagttcggcttctgtcagccctttccagtaccgtttccgacgaccgtcccagctgctgttcatcggtaagatctttcactacgctttgagttgttgcattaaaatctacatgtccataataatttgcaacatctgtcgattcacactaatatgacacattaattcgcaagtactcgcgcaagggtcagcagtcagctggcgactggcccgccaagttggcgacttttgttgaggactggttgctcacaaccgaggaggtcgtggaccacgagggagagccacacactgaggaggcgtaccaggcctacctacgctggtaccagccacgtacccgtactagggtcaccttcgctcccttggagcagcagccccacgttgcgagcactagagacctctacgccaggcaccgcgaccaggacttcgctcgtgctgtgagtaccatgcatcgcaccattcctttatgttttcatgtctttctcttcatcaaattttacgaatatgtacgaaaaaattaaccaccaatgtttaggcgcggggattccggtacccgtagaggagcacctgacgacatacacgcggatggtggagtcgatacgctcgattctccgagtgctcacatgtcgtgcagatgacgttgctcgggcagacgcagctgtacagcggccacccgtaccgactggtccccgtccagctatgcacgttcctaggccgactccccctccgcacggaggtaagtatttttaaggatttttctgtacatgccttgcacatatatgtgagccgtttcacttgccgattgcttcagggtttcgtgcaccgttcagcaccccgccttcctcggctaggccctctgttgtgcccccacaggtacttaaaaaaacaacattacttcgacaatcaatttacatgcattttatgtcttagcttacaagggtcccgttgtccatgtgtaggtttcacccagttcgctatgacgcaggctgcccacttctcccaggctgcagcgtcagtgtctcaggcagctgcgtcgacctcgcactcagtgcagttctggcagtacaccgggacttcgtcacaggcagccggcacgtcgagtcagggtccaccactggaccatgctgggacctcgtcggaccacttgctgccttccaccttgctcttcgacatcactgacttcgatttcgcttcaggctagacagaggatgtcatcggcccctcacagctgagaggggcaccgccggtgcagacgcaggaccaggcgcaggccactccgccgccagacactcgtgctacccgtgctgtgccaccggatcgtttcacctactcccaggaccacgtgcgagcacaggcccggaggaccaagcgtggtcgcggcgcggggcagggccagtagagcagtcttctctttatttatttgcttcactttccagtactgtatgcttgtgtcatgactacgttgttgttatatgtgcacgatacctttcggcgcatgcacgactactttctgccgcaccgatgcagcctcctttattcgcgtgcgatacgagtatttgcccaccatttgccgcatacgaccaatgtaactttcggcgccgatcaggcatgtaactttcggcgccaatcaggcgtacccaccatgcctcgccacgttcacatgtcagggatatcactcgattttttgcgcctatataagtcgccttaacgagtgaggcctcacaatctttcagaactcagtcacattcagtactctcttcccccacttgcttcattacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatatttgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcctgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggatgcccatccaagatgcaggtgtggtgatcgtggtcaggttcttcgttccataaagcctacaacattgggtcgaaggttttttgtttgtccaaatattcttgacgacgatttcatggtaagaatattttgattacatgaatccttattttctcacaacatttactaactttgctcgctttacatctattctttcctcctaggaaccaccaaggagatatcaatacagaaaacggatagacaccagaagggttctaactccacctagccgtgttgagcagcttgaaactaccagagcaatatagggttactaaagcgcgttttgagagaggagagggatcctcacgtaggggttagctattatcggacaacttggcatattgaaatttctactgtcatgcttccttgtcccattactacatcgtcgttatgttcaactattgcactacctccctcctagttcgaatctaatattatctatgtaaccgcaatggaaatagttgtatcatgttcaaattgtactactatttcttcatgttacataattctccttgtttaaatccatataatgtttatacgaccgaaactgcgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggtcgtactttttgcatctgggtcccttgccgccctctactggggcggcgaggggcccaaatgcaaaaagtacgagggcaacctctttatgggcggcaaaaattgcaattagccccttgccgcccagggtaattgcaattttggccgacggcggcggacggcgcggtcgacccgccatctgccacgtcagcttgccgcccaccactggggcggcagggtctatttttccaatttttttggccgatagattatttccgtaaatattaaaaaaatctaaaaatgaaaaaaattccgtgcgttccaactacttgggccagaaccaaacgctaacccacagtcgaattagcccaactttaataggccaatacgctagctcgggaaggggtcgaaaagtccaatttgatcaaaaagtgtaacgacaccggcccacagtcgaagtggcccagttggccaacgcagcccacattaacaacgccaaccccaccagagcacgcgctgcctagccccaagtcccccaaccctcgccgccgccgccgccgcctcctcgcccccgaagcgtccccgccgccgccgccgcctccccgtcgggaaggatgaccctgtccatgaagccgcggaaggtgctggtgcggaaggcgatgaaagaccgcaagaagaagaagggccccaccaagcccaccccatggaagtgccccctctgccacgagctcttcctcggggtgcgcgagggtaaccgccacttcgaggagtgcgaggcggcgaccaaggccgcgcgcgccgccgaccagaggaagatggacgtggaacgcgctcgccaagaggagctcgtgggatccaaaaaggccgccccaccgaaggaaggtagagtctcgttttcgttcgcgttatttgcatcgcaatgcatggatgaatgaattagactttctggagaacaatcccgcaatggatggatgaatgaatgaattagactttctggagaacaatctgataaattaacgaattgaacccgcgtagttttcaggctatgaaaactttgctgcgaaattcaaacgaatgttccccaacatagataggaattccatgcagacatttttgacaaatattagcatgctgggtgtataaaatatatactgcactgagcaaatcttaaaaatcactcttttcaagaccttacatagttggacgcacctggacctgctgcaaagaattactagtgggttatatctgctgatttgttttagaacccatacatttacctttccgtagtacctgg

SEQ ID NO: 78401 - DNA, 761 bp, Oryza sativa
  unsure (1)..(761): unsure at all n locations
cccgcctatatttgaaatttaattatattgcttgcaaaatattatgcattgataggatcacacttaatctgttgtcccgtctgcaaggcagattggcagacctacctaatttgtcgcatttgatccttccattgttaattgctatgccatgtccccttgtaaccacccagttgcgcctcgatactcgtgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttatccaaacataagacaagtacgaccacatagatagatagatcactgtctttttgtgattagtaatttaaattgtttgtttattttttaaaacaataagggcaaaaaagagatcggaagggggagaagcgaagcaagcgcaaggtgtggtgggacatatttttatcttttttattagatcttttgtccttttgtgattaggaataggaccgattattttaatttcgctcttttttcttcaggtccgattttttttgccatgatagaatggacgacaaaatcatttaanatttttttaagtagtagagatttgtacaatagcttttacgtcgcttaaaacacataaatataaaagttttaaatacaat

SEQ ID NO: 78402 - DNA, 5745 bp, Oryza sativa
ctctgaagaaagacaacaatgttgacattggatcaggaattcgaaagatactgaaatgtgatgatgaaatgcaacagtttaggaacctttgtgattatatgccctttatacttgtgttgtaggccatcgattgtgttcatagagttagattggacctctgtatcctcagctagtttctcttgcttgaagagttattgccgttgttggacgatcaatctatattgcagtgttacacaaggtaactgatgaactgatattactatgctgtcgctcaagctgtattcaagccagacaattttgtcttctttttgagctttatggacttgattgctaactactcaattgtagattgagaatttgagttttgatcaagaagagcggtaccattttactcctgaaagatataagctactcctccgtagcattttttttcctgtgaaactaatgcctttgcaaacgagacctacctttttgtgccggcaggagtacacaatctcgggccctgtgatttagatgactgattggatttttgtcacagattatctacttacttaattatagagataaattaagacttctataacaagtggtctaagcaatgcatagaagatttttttttttgaagtgtgaagtaaataatctgtttcaataatccggtgagtaatacgtaatatcaaaagaacagaggccggcgtgcaaggttgttcagaaccatctgttcatccatgaagtgcaagtactgcccagcccaatgccccaagagcccacagtacccttgtcagaaatcacgagtagtacaagggcttgaacacaaaatgacccatttgaaaattcgacctcctccgctttggcgttgaacagcaaatcgcgtgtcaaaactcaaaagcggacagaattagaaacttataaaatctctctcgctgcctccacttcttcttcctcctcctcctcctcagatccagcaatccgcgataccaccattagtaccattcgaagcgccgccctctactcgccggagaggaggaagacggagcaaagggagcgcatcagataagcagaaggcatggggctccccggcgccgagccgccggcggccagcggcggcggcctccctggattcttcggcggcaagagcaagtacgtccgcatggacgacgtgctgccgcaggagcaggaggaggacggcgtcggcggcggaggcggaggcgtccgcgtccgccggagccacagcagcaggcgctacgtcttcgcctgctctgtcttcgcctccctcaactccgtcctcctcggctacggtaactaatctcctccgtttccacatgaatctctctcgcacgtatatgtgttcgtgttggctgaatcgatggagaatttcgatacgcgtgcttggatcttggcaagttcttggtgatcctgcacaaggagtaggaaatgttttggccaatcgcgttgactatttcttcttcattagtcttcggtctttgatggcgactctccagcttattccatgtctgttaccttgtggcgtttagtaggagttgttgagtagtctaaactacggttactagttaactggttagtaattagcaatgcagtttcttcataatcaagaatcagtagtaactagtatcacaatgttttgttcagatggatttctattcactactgatatcgaatagtccacttatttggaatcatcgcgatgctaatttcagtcaacggcagctagctcgtagtagctttttttttttcgacagcattttagcaacacactaaaaatttgactagaactaactttttcttttaagataatggaattgatttcattaagatgaaattgcacccgggcaaaaattaagtttaagataattacacacaaaatgcatatataattcaatttctgtgtggtaataaaccttttgttcccagatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatgaggatcttgagttattgaccaaatggatcaatgtgaacttggccatttttttaggtgggttttaacagtattactagatactggtgttgcggtgaatgcaaattgcaaaccaaattgttttgttttagagcactaataggaaagaaaatatctcatactcttttccaacttcagaatcctctgtagcatcaacgaatcatacagtgtaaatgttggtgccactgtgccagtcaatcagtcacagttggtaatgctagtaagctacacttgcacatccatgaaaccattacagtgaatgtaaatagattctgaactgaattattcaaattcattgaaaaagagcgaatttccagtgagttatatgatattttagcaaatagaagaaattttatgccaaatggaagtttgacatctaaccacatggtataagagcaattatctcgagtgaatattcagaacaaggtgatacctcaagtttaatactctgcaattcagcaattgtgcaagttcatgccaaaatgactgaccacagctccaaaatttcactctaagccttactactgaatacacaataacacaaccatgaaaatgtgggcagattcctgatacaaattttgacaatttgactttttgcaaaaactatttttacaaatgaaccgctgccaaaacttatttcaaatctgacccttttgctcaatgccaaatcatgtggcgctgaacttagacatctcagcgccacgttagctggcgctgaatgcggtgccacgacggatgggagactaagtcagcgtgccaacgtacattcagcgtcatgctatttggcgctgaggtgtctaaattcaacgctacacaatttggcgttgagcaaaagagtcagatttgaaataagttttggcaacgattcatttgtaaaaatagtttttgcaaagagtcaaattgtcaaaatttgtggattcctgactccaactcttttaagctgaacaggtagtcatcaggttaccaaacatataaaaacgcctcattagtcttaaacaaatggttccctccttgtttcttcctcctcctacagtctcctccttcctccagatccaattgctagtccttttcccattcacaagccacattcttggagcttgcaagaggagagaagaggatgagccaaccatagccagagcacagcacaagaaagacggtgagaatggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacggtgagcccctctcctgaatttgactgttcttgattcagatttggttgtattacacataatcaggggtttattttctgattaaagcaagatttgcagctagtaaaatatggggattgtatgtcatgttaatatgcttttagaagatgaagtgtttgaaaagttatcatcactgacagcccactctgcttcagattcagatgaaatgtaaattttgaccggtaatttggttcagatacttgttatggttgttaatctttatctgagtctctctctcagacagccattgacattgtttgtctcgtgaacaatcgatcaaactttcaaatggatgaaatatctttgcacaaattgtcaaatcctgtgttacatcgtggctgttaattttcagatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcg

SEQ ID NO: 78403 - DNA, 16294 bp, Oryza sativa
ttattgaaatgaaggaagtaacatatgaaaaattttctgcttcctattggccgcattttaactctgaactgacaaagaaacttgatgcgtccactgtcttcactgaaataatttctcatataaagggtggatatcaagcgaacaaaccttttggtggcaaacttgaaaggcttgattatttaaagctttctgagaagagattttcgtctctgaacagtcagatgagagaaagggtatatgatatttttcttgattacgaaagtatgaaatgcacagccagggaatttgacttgtcagattttgttaacagtcttcacagaaaccttctttctgagggctacaatggtgatattgtggattgtatttacatagatgaggtgcaggatcttacaatgacacagatagcactgctcaagtatgtctgcaggaacttcgaggagggctttgtttttgctggtgacacagcacagacgatagcaagaggcattgattttaggtttgaagatattcgctcactcttctatacctatttccttccagaaatggagccatgtggtcaagggattaatcatggaaaacagcttcgtatcacggatatgttccagcttacccaaaattttcgcacacactgtggaatccttcgtttggctcacagtatcatgagtcttctgtactactttttcccgtcatgtgttgacaaacttaacccagagattgggcttgtatatggagaagcacctgtgctgcttgaatctggtaatgatgagaacgcaattatgactatctttggagaaagcaagagtgaccctggtaacttgcaagggtttggtgccgaacaagttatattagttcgtgatgatgcaaccaagaaacaggttgttgaccttgttggtaaacaagctcttgttttgacaattgttgaatgtaagggccttgagttccaggtatgagccttaccacttaaatttcaattgtggttgttgataagcatttttcctgtttactgtaagaagccttttaggactgaattatgttgtattaaataaatttctaggatacttatttatttttaaaatatcattttgtgtaggacgtgctgctgtacaatttctttagctcatcacctttaagaaataaatggagagttgtgtatgactacatgaaaggcaaaaatgttatagaatcatctgaagagatgtcccactcttttttcgacaaaaacaagcattatcttctctgttcagagttgaagcagctctatgttgcaattacacgaactaggcaaaggctgtggatatgtgagaatgcagatgataactgccgaccgatgtttgactactggaagaagttgtgccttgttgaagttagagtacttgattcttcactcattgaagcaatgcaggcaggaagcagcacagaagaagattggaggcaacggggtaccagggttagtgttatactctccgtcaaaaattcaaggcatcatgtatttcaaaacgttgacatttacaacttttgtctaatactcgtttccatcatgttgggcatggtggataccagtacattagtccattcatcatgctatctgttttggcaaggttttagtcatgttgattgtttgccctttcttttagacaattgatatgtggacttatgttttttcagttttagctcttctttccagcaccgttgtgagctacttataacccatgcacattctttccttgtagctattcgctgaggggcaatatgaaatggctacgatgtgctttgaaaaggcaggtgatgcttacagagaaaagttagcaagagctgctggacttctagcaactgctgaccgtgtcatctctacaaactttgagatgggccagtcttcattgcaaaaagcttcagaaatctttgagtctattggcaagcatgagaaagctgctacttgctatatgaaattaggtgactacaaaaaagcaggtatgatgactgtcttaaattgttatatggttgtgtattacattttttatgtcttcacctttccatcttgttttaacaaatggcaagtttctcagaaaggttttccccaaaagtaaatgattcttcctcagcgaatttctgcttccagattttttttgtaacatttttttcctggtagtatcatactccctccattccaaattgatctacatatttcataggtacaccaagaccaagaaaagctaataactctctcatactatatttactatagcaacaaactcgatgcatgttccatccccactatttcctagccaatagcaaatcaagatattgcatgtgggttataaatacttgtgtgcatggatgcatgcatcaatgtccatttactccaatgcacaaataacgaatagacttaataaatgaatacaaatatgatgatcatttaggaataacctcaaaaaaactaaatgtagatcaatttggaatggagggagtatttgcctatattgggttttcacacaagtattaccacataactttcataacattttcaaaacatctaatgtggctttaacttctatcaggaatggtttatatggaaaaatgtggtaattccaggctaaaggatgctggggactgttttgaactgagtgcctgctggtcactggcagctgacgcatactttagagctaaatgttacgccaagtgtttgtccatgtgttctaaaggaaaactgttccaaaagggcctacttctcttgcaacagttggaggaacatttgcttgaaaattccagcctcgtcaaggtggctgctattagaaacacatttctagaagattgtgcgctacactattttgagtgtggagacataaagcacatgatgccatttgttaagtctttcagctctatggatcacattcgtgtattcttaaattctaagaatcttgtggatgaactgctgagtgtagagatggatatgggtaattttgttgaagctgctgggatagcaaagcatacaggaaacatcttattggaggccgatctgcttgaaaaggcaggttttcttgaaaatgctacacaacttatcctccttcaattatttgtgaattctctctgggcttcgcacagtacaggatggcctccaaaaaggtttgcggagaaggagcaattgcttgcaaaagccaaagaaatgtcaaggaatgtatcggagtcattctactgccttgtttgctcagaagcagatgccctttcagatgaacataagtctcttgccagcataacttataacttgattgagggcaataaatgtggaaacttgttagtcgaacttatagcttctcgcttgattcttgatgttcatcttcaggctgaagcctctggatactgttttgaatcagagccagggtctcatgatggacggcattgcaaagatatgctagttcttaatcagatatcacttgaaactctagtatacgattggaattactggagttcaattatagtcaaagtgctcaggcatcttgatcaccctaaggacgcagaatcaaatgatttggcagcaatctgtgaagatctttgtgctaaatactttggatggagaaaagatggtgattatgaccggtatgtggtacttaacacagactctagctggctgtctaacacaggaagaaattatttgcagcaagatggcaggagatgttggctggatactctccattgtcattcttgtgctaaggatttttggatcaatgaactttattctgttggtttgagtgtactcaagaagttggaatctattgtccaaattttgccaacatcatcatgctccctgggtagaactatactcgttatatacgaaattgcaaagtttctaaaggaatcagagtttggcatgccaaaaaataccataaagtactactctattctttgtgaacgtcgcttcttcgagttggttttccttgtctggagggatgaaacaccaaagagcctcttgtgtatacttgactcagcgactacatataacctgctctctgattccatctgttcatatcttggttcaagaaacaataaaatgactcatagtcaagttgggagaataactatgcttcttctccatgcagcaaggttggatgattcgttgatttcacagcttgtggaatatctagacagagggtctgagtgggcaactttttttctatcgttgaagaagtatcttgacaatggtgttagcagagacatcttactcttggacttcaaatttgctcttgattgcacttataaggcaaactggagggctgaacactacatatccccgatatgctatgtagatctcattgagtgccttggctttttggctacaacgcatcttgtactgaatgactatatgttttgcacaaaatctctgttggccaaaatgatgaagtgtcgcactaccaagggttactttgagacatgtatggctcctagcacagatatcgatctgggctatgcaggtcattcagcacggtgtttcatatacctgtcagttaaggatcttttgggaagcaagcgtatgattgtagagtgggttcagaacacctctactccaactagttcttatgttccaatccttctgagattagttatcacactttatcttgtgactgtaaaccaagacgatggagatttgtatgaggttacagctttcctcgagaaaaatcatgtttttacggatttacctcctgagttctctgaaaagattagaaatgctttgaggatgaagtctcgcacagtgaagaacttcatgagggtatttgctgatgcccttgcagcaataggaactcgcatggtagttatgggtgatattaagaaggcaatggcacataaatgccagccagacttgaatgctgatatgattagcagtgtggatttgagtgatgctaagaaggtaatggcacttctttcaacagagaagtcaagtagtttaaagcaggaacctcagctgccagagatcaaatctgtttgtaacaaaatttgcaacgctacttctggtcacttccctttgacaagtgtaggaggtagccagaagagtacaagtaattttaatttgagtgatgtggatcatcctttgttggagaagtttgaggcgtttcaagtcaatatgcctcaaaaggtgagttgataatttggtaaattcgtttggtcatcttcccttttgttcaattgtttaactacggacagcgtttttctgcagaaaaatggaagcttaatttctcaaattcttagaagtcccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctattatgtctctttttcaaagttagaacttgttaaaagtttgataaagtttatagaaaagtgtaacaacatttataatactaaattagttttattaaaccgatcattgaatgtgttttgatagtttttgttttatgttaaaagtattgatatattttcatacaaacttgatcaaagtttgaaaagaagttaaaggaggttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtgggctccccgtaaattctcccccgaaaccgcccgagatggcggctgcggcggcgcggctgttggagagggcgacgagaaccgcggcatcctgctcctccgctcttctccgcagtcctctggattctttctccggacgcttcccaagcttccggtcgcccctcctacggccggctccggcgccgtcgaccgtcttcccccggggcctctccgacacggccttcgacgcgcaggcgctggacacccgcgtacccgccaccgtcatcaccggcttcctcggctccggcaaggtgaccgctgctgtccttccccttgtgcagtcttgctagctttttttagataatggaagctttatttagactcagttaattacatcaagatgatacaatcaaactgagtcacccccggcctctgcataaaatgcacacagccaaaaagcgctggagccatatagacagtgtacttgagaggcgcttgcggcgatccaaacttgacggggtaatttgaactagaatccaagaacttgatatatctgtaaaaatcaaattaaaaccagtctggatttttgcactatatggggcttgcttccatggttccggagtgttaaatagtaacatacatgatgatacagtttataggaaacttatgcttgtgtggtatagttggctaattgtttcgaatttaccttttacagacaaccctcctgaatcacattttaacttcacagcatgggaagagaatcgctgtaattgagaacgaggtaattctaagcagccatatatcttgcggacttgtcaaaattgcattgttcagttatgtgcaacagaatcttcagatcaggctgaccattgtttacttgatattctgttttccaatatatccatatttacattcaattagcttggtgactagtgaccacatactgactcagttatttcttagtttggtgaggtggacattgatagctcactcgttgcaagtcattcatcagttgccgaggacattgtaatggtgaacaatggttgcttgtgttgtactgtccgaggggatcttgtaaagatgcttctgaagttggtaaagcaaaagggggacaagtttgatcatattgttattgaaacaacaggtgggcctcactggattgtattgctaaagtatggaattggaaatgcctccttttcttgaaggtccatgatttttcaatgcctgacagagtcaatgccattaacccaggtcttgcaaagcctggtcctgtcattgagacattctgttctgatgaactggtctctagatatgtgaagcttgatggtgtggttactatggttgattgtaagcatgccatgaaacatttgaatgaagtaaaggccaggtgggttgtaaatgaggctgtagagcaagttgcttatgcagacaggattatattgaacaaggtatttactgcctactaatacatgactcagtagtcagtactataagttcttaaaaaaaggaatacaattttatcttttctgcattcttccggcttaaaaaaaaaacttctcaaaaagtttcttgttttactaatgttccgtaacatacatttctgcagactgatttggttgataatgcagaactggaggtgttaattaacaaaattaaggtaaattgatagagcggattccttaagaaacaaaaatataagctgatggatttttgtacaagctgattcctttttgtgcagctcataaatgggatggcacagatgagaaaaacaaagtttggtgatgttgacatggattttgtgctaggaattgggggctatgatcttgataggttggttatgcatgggaacattttttggagggtattgaagaaaaaaattggttttgaccctgagttagatatatatcttgcttctctaatttgagataggtaatgtacaggattgagtctgaagtccagttgcatgaaagaaaagagacaggtcattgccatgctggagaagaacatggtaaagtttgctttcatatccttgatcaccatgccatggttcccaatcatattagaatcatgtgaattatacctaggagtctaggacaccatgcaagagttaatggcaataaaacattcttattaagaaatgacggtaatacctgaaaaaatgagatagcagccagatccttaccacagatagtctgtgtccatgttttcttttacctgcttctactgtcaattcagtcagattactatttagtttgtactctactgatttgtagggcatcagcaccatcatggacatgtccatgattcagctgtctcaagtgttagcattgtttcggagggagtacttgatcttgatgaggtaaaccaaagcacttggaacatctgtttaaaatatgattattcagcagggatttttgttctttgctgctagaagtatactcagcaaatcaactgatctatcactactgtctttatcaggtgaatgactggcttgagagactcgttgaagagaaaggggaggatctttatagattgaagggtgtaatctccgtaaatgagtcaactggacgtttcgtattccaggttagctgatctaatagcttttgtattccaacattggtgtgatctatcactacctttgtttatccattgttggtacagagagctcttgttttaatgcttttgcaattcaatctactctaattctgtcttcttccattactaaccctttcttaaaatctaaaacttacagggtgtgcactctatgttggagggatgcccagctaaaccatgggagccggatgagaaaagattcaacaaattagtatttattggaaggaatttggatgaagctgcactgcgaaaagccttcaaaggctgcttactgtgaacactctgatcacgtattgagtcctgggaagccatgcatatatcaaactgtacaagatgtttgccttgtgctcgctgataaaatgcttactgtttgtcaccaacgtattaggccaatctaaatgtgttgcatgtcatacgtgggtggtgggtcatggtttacgtttatttgtggtatcctcatctgtgccaggatcatacctgtgtatcatggacaatcagacaacagagtaaacttttttaagggaaaaccaagagttcatgtcccaatggtctgaatttctgaatgcgtggttctgcctcttgattgaatctcgagcataagtttatcttatcgagattgctctggccggaagatcgatttgcttcgatgaacatcggatccgatgcaaacagtgagctgacggttgattagtgaaagaacatcaccttacccaataagataagggttaaaattgataatcggtttcatgatctgctattagcccaatcacaattttgatctagtagcactagatgatgatgatcccagctaattttgctactgctaatactagtgcgattgtgtgtgaactagtgctaaagttgctaaccctaagttgcagctgccacatcccaacggctattttttttctcggacacactgctagccgttgcggccgccgttccgtataaatattttgacggatctaccagtaaccccacaaggatactactccgcgaggcacctctctctctctctctgtgagtttcgtgcgatctcgcgagcgaatccggcgcgcgacccaggctctccaagatccccgcgctctcctcttcggtttactgatctgaaatctctgcgtcgaatcacctgtttgttggcttgaattgcttgtccgcgtcgttgatttcgttgtggtttcttgatcttcggtggaatttctttgcgttggattgtctccacccctgttggtttcttgtcgattcccgatttgagttgttcgttggcgtgaaaaggattctttttttcccctgagatttcttgatttttggtgaaatttctttggtgttgaaatatcatcgccttttggtttcttatcgattccgtcgttccgattggagttgttcgtcggcgtgaatttttttttcctgattcatcgttgcttgttgattggggatcgaatttttcgtctacgatccatcttattcgtggtagcagtatctcttcttgttgctgcgctgtgccctgtttatttgtttctgcttgttgcttctgacccatggatgcaggttcgcactcgatctcatcggagaagagcagccggtacgtggcgccgcgacagccactccaggaggccggatccagaccgtacatgccatcgctgagcacggcgtcccgcaacccgtcagccaagtgctacgtgagttctctgttctaagcgtcgccaaggaacgcacacaagctgttcgacgaaatgactgaacgggtattctccttgtttggcagggtgacaggtttattccggacaggtcggcgatggacatggacatggcgcactacctgctgacggagccgaggaaggacaaggagaacgcggcggcgtccccggccaaggaggcgtaccggaagctgctggccgagaagatcctcaacaaccgcaccaggattctctccttccgcaacaagccgccagagcccgagagcatcctcacggagctccgtgctgatgcggcttccatccaagccaagccggcgaagcagcgccgatacattcctcaggtatgcacacctggttctagtctagtgttcattgctgccatttagctgtaactgtctagtgcctttggattatggttggttgctgattgcctgattggatgtgcgctggttgaaaatcttgtgcagtctgccgagaggactctggatgctccagagcttgttgatgattactacctcaacctactggactggggaagcagcaatgtgctatccattgcgctgggcaactcggtgtacctctgggatgccacgaacagttcaacttctgagcttgttaccgtcgatgaggacaatggccctgtcaccagcgtaagctgggctcctgatggccggcacatcgccgttggtctcaactcctccgatgtccagctctgggacaccagctcaaaccgactggttagtacttagtacctcttggtctgtgtttgaatgttttcattagcattgcatgtgcagttgtgcttagttcctgattgtgattgattctgcagctgaggacgatgcgaggcgtgcacgattcgagggtcggttcgctggcatggaacaacaacatcctcacaactggtggaatggatggcaagattgtgaacaatgatgtgaggatcaggaaccatgttgtgcagacataccaggggcatcagcaggaggtgtgtggcctcaagtggtcaggatcagggcagcagcttgccagtggtggcaatgacaacctcctgcacatatgggatgtgtccatggcatcctctatgccgtctgctggccgcacccagtggttacacaggcttgaggatcacttggctgctgtgaaggctctcgcgtggtgcccattccagagcaacctgctggcatctggtggtggtgggagtgaccggtgcatcaagttctggaacacacataccggcgcatgcctcaactcgatcgacactgggtcacaagtgtgctcgctggtctggaacaagaatgagagagagctgctaagctcacatggattcgctcagaatcagctcactttgtggaagtacccgtcaatggttaagatggctgaactcactggccatacctctcgtgtccttttcacggctcaggttatcttttgctccttgtacctgccgtttaaattgacaaatattgctctgaacagattgctgattacttgtcttgtggtaatcttgcagagccctgatggtctcacagtagcatctgctgcagcagatgagaccctgagattctggaacgtatttggggctcctgaagcacccaagactgcaaccaagggttcccacactgggatgttcaacaattccaaccacattcacatccgttgaggaacacagtaagtactaccttcatctgtatttccctagcgcttctacacattacacagtatcaatgtgatgtccaaaagctgcatgcatatctattaactacaagtagctcattgtgctgttttgctctatgcatctttgcagatacccttggttctgtgatccagtcataacttacaaagaagcagacttggtgtgaagggtcatttgcaggagagatcatcttacattattagcagaagagttagattttgacatgttgtatataaggttttgtgctatgttgataacaattttatgtacatcaagaccggtttgatgtattgattggcgtagaaaaaatgtaaaaaaattgcttttctgccagtaatatacatttttatatacttgccaggcttttcttgtagtaagttcctctcgttgtgtagtaacttgtaatttgattgattttactctcgagccaattgagatgtctggtaaccaggaaattgctgagatgagtcttcctcttactccattggattgctatgatattttacttaatgtcattattagtttaacaagcttctttttcagcatgactgttgtgcttctggggaacagcaaatttgtggtgctgttgggctgttttaacaagtccattcagtatattttaattgcccccattttaattatagcatgcctttacagtttacataaactatttataatattcacctaagcaaccagatttacacacacacacacaaaaaaattagatgatagtttcgggttacctaccattcattttgctgctgtgttttaaaggttgatggatttggattgatcatggtcatttgtacttttgtagtctttatctttagtgcattaacccaacgtcccaacccatgatagagtgcttccgtctttcggcgcaacactgtccatcagatcctgccagcttgatcctggccgtccaacgatgtcatactagtagtacatggtatactagcctagccttcttcaccaaccggccatcgcccaccggcccacgagcaccatctctcctctctgctccgcgagtggccttttgcccacctaagccgcctccccatcctctgcttgctccggcgggcggcgagcgccccgccggaccgacgacgacctcgccgtcgagctggtggccgctcaacctctagcgctcgcagggatcccgggaagcctccctcggccgcgtcaccaccggcatctggtgctttccgctcccaccacagtgtgctgctctcgtcagttgccaccgcccgactcggcgctccggagcccagatcttggttccggaggatcctctccggcgatggatttcgtgaaggttttcgatcaggccgtgcgggagatgtaagttgtgggccgagcccgagatctcgccattgctgttccgatttctcgaggatgtggcgtgttctgagttggatccgtgagatcctgatccgttttctgtgtgtgtgttgctttgcagaaagagggaggtcaatttgaaggtgctcaaggttccagagctcgaacagaaggtgcgattgcgatatcacctttatcttaactctgtgatttttgcaatagagttgtaacagctggattggttcgtatgatgggtgtgggagcttgggttttgcataatcatgtgcttttgatatatttgttgtctgaccccattacacgctgttagaattcatgtaatcatgtcatagtagtactttaaggaaatgaatttcaggagtaccaaaattaagtctgcaatgtgtttactatttaggacttgaggtaaaccagagatctcaagtgctttcaattgaagtatctgtattgccaaatttgtgccgttgaaggctactgtctggagctgatgcgtggatatattgagttcattgtacattttgtagcacgccttgatagttgatagtcatgttgctttgacaatcatgtatcttgtccgtggtgtagatcatggttgtaagggttttcgtctgtaatagtacattcacccttatggtgcatgtttggttattctactgtgggagtatattacagatatgtatatttcttattaacttccacagcaaaaaaatatagatgtatatttttgttcttagctttgaattttaccttcgattctttttcttatgtagtaaacaatatttctttcctttaaaatttcaggtacttgatgcaacaagcgatgaaccttggggccctcatggtactactctttcagagctatcacatgccaccaagaagttgtaagttacaatctcttattaactaggtgaaaccccgcgcgttgctgcgggattttagtatgatagcaataagtagaaataatgtgtaagatagctagacgacataagcttacataatttgatatggtttatgataatttaaatagtatttaaaatgatggagaggtatatttaaatattatgtgaattatgtgagatgatgatttaacatatttgcattttaaaagtcaaaaaattaataaattatagaattatagataatatagcatgcttgcatgatgtttaagatgtaataattattagtggatgatgtgacatctttgtatgttgagctttaggatttagtgggttgtaactttatagtaagataggataggatatgtattttccccttgttttttatgctgaaatggtgctttcaaattttgtagcgctgaatgtcagatggtaatgagtgtcctctggactaggctgtctgagcgaggctcgaaatggcgtcacgtgtataaggtttaactcttgaccattttgtattttctttgtcaagtactggggctttgtactatgagttctacattggtcactatgccaataccaatggtcaaagtgaacagcaaaccttggtatatgcatggttttgtatcagcaatgtaactaaggcatataactattaatgtccaggctttgacaattattgagtacttaatagccaatggttctgagcgggcagttgatgacattcttgatcactattcaaagatctcggtatgtcttgtttatgcttttgtttctgatatatagtatttcttttctcttttttgaagtttatgtcattaaaaactttgttctctgtgctatatttgtcaaggttctttcaagttttgaatatgtggaacctaatggaaaagatgctggaataaatgtgagaaagaaagtcgaaactatattgggactcataaatgacaaggagaaaataaagtctgtaagagagaaagccgccagtaatcgtgacaagtgagttcttaaggaaaagaataagttgtgttatactatcttttttctggctgtttattcatcctgtacaactccaattattaacatatgtttgttgtggatgaaggtatgttgggctatcatcgacagggataacatataagtcaagctctgcttcatttggtagcaactatagttctggtgaacgttatgggagttttagtggtacaagggaaggtgattcatacggtgacagttatagggataaagaacctgttaaatcctctccaagttatactggcagccagaaatctggcagcaggataaaaaaggatgtgaa

SEQ ID NO: 78404 - DNA, 1832 bp, Oryza sativa
  unsure (1)..(1832): unsure at all n locations
gacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaacatggtgctgagctcggagatctacccgctgcggctgcgcgcgcaggcggtggcgctcggcttcgccgtgaacaggctgaccagcggcgcggtggccatgtcgttcctgtccatctgcggcgccgtgtccgtcgcgggtgccttcgccgcgttcgccgccatctcggcgctgtccgtggtgttcgtccacgtgttcgtgccggagatgagcggcaagtcctggagcagatcgagtccctgttcggcgccggcgccggcgccggcgaggtggagctcggtgacgcggaacatctggtacaagggaaagaaatgagctgataagtagcatgccaacgaagtagcatctcactcttatgagcttcttggtcatagttgtgattactgattactaagcagtaaacacgggatatcaacttgcaaactctgccatgactcttcaccacgcaccccgcggttcggcggttaccatggtaaccacgaaaacatgataaccacacggtttggtaaaacctgcttacgatacgtatgagtgtattgggcgtagataacagcaaggagaaaagctcgttctcttttcttagacgccaataaatgaaattacgaacggattacgcaaacgaagggagcagcctggcacaacagacagtacactacacagaggaagcagcatctgttccacttccacaccagaaaatgggcgtgcgctcgtttctttgcgtgcgaacattttccgacggcccaccagcaaaatttttcaaggtcgcaccacgaatcggattggggcattgggccatttttgcttgctgcacgagacgtttttctgccagttttattgagtttttctatagtgattttggataaatttaaaacacaaatagaaatctgactagtactacttagattttttttaacacaaactttaggcataaacaaagatagagttcgatatgatttcttagttaatgaacaccacttaaagaccatatttctacaaaagactcagattcttcctattgcatgttcgcatttgaatgcccccaatgtaatccagcacttcccgagtaccttatcatcctttccaacaacatacctaggtctgccccttcatctgcgcaagtcgaggaaaatcgattacgtcccactgcttgataaaattggatctaaaatcccgggttggaaggggagatattactcatcagttggaagggagactctcgttaagtcagtgttcacggcaatgccggtgcactatctcactgccctgccggccccaaagtgggtgatcaaaatgattgacaaaatgagaaggactttcctctggaagggagaggaaccggagaacgtcaaaccggggacgagtctagtaaactggcagaccgtgtgcatgccgagagatttgggaggactggggatccttgatttggaaagattttcattggctttgtgactgnnnnnnnnnnnnnnnnnnnnnnnngatcacaacaggccttggaatgagatggaactacctcgcaacgcaaaagatgtacaactattctaggcttgcactgaaattgttattggaaacgaaaagaaaatcctattctggaaagacaactggctacaaggaa

SEQ ID NO: 78405 - DNA, 3886 bp, Oryza sativa
aaacgacaagtattatcagctcggagggagtagtaaatttcaccttaattaaactatataacaataataaaattaaaatagccttcacccgttgtaacacacggacatcttttccagtaaaaagaaaaaaagggaaaaataattctccgtattgggcctaacgtatatgaggcccatgctctctagtagcacctaaaattaagcccaaaagggaccgatcagttctattacgaacggattagcgaccattaattaagagagcgcgtgacggattaagcgaagcgaaccacgcaaataatactacacacgcgcgtcacggacaccacccagtcccctccccacaccacgcgccgcccaaaacctccgccgcgtttcgcaccaccaccaccgccgccgaccatggcctccttcttcgccgacgacggcgccgacgagctcccccgcaccgcctcccaccccttcgacgccgacgacgacgccgcgcccgatgcatcaggaggcgccgccgccgacgacaccggatacggcggctacgcctccttcgtcgacggcggcgtagaggatgtggaggaggaggaggaggagatcgccgtggagtccgagggggtcccgatcggccacgtctccggagggttctcgccctcgcccttctcccccgacccggagctggacggcggcgacggccctatcctcccgccgccggcccagatgggggcggaggaggggatcctcctccgcgagtggcgcaggtgagcaccgcatctgatctgtccgggcctttgccgtttcggctactgcttgcttgctttcgctggtgctagggttccgacgcatcgagcgagatctaacgcttagatctgatatttcgcctaattttcagctaggtggggcggaatagagtttgtagtgaggctgtattatcgtattatatgtcgattttagttaggatgaaacttgaacttgttgtttaggaattgcagtgattgattaggctgaggcttcaactggttctgaattcttagctagtggtactgaatttagttagtgcaattgaatctggtttggcaggagctgttgttaaatgcctttgcttgtgaggaaagtttgttagctctggtactggtatatgtacaaaataatcgctagttagcttctactcatagaacaacaagatgcttgatcagtgttgcacacactccaaagggaattgatgtctttgcatgtgcattaaaaggctcatgtttcttgtttagtgaagttaaaacactttaagtacttgaaccattcttctctatcatcatggtgtggaaatgagcataaggccaatctcattttgcaattcacccatggtctgttacatgtttcaactttcaagataagcctcaggcttaagcaataatgcagtacacgtaacagttttctgagttaatgagcaaatgcttagtttatcttgagctatcttacatgtttcttggtgaatggtgatattaatcctaggtcttaccatgatgatggttcgcacccttactccttttgatgcttgtcttaggatgctttaattgatcttaaaatcagcttgatttgccagaacataaatcaccatttttagtgctatgccacatgggcatggaacgtgctcggcaaaggtgtgtgccaacaggagcaaactggctacttgtttgtgcttctgaaatttgcattttgtctgtcatgatcttatattctgcacttgcacgctcttctgcacctgtcaaatttttagtagtttcatgtatatccattctcagctcaaattttgtaaggtggtaatgttagcagttttactaccagtggtatgtgtttttgtgcctaatttatcctgtgcttggtataatctggtcattacaattgcaacagtatattttgcattagtatatagcgcaggtgagccacatctgatctgtttcggctatgccatttctgctattgtttgtttgcttccgtgggagctagggttccaccccttcaagcgagatccaacgcttagatctgctatcttccctaattttcagctagggagggcgtcatacagttgtagtgaaattgtcgttaaggaaatggcaagtgatcgattagtttgaaggtacaaccaattctgatctggttctcatgcccctgcagtatcgttcttcaagagctgctgtttaactgcctttgcttgtgaggaaagttttctagctctggtatacgtacaaaataatcattacttaacttttaccgatggaacaacaaggtgcttgattcattatgcgcacactccaaaggggggctgatgtctttccatgtgcaataaaaggcttatgttgatttgtttagtgaagaaaacctaagtacatgcaccgatttcttttttcagcctggcatggaaattagtgtgaggccagtgtcattttacaatacatgtatggtctattacatgtttcaactctcaagataagcctaaagcttaagcagcactgcagtaggctaacagttttgtgatttatgatcacaggcttgtaaggctagtttgtcttgagctacattatctgttttcttccagttggatatcttggtgaatcctaatatttatccagaacttactcctttggatatttatgtcctctaatgtatcagatgctttatgtgatcttaaaatgagtttgtagtgccagaacataagtcactgcttttagcgctatggttggccaaaggtgtatgccagcatgagcaagctgtctacttgtttgtgcttctgtaatgagcactttgtctggcatgatcttatattctgcacttgcacactcttctgcaccagcctatccagattttttgttagtttctcgtatatccattctcagctcaaaagtttgtaaggtggtaattagcaattttactaccagtggaatcgtgttatgcctaatttatcctgtgcttggtatgatctgaacattgtaatcacaatattatacatcttgctataatgtttttgctttggctgttctctagtaactgttttccttatcatgtagaattatattatgttcatgatctatcttttgaacagcatcactattgtttcaggcaaaatgctatagttcttgaggaaaaagagcggaaggagaaggagctacgggcccagatacttgctgaagccgaagagtttaagaaggctttctatgagaagaggatacagaactgtgagacaaacaaggtccataacagagaaagagagaaggtatggggctcagagcaacttctttagttattatatgtcaatgttcatagcatgtccattaagttctcatgagtgacaacttattgtgtgctgcagattttcgtagctggccaggagaaattccatgccgaagcagacaagcagtactggaagtcgatatcggagctcatcccacatgaaatagctaccattgagaagcggggaaagaaggacaaggacaagaagccatccatcacagtcattcagggccctaagcctggcaagccgacagacctctcacgaatgcgccagatcttagtgaagctgaagcacgctcctccaccgcacatgatgcaacctccaccagcgtctgctgctaaagacggcgcaaaggatggtgctaaagacggcacaccagccccagcaaatggaaccaagaagcctgcagagagcaaagagaaacctgccaacggatcgcctgcggaagcagagaaggagcagcctgcagcatcggagtaacttatggtagctctacaggaacgcccgaaccttgactgcagatatggaaatgcattttatttctaatccctggatctgtctatcctgtatttatctttttatggagatttgcgtcaggatggctatgtatca

SEQ ID NO: 78406 - DNA, 507 bp, Oryza sativa
tttcaaacaacacaattaaattgaaatttgatttttttttataatatcacactgatatgtgcatatacgtacactagtgtgagtgcatggtgactcactagaatgctcaatcagtccatctgttgcggctagtagcagtagcagttcatccatcctacactcaatatccaatgatatacatgcatatatggatgcatataatcatatatgagctggtcaatattaagatatattatatccagtgcatacacgaaactgcatgaatatatgcaaggagatatagtagtagctccttctagatcagcatcaaatctcagttggccactggcggcagatggctgttcacacttaacaggaaccaaaccacgtctcatcgatatgcagaaaaatccatgcatacgtgcatccatgcaggtgaccaatactatagcagggcgatggccggattagagcagaatcacccgcaacaagacggcggcggcgtgcaagcaatcgcgcgggaaggag

SEQ ID NO: 78407 - DNA, 12078 bp, Oryza sativa
atatatcctgattattataactatttggctgaagtgaacaagtatgcaggttttttttttccttttatcgtgaaaagtagtcagtgttatatgatacattttccaaacatgaagataatacaattgtagatgtagttgtgatccttaattctttcaatctctatctacaggtgcagctaatacaaacaccagtggcgtggatctttttgccccaaacttattggatgatttcatcgatgtgcctgcagcagcaactcatgaaacaaacgactctgcagacgctcaggttgatctgtttgctgatgcagatttccaatcagcaataccaagtacagaaacagctgcgggttcagatgtccaggtttgtttatccatgagactacttgaatacttgatacattttttttgcaggcctgatgaatatagagaaaaatgtttatcctagtcctccaatctgggatatgaaatgtgctgaaaacaattgagggtgtttctccttaaatatttagttgtgcttcattaatcttagaaatcatatagttcttcaatccattgatcatgacacagggtgttatatcaaaatgatactgcagggcaatgtagacctttttgcggaacagccagccttcacagcagcctttccaccacagacagggtttattccaccaccaagttctgggacatctgaagcaaatacttccacgtctaagaacacaactcctgaaccttttgatccttttggtgctattcctataaacagctttgatggatctgatccatttggtgccttcaactccgatgttggatcatctagtataccaccacccacgcagagttctgttggaaatatcagcacaccaagtcagaaccctcaagcagcatctgactttggtggctttgtgtcgagcactgtagaaacagcagctaaggacccctttgatttttcaagtagcaatcttgggaaaacacctttggcagatccaaaggctgatgcatccgattttggtgcctttgtatcgcacagtgaggaagtagccaaggatccttttgatctttctttgagtaccagctctggaaggacaaaccaagcacctctggcggctcccaagtcagataccaagaaagaaaattttcaggtcaagtctggcatatgggctgactcattgagccgtggactgattgatctgaacataactggacgtaagttcttccttttctccttgcccttttgacaaggatatcaccttgccatatcttgatggcagaattattaatgatttctcattgttcttcgcaaattacagcaaagaaggtgaacttagccgacgttgggattgtcggtggcctcgatgacgggtctgatgataaagctctgccctcatggaccatgggtgcaggaggttccagcctaggaatgtccggaattccttcatctacacaaagtggtggcattgagagcttagctaactacaacaagtaccagtttggctttaaatgagctttcatgtgaggctttctagtatatgccggttattgtcggaatgtcggcttgtgccttatttattttttgttgattctattctcccctcttttgatgcttacattcctttacaatcgcctccaaggatcgtgatcttggttcgtcttgtcgcgcttgtattgtatttattggatttgcggatgagagactcctacctatatcacaccctgattcaatttaactgtactgttatttcacaatcgtgttaatcctatggctcacctctatattgcgatttatgattcggtacagcaacatgggatcgttccttctgccgcttccttgaactcattgaaatgaattgatgcttgtgcatgtttgggtcagagtgggggatagagagaggtccaacctgacctgcaactttcaggtttcagtactacagtacaactttacggacattcaggaagggaaaagtacaccgaagatccctcaacttgtcatcgagttacaaaatcgtcccccaaccgcaaaaccagatattagagatttttcaactaacaaaaccgttcgcttgagatcctccggttgttttggacccggttttgtatgacgtgatgggtgagtcaccgtgggccccacgtgtgaggctgccacataatctccctccccctccccctctctctcactcttctctctctgccacatctctctctctctcttctctcctctcactcgctgcagggcgggcgcggccaccggggggcgccggcgaggtgggcggtggcggcgacgggggtggggatgagaacggcgggggaaggggaggggagcgagtcaagggcggtggggaagacctcgtcggcggcgaggcggcgaaggggcgacggcgaggataggagggcgtcggcggcccccacacccgcaaccacccagcacgcgccgccgatgcccggcagtccctcgcgcgccgccgttgcggacgacgacgacgaactctcgcgcctcctctccctggccgaggccgacctcgacgccggccacctctgcgccgcgccgcccgcctcgacccggactcctctcgacccgccgcggcggaggggcgacggcgaggagaggagggccggcgccgcgggcgcgtccggcggccatcaggtgaggagggccggcgtggcgggcgcggtcggcggccgacaggagggagcgcggcggagaggagggccggcgcgacggtcggcggccgacgagggaggagcacagctgagaggacgcctctctgctcccgccgcgcccggagccgtcgcgacgatgagggcgagtggcgtggagttgttggcgccgccgctccctatccgccgccgcttctcggccaccgcgcttgcccgccgacgccgccgctccgcttgctctggccgcccctctggtgcggcggcggctccttcggggacgaggccggcaggttcagatcgaacggcagcagcgagcaacgcggggcgggggccttgtcgctggcgcccgaggcgctgtcctcgtagagcacggaggaacaggagctgcgatggggagagcgaggagaccgccgtcgtcatccacggcagcgggtggagaggcgacggagaccggcggagtgggaggcggcgcggccgcagaagaacgaggcgaaggcggacggcgccgatagggagcgtgacgggagagcgaggagcccgccgccatggctacacatctgtcgcccgccccgtcgacggctcgggtgacggcgtgggggccggccctcctactcccacgtcgtcgctgccgctgcgtcgcccgtcgcccatcgccggccgcccgacgtcctcctctcccgcctcgccccgccagccggcttgccgagacagctcgagaacggcgagggcggcgtgaagatggcgcgggggtcgttggctgcgaccccggcgcggcggcctgctcacgcgtcacagctgccgtcgctgcctcgtcggccgccgccctcagccccatcacgccgctcgtggccgaccccttcaaccggtcaccggcgtcggcgtcaacggaggaggaggccgcgaccatcacactcgcgcagagaagagaagagtgagagagagagaggaggaggaagggagagatgacgtggcagcctgacacgtgggatctacgtggggtccacgctgactcacgcaccacgtcagacaaaactaggtagaaaaccaccagagtacctcaagcgaaacggaaggaacctccggggaacgattttgtaactcgatgacaagttgagggacctttggtgtacttttcccattcaggaatgcacttacgggagaagccaaactggttgttcgcaagagccgcttctccctggttgttcggaagagcctttcttgggggccggcccattagtatttgtgtgaaatactttcttggggccgatatagtgaaaatggtactacatttattctaaaatgtaatagcttttagctgcggatctaaatatgtgtttattcaaattcatagataagcttactatattttagaaccaatgatgtaggtaataaccgtgtcatctttagaggcatgacgtaaaatcactactagaaaacaacacaaaagggacggcactatagttgtcagaaatgcaagaaccaatacttataacgtttttcccgcccgagcgcgcacccggcgggcgccatctttgagaactgacacctatgcggcgacataggtgctggtctttaatagaaatcgatactaatatcattagtgtttttttaagagaaccgatatctataatatattataggtgctagttttataatgagccagtacccataaaataagagccgagccggtgtccttatccacccacctgcgcacccacgcctacccatcctttctctcgacagttacgcctctccatccttatctcctcccctttgtcatctctctctctctccctctctctctctttcagctcaactccaacctccacccctcgccaagctccttcctgaccatgcccacctccttctcctcctcctccaccatccatcacggccataatcacctcctccatcagatccaacagcatggatcacgataaccactagagcggccagatctagcggcggcggtggaggagggtagatccccaaagccctcctctcctctttggtcggcgtccctggagcccaaggtgtcaggaatgtgtcagagtccgccagcggggagtcaagtatgagtaatccttatcgtgcccaagtaggctctgcttcacttttcttatctagaacaccttccgtatacaatattttattttgtataagacttggaacatgatgggctctatcaagcctaacacaaaagtattaggtatgtcttatccgtaacactgataaatattgtagcattacttatgataaacaagtccatatattacccaggattgtatctaaaaattagagaagtagagaacctggtgcgaaatgtatttggaccctaaaatttgatagccaaatcccatgatcctgttatcataatcaatgtgatatgacttgtagaacgtgattatatctagttctagtcgatttaactttaggtattaggcatgttgtggccttttacttttagttctgaatcttagatcttagttctgacattctggttctggctttatcattctagttattatatcgctaactaagtatacttagtacttcatataattaaaatttgagtcccctaactttaggggccctaaacaattgtacactttgcacatgccactgtacgatcctgattttactaattactctcttttgatgtaaaaaagtttttagctacgaatttagacatatgctacatccaagcttataactaaaagtccttttcttatatagtgagtactaagggcatgcccaatgcaggatgcaccccaccatccacacgagcaaaagtgaccaagcacctagctagagatatgcctcacacagtgcaagctatactcctatggaatttttatgtttcagcacctgtcagtctgtcacattttgcatttaaacccttggattattattatttgcatatacatccaatatttgcagtataccccctaaaaatcacaaagatatatatacatcaacccctcctcaatcctctcatcaccatctcccctcccaatctctccccgcgtctcctccctctccgactctctcttcgccggcgccgcctctcccctccctggccatctctccccggcgctcccctccccggcgccgccgcctctcttcccgccgctagatcgaggcggaggtggcggatcgagcggcggaggaggcggatcgagcggcggtggcgccggatagaggcgcggcggcaacggatggagccggaggcggcggatcgagcggcgacgggtgcggattagggatggcaattgtgcccgtttgcccgtttacccgcgggtaaaaaccctattagggttgggtttgttctccattttatacccatgggtatcttattgggtcaaaagctatgcccgatgggtaaatgggcatgggtatgggtaatcactacccatgcccgctttgcccgtttacccgcaaaatctaacttacatgtaggttaggagcaaaatccactagaatacataagccacgttctttgttttctacggtttccttttatttcccttattatttctctcctcttactctattgccgccagaggagagacacaacaccgaggcggagaatatttgatgttttaagttcgattcgaacttagtagcttgtagactttttgttccactgcttttgttgtggcgggtaaacgggcacgcccgcgggcataaggtgcccgcgggcaatgggcatgggcaaccatccttacccgtcatgtagtaatgggtatacccgcgggcacaaataatctcaccggcatgggtatgggtaggcactacccgtgcccgtcgcgcccgattgccatccctagtgcggatgaagccgcggtggtggcggatcgaggcgcggaggcgccagatggaggcggaggcggcagatcgagcggcggcgggggcggatcgaggcggggcggcacggattgacgccgcggccacggatcgacgcagcggcggccgggatcgacgcatcttcttcccttctctccagtctaccccctctccatcttcttcccggcgtgggagcagcaacggtttgggggcaacgtctctcccccaacgcggctcctcgcctgttcctcgccgaaaagctaccgaaaccactcgacgctctgcagagggtcgcagcgctaggtgagggtgcggtcccgatcgacgtggcgtgaatattcccctcgggagcagtgagaccactctccagcgtggagcgttgaaaatagcctaaggaaaggaaaatgggcagataaagattagtgaaatacggagcaggcgaaatcggggcttttaactatttgccactcttacggatgttgcttaacgatttgccactaggcccacatgtcatagacacatgagggcccacatgtcattgacagggtgtggcaaatcgttaattgccatgtcacaagagtcgcaaatagttaaatttcccggcgaaatcggccagccgccagtcacaggagcgagaagtcaagaagcaaagctggcgcgaatattcgcgcgacatcaacgccaacatcttccccgtctctctcgctacccatcggctccaccgctaccctctccgccctgccacctggcacccgaatattccttccgcccgaactgttgcgtttacatggccccacatcgctccgcgtcattagatttagcactttatcttcttccacaaagattcgaattttcttttcggtttggatcatcgcaagcgatcttttcactttgagctactgtaccttttttttgtcggcatagttggactaacgatgatgctcgtgccaattgcaacgcagcgctcgtgctacgcatcagtaagctgtagtaaaagtatctagtctagtcgtctaaacaaagcacgtagaaatcaacacggtttgtgcgccgtgctcgtgccaattgggggagcatttttatccatctcgtgtacgtgccggcgccgccgtgttggtggcgagcgcgcggcggccacgcacgtacgtggccccgcgcggttggcgcgggcgtttagccgagagatgctctctggttggtttgttgggttcttttccttttttttgtttcttgcgccgttgcattgcaccccagctcaagcctccctagattccgcgcgcgcacacatggatgctttctccttcctccgcgccaccgtctccgcttccctcgcgtcctcttgtcctcacgcagagagtagacttgcactgctcttttatctctttctctggccaccaagctggttgttgtatattactagtagtaatccgtcgccgatagctgcttcgtgttgctcgatctttgaccagccagtggggttggaggagggagggagctagctatagttgctagcgtgtttacgtttttgccggcgaggcgatcgacggagatgtttgaggggtgctacggcggagtcgggtcggcggcggcggcggcggcgcgggacccgaagccgcggctgcggtggacgccggacctccacgagcgcttcgtcgacgccgtcaccaggctcggcggcccggacagtgagtcctctttgcccatcagtcagttcgtttcctgcttaattttctcttcgcggcacggtgacgacaacttcgtagtcctctagctctgtttcggttggcacttggcaaaggcaaatagtctgctgatttctctaaactgcaatgtttattgcattgttcatccaaatccttttcctctgcgtgactctgcagcttggcacataactatgtagagctgcatggttaattttgggcatgcaaactggttttcaatttcagtgtcaagaatttcattcgaagaatagtacgcaaacatcatttgtcatgctaaataaaaatatcacgcataatccagtttgaacctgcttcctttatcctttatcatagaataattgattgtctccattctgatcgtgcttcctgcaacagaagcaacacccaagtcggtgctcagattaatgggcatgaaaggcctcaccctgtaccatctaaaaagccacctccaggtttgaactcattttcatagataaaacattccatatagctgctcttttattttctgttttttttcgctcagttatattaacacagtgctacttgtattgtaactagaaatatagactgggaaggcaaagcaagaaatcagcaggcctggagctagcagtagcagatagtggtggtatgtgcctaccttgaaatattactgtcatgactcatgagcagaatcaaaagtatcatgccttaaagctaagatttgtccacacttcctacctttattttatcagaatttacagcggaaggcatcagtttttctatcggagcgcctccaaggaatcctgccggaggaaacaacacggggtaactagcaattgcccttctgcttgtcctcataatgcactacaatagaatcatcatagtctattacagctacaatggtatatttgtaatgggatgtaaatcctactgaatgccttttgttatgtgatctttggggatttttaatttccttcagtggaagttctatgagtgtctgactaaccatctttagaacatttctcttgtgaagcagagaaataccgcttgcagatgcgctaaagtatcaagtcgaagtccaaagaaaactgcaagaacaacttgaggttagaccatcgacagcttttgcatcaatccatgagcttctacttgccaatgttttcttccattattgctaaaagtgcttgtctacactcaggttcaaaagaagctgcagatgcgaatagaagcccaagggaggtatttaaaggaaatactagagaaagctcagaaaaacatttccctggatgcaaatgggtctgctaacctctcatcaaccagatcacagattacagacatcaacctagctctttcaggtttcatggacaatgcaacacaagttcaggaggaaaacaatgaactgatgaaacctatatctgatgacaacctaaaagttaataatttgggctttcagctctaccatttaggaagtcaggagagtaaggatgttaagtgcactccaaaaactgaagagttgcttctactagacttgaatattcaaggaggatatgaactctcttctagaggaatgcaagggtgtgagttggatctgaagatcaaccagcagagaagatagagagttgtttcacaaacctaacagttttggaaagttgaccgttcgctattagtttattctttttccatgtgccagtgttgagcatgcttgtgttcacaagtttgttttttctgtctgctaatgttaaatttcctgaaaggaacttctgaataaatatggtattatttagttatttgaagcttcaattgtatatacgagtgaagtgtgcaaaatgagggaacatccaacacagatgtgtatattctatccaagtatcctataaattgatgttttacttttgttcttattatcctataaactgatgttttgtttttgttcttatcaaagcaagcattattaactggtcaaacatgccatccataggtgtattgacttattgaactttgaccttttttttctgtgatcaaacctttggccacaccttatctattcaactattaattattgcaatatgtgcagtaccgggttagcatactaacgctattttttttttagttcagaacacaaatcagatccttagcatatccctcatgtagcttgaccagaactttatattcagccttagcaacaccacaaaaaaatactgataagctgctttcgcaaaactaactagaaacaaaacaaaactattgttacccaactgcataaatgggacaagtaacttttatatcttgtcaattaaccaactgaataatgtttagaaaactaacatcatcttaaagagcatgggaaacagaagattctaataaaactagactaacctagttggatccaatattcataccaatcatgcttgatggccaggattccaacaaatcactttccccatttcgagaggatcaagcatccaaaaattgtgaagcataccgcagccacggagccaaccacgagtgcaaaagcatacatctggcttggaaggttaagtttctcttgaatacccttcaaccctttgtcgatcgccggtgccaaagcagctgcaccagcaactcggaatggcctagtaacattgttaccggtccacattaggataactatctgccacatcagaaaacagatgaaggtcagtctgaggagcctggcagttttgcattttgttttagaattttctcgcaattttgccttgcaacaaagttgcagcactctaaagaactgcgagcaatgtgcagatgagcaatcatttttttttggggtaaatttaaagcaaagccatggaatccatacccccagcaaggccttgagattggccgccgggttcttgccggtgctcttctcgtagccgaggaaggccagcacgaagaacgtcgtgtaggtgacggcgtcgaacagcccgtaggccagcacggcggccaggccgagcttggccaccttggccctcatctccgcgctctccgcctacacgcatccacgcagccaaaaaagaagtccatcaaaatcaaccaaataacgctcaatcccattgattcgacgggtacaaactcaccatccacctggtccagaacccgcccttcggctgcggctccggctcatcctgcaaatcgagcagaaatttgacgagagcttaggtaaggatgggatcccagtcattcagaacctcacagagttcagagttcagagttcagatgtggttgggtaagtgatgagacggtgagagacacctgagggtcgggatgcgggtttgcggcggcggaggcgcgggggatataagcgagcctgctccctgcggtggccgcgctcacggggagcgggcacagtggtgagcggcaccagcggcgcggcggcggcggcgctgggtttccgagcgggtagagggtgaccgcgggacgctgcaggtgtagggtgtacatgtcggcgaaggagaaggcggcggattgggaccggtgagatcgatcgactccatctctgtacgccgtccgcgtcacaacaggcaatttggaagaagacaaacaagatagcatccagcatctaggcaagctgaaatgggaagttggagagaaaattgcatatctaccatcccataagaatggcttcgctagaataccattatgaaaacgggcttcgctggaataccatcctcaaccagagtgtcttcgccaaaatgccatcctggacggaaatgcccctggctcttcttcttcctccatcccgcgcgtgaagagctcgccggcggccatggccatctccaccgccgcgccgatgctgccttgccgacggcgattggggcgctgccctcccctgccatccccacctgcgcctgtgcagctgaggtcg

SEQ ID NO: 78408 - DNA, 3388 bp, Oryza sativa
aacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcatcgacggccgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttaagcaacaaacgaaatcaatgcacttatatagaaaaatagtcattgtaacatatcaatattcatacccaacaatgcacggtcaaggctgctgttttctaaatactcgtataccaaaattcgattgtttccttcaacacaacagccaattaattcaacaaggttgggatgcttcacattggtaataacatcaatttctgtcaaaaattctcgaacgccctgcctggattcagcagaaagaactttcaccgcaacatctcgcccatttctaatagttccctgaaacatcaaagcattggtaagaatgcaaggactgatggcttcagatttgaaagggatataaccctcaatggactcctcccttccacatataaagaaaaacaaacattaccttgtatactgtcccaaagccacctcggccaattttattactgcggttgaagttttctgttgctgatctcaactcagaataagagaaaagccccttatgtttttctcaggcggaatacctgaaagttagttacatttagttaagtaaagcatggaatcttaaaatggagcttcagtactggcattctctagcctaatatgatcgaatctgtgatagggacaatatacatgtttctatttcataaactctgttggctgctatgcaaattcagcataaattttgcaagcaaatacagttcgtaccgctaacgccatgagagtaaggattctctcctttcttggattttggaatgcaacaccaccagctcatatcctcagttgttgtggctgtcttgtacacttcaacatgcagaagaggaatcttcaggaataattattctgcaggaattcattgcgaaacaaccacttagagagttgcaaattgagttcatttgtacattttatatattttggatatatagtacagaaaagggaaaataaaaagtaggacatgactctctttagacagaagtctgcgcaaaacttcttgttagaactgataggtagatgcagatccacccacattagcctgtactagagtaggtcaggaactggagtacaattaaatctcctttttgaaaccgagtacaattagatcttaaatccatcattcctcatgattaaagcacaaaagaacctcatactggcaagctttcaatgataactgattaatcggtgccatgattgtgaacttgcgattctcatgatgaaaagaaacatgacccaaaattttggggatgccaggtgcatttggaccacatagctccaatctcaggtgaatataccagatgttccactggatccaatggccatgtatggcacatgtaaatactaggttagcacctcatccactgaacagttcacatgatttgcaaagcaaacggccagatggcatagctgccaagaacaatcaccaaagcaagctgaagtttggtgatttcttctaacaccatggtccactcgcctcaatctgtatgcttgtacatatgcatattttcatgggagtatcagcatgtcttaaaccattatcatccacttcttttccccaatcaattcaaacacctcataagtaacggatcatccaacttgtttattcagaccacaattccaagaattcttttgttcgcatcccagcggatgattcgacggcatcacttattttcagaatctctgtccgaatgatgctttgccactcaagaaaaactcttgacagatcgtcatctgatgaacacaaactcccagagcatcaccacatcacaggtcaggactccagacgcatcatcagaaatcaggtggagaaactctaggctaaaactagtgtgcgagaaagcccaagaactaggaaatcaagaacacgaggggataaaaacaacaagaggcaagaaatgctcgagaaagcagcagaaaagtaccaaagaaaaacaaaacgttgaacactatggttacctttcttgcttggcgctctcttccgatgagatcgacggcagaggagatcgaagaggacgga

SEQ ID NO: 78409 - DNA, 5437 bp, Oryza sativa
aacatcgacagaaaatttaaagaatttggaaaggacgcacgaaacatacggtttggtttaagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttaccaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcagactccagagcagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttatcactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcttgctccgccagcaccgtctccacctcaggctccagcatcgactcctcctcaggatcctgcaccgactcctcctcatgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttaagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacatacaaaatttcattcccatacgaacttgctaagtgtttcatatgtaatgcatcccacgcacattgcagattccactgggtgcttttactcttcgacctggatgcctgcaccatcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctgcatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgaagtacgtacaaataaattcaaaatttcattacgtagcgatttattgtttaattactaatcaatttcatacattcatatagtttattcgcatgagggataacctgaccacacacaaggaatttatcgcggcggttcaagaacaactcatgggattcatcaacgaagaaatccttgatcctaagggtgaattctactacgacggaaacacaattcaccggtccttagcttctgagctagcagcgagtactactacatcgaaatcgtagctagctaggacatataatggattgtaataatacatgactacatatgtttctatatgcatgtgtacacattttctataatgtaaatatatttctggtcatatatatatctatatacatatgcatttgcataacatatatatgtataaatacatatatattatgcatgtatatacatataatataatataatatatatatatacatatatatatgtatgcatatatatgtattgaaacaattatatatatatatatatatatatatatatatatatatatatatatatatatatatatatatatatatatatatatatatttgtcccggttggtaacaccaaccgggactaaagatggctcagcctgccacgtggctgagccatctttactcccggttaattcacccgggactaaagatagcgatctttagtcccggattggtactcccggtttagaaatcgggactaaaggggggttacgaaccgggactacaaagggtttctccaccagtgattaatggagttatgtttcctgtccacacattctatcctcgcgcgaagctacccgtatttcctgaacaagtttcttttatttaagttaattaagaaccgtaagcattatgaacttccttttgtggcaagtagttggttctgaacaattttgtatttcatgtgatagtgatgccattgagatactttagaacttggcatgctcgacacaatgttacctaaaggaatctcttcagttgctgtctgactcatttgatcatcctgcctcggttttcactacacctacgaatacaatattggttagcaacgcatctactaacggcaagtgctacgataaatgtgaccaccatctttaaatttatttatttttttcactcctgaactgagagacaacttatacaatgtatcacctctggtaccaatatctttaatactctcacatctttcttaaaatttgtgtggaggttacttcttgatttaggggtggctcatcatctatctcctttccatctcatcactcaatccaatgtggcactcttagaggcaccatatttaccattgtagtacttgccataatctcctccctcacacaaaagagatgacaacattcaccgtcgggaaatgcatcaccatccttaccctgtggtaactttattcccatccttgcccctgcacggggaataaatccccgtggggtctttgttcctgattaaaacaatatatgcatgtcaaattatatatgcaatataacatatatttacactttatattaatatatcagcatatatctagtaaagtatctactatctactgctccctccattccaaaaaagacaaaccctgtttccgtgcccaatgcttgaccgttcgtcttatttgaaaaaaatataaaaaaaattaaaaagacaagtcacgcataaaatattaatcatgtattatcatctaacaacaatgaaaatacaaattataaaaaaatttcatataagacggacaatcaaagttggacatgaaaatctagggtttgtcttttttttttttgacggagggagtacttcacatgataaaaacataatattatcattttttttcccagggaagtgctacgcctccgcagctaatgcagacatgtggttttccgtccccaaagaacaaggtgctttagcatcatttggggcctgtttagattcctgtcaaaatgtttcagcatgtcacatagaatatttggatatatatatggagtattaaatataaatggaaaaactaattacataaactgcgtgtaaattgcgagacgaatcttttaagcctaattgctctatgatttaataatgtggtactacagtaaacatttgctaaagatggattaattaggcttaatagattcgtgctcgcagtttacacgacgaatctgtaattggttattaaatcgtagactaataacacaa

SEQ ID NO: 78410 - DNA, 58704 bp, Oryza sativa
gtgccagccgccaccgcgccgccctacgccggagcccgcgtctgacgccgtagaccgcgctagccgcaccacgccgccctccgccggagcccgtggccgccgccgtcgaccgcgcctgccgccaccgcgcagccctccgccggagcccgtggcgagctagccatggcaggagggagctagccatggccgccggcgagctcttcacgcgcgagatggaggaagaagaagagccaggggcatttctgtccgggatggcattttggcgaagacactctggttgaggaaggtattccagcgaagcccgttttcataatggtattctagcgaagccattcttatgggatggtagatatgcaattttctcgaagttggaacattaccaccagaattgtgacagacatcaaatggacaaaactatgctctgacctgctttaacaaaagaatggtatgtagtatatataactcagctgccaatagttcaacgaaagaaattcaggtgtcattacatccaagaatttagaaagacacttgccacacataagataggggatggaatatatgtacatgaagcagtgcggcgtacgaaaaacaggcccaattcagatagagttggttcaaaaaatctcctagatttgtacttcaaacaaggagactccttatttttcagtacttagtagttactagtagcaattaccaaatccgatacagctaaagagctctcatttgctttccctgaaaaacgaagtatactcatttgatttgattattagtgatgcaaatcctcggcagtagacaaacatcctcagtgatatccgatcggcgcaggggtctgcttcagctccatgccctggtaatggatgtcctgcacatcacaagccagaccagatcacacgtcagaaccaattcaacatacatccccaaaaggcgagatcaaagagcaagatcgctgatcatgcatgcgtaccgatgcgaagtgattgacgtcgcggtggtgagcctcgtcggcgcgcacgacggtgacgacgtccttgagcgtggcgttggcggggaggcgccagtagtcgatggcgatggccggggcagggacgttgtcgatcttgccggcctcgaggtccttgaggaactcggtgtacgagtggatggcctcctcctcgaggtagccgacgacgcggtgcgcgaacttgggggagaggaggtaacccaggaagtaggcgttgaagaagacgccctggacggtgatgacgagggcgcgctcgtaccactttgggttcgccacctccatgaaggtcatcaggtgcatgcgctcgttctcggcctcttccagcagcgtgcggatccagccgccgctctgctcgaagcgccggagggaccggaggtggagcagcatgccgcccaccatccccggcaccgccgccaccgtctccagcatcatcgcgcggcagccatacctcctctgcacccaacccaatttgcagtgttaaccattgacagttacagcaattagcgaccgactagagatcatttccacatactactagaaatggatatcatgtaatataattgttcttccaaattagtcataagacattagaatcatatatagattaatttgcactaggaaacaattggatcaccagtcattgtagtgcaaacagtaataagcctatgattgatttaatgggcaagagattaacaaatcaaagttgagtccttctcacaatgcgtgtccttttcttagccgttgttatcagatagtatagcggaaaataaaaggacagggattttctacacctaagtgctatgacacccatcatttgcatgcgactcaaatagttatagaaaaaattgaaaaaaaaattagtaacatcgattgtgatgatataagtctatacacaaacatgcatgactaaatttgatctataactagagaaacaaaaataataaaatcagacagtgaatagtacccgaagagcgcatataaaatttattatttttgtttcttcatatgttgatcgaatttagacttacatgtttgtataatgtttgtaaatttttttataacggtttaaattgcatgcatacacataggtgccatgttacctaggtgtagaaaatactttccgaaaataaaatcaatcacacaggtggatcaggtagaacccaggcgtcctaaatacaaatggcatcttcccggaagcaaggaaaccaaaattctcaagtgccctggttgcaatgctactttgcctcttatgacacgccaagagtcacgcggcctctcagtttttcccttcgaaaaaaacgttgaactaaacacacagcgctaatcacccggagaatcaaacggccgtcgggcggtgcatggtgatcgagtaagcacaattatacctggaagaagatatcagtggggaagcgcagcgacttgacggtccagtaggcgatcttgtcgagcagcgtcttgggcacgtggtgcttcgtcagatcgatcgaagtgtccgcggtgtaggtctcccatggctgcggagaaaatcaaaccaaaattacacacggcggcgcgacaagttaaggaccgagcctactatctcggagtatggatacatcgatctggcgatcaatctacgggacaaacagaatcgaaacaggaaaccgatcaggagcaaagcgaagcgcaagtaccctaaagcaagaccacttccactccgtgccgtcctcccgcaccagcttcttcgactgctcgatgccccagtagctgttgaccaccacctccttctccgcgtccgccttcttggcctccgccttggccgccgcctccgtcgacgccacggacgacgtggacatcagccgcaacccccacaccccggggacggcttctccgcctgcaaggaacggcctcgccgccgccgccgccgccgccgccggagaggtcgccgacgcggtgaagaggcggacgccgccgacgtgacggaggatcgccgatccggccatccgggagctcatcgccgccgttgatgtaccccgaaacgcacggcttgacaacaccaaaaagtttgggaggaattcttagaggcgcctttttgttgacgagatggttgcgatttgcaaatggagagggtttttttgggagggttttatatagggaggaagagcgaaaggagaggaaccggtggtggggccacaccgtcagtgacgggggagatgggctttcctcgggctttcccgactctgaggaaatcttttcttcttctccaagttgatcggttagtagtactgtagcagtactactaattcttgtgattttttttttcaaactgcctgtgactaataataaaaggttcacatgtgttttatcgccaaattaaagtatgtgatgtgtcgttggtacacgcatcacatgttgattgagttttttttttcttaggatggtactactgcctaatatcaaaagaggctaatataacaaagtgcacaaagtcaatgtaaaaaaatgcgtcacttgtacaggtggagtacaagtgtacgtactacaagtagaatattccgtttagaaccatttcacaccaaggatagtaatgcgcaagcaatttgcaagtgcccggtagtacaaggaaaacggaacgtacaacaaagccaaagccaaactggaaacgaatcctgattctgttgcttgtcttgtggaccaagaaagactccaaccatccaggatggcagtcaaattaggcaacttctattattagatccttaatctaaccactgacaattccagaacgtgactaaacagctctattgctaattgcgactagtatacgcagctagaaacatctgggatgttgcttttggaaagtgcctccatggcggtgtacgtacgtgcttgccacatgaaccacaatctgaataagcaaacgtgtcaatggtgttatcgctcatgacaactcagtaagtgtttatacgcccgtaatatataacgcacacaagggaaataacaatccagtgcttgtatgcgcataatggacacaaaaggaaatatcaagcgtagcgtgggcgtggattctaaggggacatcccctcgtcggtttaagttctaagtttaacacgggagctcaaatttatttttcagtgataggtgataacatttcacagcgaggtgcctatatggtatctatatggtatataccggtccagtcttcgtctgccaataataatgaatactaaaagaaaagggattaaatgtaacacaccaactttttattactgaagtggagagggaatattgggatgaataaaaaataatcgacatttaaaattatatcaacttatggcacctccttaattaaaaaatgtaaaatggcttaaagaaattatttttctacacttacttccataaaaaaaatcctgactgatttttcaagttaggagttgatttttctaagacagatggtgaattgcaggtgagccattgtgtttgtgcttctttggtgatttttttctgagggcatattgaaatcaagagtccagaaaaagaaaaaagtttagtgtgaatggtatttgaacttgtctaaaagagattccatttgcctttacacatttggactggatgtttggtcttggttgtgtgcacgggtcagccaacggccatgcttcctttgttagcagcagagcatcttgacaagtgttacctgctgcaattctgaacacgtggatacttctactccaaaaaaaatcttactatattgttattcacaatttgcataatctcagcatgcatataggtacaggcataaaacggagtgacaatagcttatttacatatatacacagaacaaagtttatcccaaataggatgtaaaatacgcatgtagtagcagtgatggtgatgaactgagcaggcatcgcccgttgatgaatgatgatcagtgatacccgataggcgcaggcgtatccttcagcttcatcccctgttgctggatgtcctgcacaagtgatgtaccaacacgagaaacgcgatcggttagctcaaacccgttcacacaaaaattaagcaggcgagattggttgttttcaggctggcatatgcgtaccgatgcgaaatggttgaggtcgcggtggtgcgcctcgtcggcgcggatgacggtgacgacgtccttgagcgtggcgtcggcggggaggcgccagtagtcgatggcgatggccggcgccggcgtgttctcgatcttgccggcctcgaggtccttgaggtactcggtgtacgagctcacggcctcctcctcgaggtagccgacgaagcggtgcgcgaacttgggggagacgaggtagccgacgaagtaggcgttgaagaagacgccctgcgcggcgagcacgagggcgcgctcccaccaccgtggctgcatcacctccaggaaggtcatcaggtgcatccgctcgttctcggcctcctccagcagcgcgcggatccagccgccgctctgctcgaagcggcggagggagcgcaggtggagcagcatgccgcccaccatcccgggcaccccggccaccgtctccagcagcagcgcgtggctcgcgtgccgccgctggaagaagaggtccctgggcaccgccagcgacctcaccgtccagtacgccagcttgtccgggaggcccttcggctcgtggtgcttcgtcacgtcgatcgacgtgtccgacgtgtacgtgtcccatggctgtgtcacaatgcaaaagaaacacacatcatgaacacgatcaaatcgagaattcaccgtgcaaaaaaacaaaaaaagaagcgcacacatcaatggttgatgagcgcttaccctaaaactgagccacttccattccgtgccgtcctccttcacgagcttcggcggctggatgccccagtagctcacgacggccttcttgttctgcgggtcggtcgccgccgccgccgccgttgccgccggctccggcagcttctcggctgcgccttctttgacgtccgcgccggcgctgctggtgctggccatccgcgcggggaaaatcctcgcggcggcgggcatgacgcccctggcgctcgcggcgagcccggagtacacaggctcggcggcgaacaggcgggggcccaggtggcgcagcagcgtcgctccggccattcgggagctcatctcggtgactaaactaaactaatcacgacaacaacaaaggcttgacttccgtgtgatgattctcagagcgccaaaaaggcttgagaaaagttaccggaaatgagaattctttgtggttggcttgtgttgctgtgataggtggtgtggcgggtcgatgtgattagcgggtgcgttttatagtggagcatcccgcgccggcgcgttgcttcctggacagagcagggcggctatagttcgatttgcgttgtagaagtaactggtcttcgtcgtcttcccggggagttcgcgagggatcgggagagcaggtcggcctcaggtgatgcactgatgccgtgatgaggattacggttgacctgacctttcaacgggatgtcgtttcttggtttgccgctgaaggattctgctgcgcgatggtggcacgggtgagtgacaacatggcaacgaaagaatcctgcacgtcggtttccttgaagtttggcgaccggtgctagtcaaccggcgaagatggactgacatttcgccgtggctggaaaggagaaaatgtgaacatctagtaaaccagaagatcacttgcatgcgcagcaccggtcctggaaagttcgacccgatatcaaaagggaaggaggatagcagggagaagctgcagcccgcaggcgttgagtccgtcagaaatcaaagagttcctgcggagactagtttccgctccaaaattatttttctataattttttcatgaacgcgaaaaagattatacgtcaatatattactcaatgtaattagctagaccaacttataccaaggagagaaaaaaaacaaccaaggaagaaaaatataactcgtacgacaggtaacgctactccaatcagcgggagagggcaaagccacgctacactttcaacaaatccctaaaggaagcaatgcctgctaacgaccacaaccgatcctccgaaaggatggattatttttcttctataaagaaagcccattctgaaaatagtacgtgtagtaagcgttgttttcctaagaaaaaatcatgataaacacaaaatactatataatttttagaaaccatctaaatgtccatgctcgctacagataaaataatgtattaatgtactttcactttttgctatagagaatattcatcctacttttattttttttaggagctacccatttagattcgatctttttaatattaaaaagttcaggagttaacttgcaaaaatttcaatgcagtaggtgaagtagcaaattcactattaccatcactactttatttctaatttcttttcttttaaagggatatagatttactaggccgtcaattcggcgtattaaactatgataaattttagctaaaaattgtattcttccatattttttcggtcgacggagtactattgcataaaaggtgttacaccatacttttaattgaagatagtcctaaatttcgagcaagtctagaagaacaaggtattataggtgcagttagttcaactattacctgtgcatcgataagagcaagattaatagtatagccaactactagctccaattcatctatagtcaatctaataactcatttatacaatagttacatactatactattaatacatggtcccacctgtcatatacacactgcgtcttagagtccgtactacagctgactacaaatatgtagcccgctgctcttctctccttatttatctccttaaaatatgtttacagctggcttatagcctgctattgtacctgctctaactaatttcaatgcagataattgttccatttaaactcaggattacatgatgatgattaacccagtaaagtgtggaaagtttttagaatattagctgaaaaaaatatctaagtggaacaatcaatcccgcttgtaaactaccagtatatgaactggatagaggttacaacttactagccattgcttctccacaaaaaggattcgacggctcaaaggacttttaagttttaagcccaaaaagggacctcatactccgcaacacgcggcatggttaaggcagcagcatttctggctgcacacatgtaaataaagaaaattttcttccctcaaggaccagaatcggctgatatcatatacagtgccgcaagcgtctatagtttacaagaatctctccatgatttcataatctaacagaagttctttcaatccaatcattttgctgtactgcaaagtaatccagccaacaacggatacatatgctacaagaaggcaggcacgcttaagccgacaggcaaacactctgatgctatgcttgcttacactggacccaacaactgcaaggactagtcctcggagacttctgagtaagatagtgatgagtaaggcactcaaaataccagccacaacccctgccattacgtatccaagcattccaatggaattgaaatcctccaacatataggacttcgataaccttcataatccgacatattggagatacaatgagcatcagaagaacaaaaacattgtaaataaataatgcagatatgcaagcaaattatgtgtctgaaaaggaagatatttagttccaacttccaagtattcaccattctgcagtctgcagattaagcagatctgggttatcatcatctgatggagctaatgttgataaaacaacatgcaatgttgatgcagtccatatatgggaatgaagcgaatatacgtacaatacaaatatcctcttgagcatctcaattgttgaaggttcttcgctggtgcaattgaacagcctatctgaataaatatcagccttgctacttcccaatgtgtatctgcaactatacgattcatttacctacatgaaaaaatggtgatgaaaaggaaatgtcgaaaaggaactagtgcctccaactaaacatgaaatgagtaaaaggcatgaatattcctaaagatccccaaaaccacgaggaaattttaactacaaaagcatcggtaaatattacatctagcagagaacaagatgctaagtagtacactaccttgaacttcaatgttgttgaccatgcaacaccaaagtcaggccggcaattcagcggaagagcctcctttggggcctctgccaccgcataagatgtctgaccagaaaaatattctgtgtattcaacctacagcaacataaaagcagaacaaattgaataaataaaaatatctattaaaatatgtaataaataattgaaaaggtgataaaaaaatattgatactaagctaaacgatggacagacagtaataagcaggctgtgcaacgctgcaagtcgatgcaaatctaaggaagttgtctttgcaaattaatttatgcataaactactaagaactagaaaaaagctataactgtttgtcaataactgggagttgagctattacctataatttgtaagcatcagttaaaaacatataaagttaaatctagaggcattgaacatgatatcagcctcattagtcatactagtaacagttaacgttagactctaaagcattgttgtgcaagcagagtggcagaaaagcagcaggcaaatgaaacatttcatcaatcaagtgcttatagatatgccaatgacaaagtaaattatatttttttaaaaaaaataacaccacaatttctcacctcaaagactgaagcccaatagtagtcatcatggcatcgaaattttctattactcgaggggtaaaatacatgcttagctctatagttcaacagtccgagctcacaaacttttgatgacctaagatcaacacctgaaatgtgccgacaatcacatcaaagctagatcagtccacacatattcaactcaagttggtctagacagaaaaaaagataatccataaacattagtattcaagaacactaactccagtatactagaaaccaatagccaatgaacactctacaatagtacaactaagtttctagaatagtaagtcagcaacatgtcacaataactattacatttgtaagaagcatgctaaaatgtacatcacagaacggaatggagcttagattcgcattaaactcttctctcatacagcctagatagcttatcctcgtcataattcaagaactgtgctgtccgtgcacaaatcagttagctctagaactgtaacgatagaactaaatcaggaaaggactgaagagacaggaacggccactgaccggtggaaaggatccggcaggtggaaggcatggagacggacgcggtggaggagagaccaccaaggacgagacccgcgagcccgacgacgaaggagaagaggaatgacgccgcgaagggggcggccaccccgagggcgccgcggaccgcggcccccggccgccgccgtctcggctccgccccttcggccgcggcgacctgtggcgcgggctcttcctgcgagggatccatcacgtggacggccgatccatcggtcgaggggccggcaagcggcggggtcgccggactccggcgatggggaaggtagtgcacgtggagtcgggtcggactcggagggtgggtgggtggaattgggcgcaagcggttgtggtttttcttgggctaagacaatttgggccgctcgtgtggccgtgtagagaccttcagcgcagtaaactagtacaaattttaccgacgtggcgtttattagtgtggcccatgtacggcccacaggaatttatttttgtgtggaggattgtacagcttgtttggcaacttggactaaggagatcgggaggttataggagagaattgttagtgagatttaatatgaaaatttgatttttaatcccgctattttgttggtagatgtagtggaaaatgataaggagtccaaatgaagatcagatttaaatgaaaacgaatgactgacattatgacatttgtttagacaacgtaaaagagaattcctctcagatttcatagctgagtataaaggaacggagggagaaatccggtaaaggatttgacaagcttacgaataaattgaaccaacgaatatgaagatttgcgttacaagaaaaatttaagcagcaaccaggtgagaacacatcaccacgttatatatgttgtctacacaaagagggacacagcatcaaagatacatttcactcctatccctaccaactttcactattttgttttaccttgcactgtaacaaggataaccgatcagcaactaacagcggtatcacctctccctaatctatctccctttttctcttgatctgctcgactcatgcatagatgcatgccttgttacagatactgtgcttgtattctgtctctgttgtgctcccaccaaaccttcgccctgtcctcaccaaacctctcgcggctgcagaagcagagaatcaattgagtacgattaagcatggatcaatcagaaagtagtccctaggcgagtatatacatgaaattctggttagatttgaaagatttgtgttggtgacatggtaaacctaagatgttttggctatccgtgcgtgattagtgtatacctgaaccggatgcggcggagctcgcgggtgccgtcgccgagctcgcggatagtgaggcagacgcccggctcgtcctgctcgatccactcggtcgcctccatgtcgctcgcgttgctgatggacacggaggcctcgtcgcgggacgaggtggtcccccgcgacgggtcgtacaacgatgggacgccgccgcccgccgcggacgggccggccgcagcggagttgagcatgttgaagtggtgcgcccacacgtggtcggacgggtcgggcactgccaccgatgggtagcacgccgctcttgtggaagccgccgccgcggcgtaattagacgccgaagccgccatcgccttgcacgacatgctccttgcgatcggctctttggccagcgacgacgacgtcgccggcgtcacgaccggactctcccgggtcgatccgcccctggagcagaacgatgattctctctgcattcatgcacggtccagatttttcagtgagttgcattattgatcatgcagatgaaaacaacgtgatgatttcgaagtagcatagaatgcccgtgaaatctttgaagggcgtagtaccgaccagaatagagtcgtcgacggaggacgtgggagtggacacgccttgctgccggccgctgaacgtctgcacgttgtacagctcgacgatgcggtcgtagttctcgccccaccaacgctgcgcctcccacttgttaaaaatctctcggctacacacaccaatacgcacgtgcgtgagagttaactctggacaaatcgctcgcacacaatacgtgcagagaatacaatcaaccgtggaaatggagcagatatgatcagtgtcagaacctgaaccggatgcgcttgaggtcgttgccaccgccggggagcgtgacgaaggtgatctggacgccgggctccacctgcgccgtccactccctcggcacggcatcctccacgacggtgacgtcgtcggcgccggcctcctcctcgatgctctgtatccacgtcgtgccgccggggctcctgccggcatcctgctgccaccctcggttgctcttgctcctggtcatgtcccatgtcgccatcgacgtcgacgcggcccggacgggcggcggcggcgccgctctcgtgtacatgtaggcctcacctccaggcctggtcgtcgtcatgaacgcggagtcatcgatgaagcccgggtacggacggcggtagctcctgctcctgaacgaagggctaccggccgtcgccgccttgtagtgctgatgcttgttggagccggagaacttgagcaccatgtccttgagctggagacaacacattgcatcgtaggagcctagttagctaccactcagtcacgcgagagtcacttcgcgagtgttatgtgcatcagctctcactggaattactggcataagtagctatcacatcgtataatatctgtgatacatttacatgtgtcaatacttagcttgcttggatcaaaagtaaatagttttttaatcatgaacatccataaacatgtgtatccatatgtgtgacctttaaattagggaagagtaccgagaatgatgcctgctgaccgatgacctcatatgacaaacaggtttaaatcaaaagtggccactggctgctagctaggtcacaaaaaaaaaaaaactagtagtaacacacaaatatacttggtacaaattaaggaccacactaactggctagtgacactgcacacgacacaggagggaaatctttacccttttgtctgaatcaaggaaccgtggcatgcatgcctcatggctgcatatctatcgcagcctaagctcaaagcaacatagtaaccggtgcgggcgataatgacagctcgtcgcgcgcaaaggcgcgcgcggcccggccgctcgctggctcgctcgatcgcagcacatgcagcatgacccctccaccgcatggatggcatgcatgcacgcatgatgcgttgcgtgcgccgtgcgcgctcgcttaaaaagacacgagacgcgagcccgcagatgcaagacgcgagccatacgcgagacgagccgcgcgcgcgtttgcgtggcccgcggccggcggccggcaggtgcaggggcccaggctgggcctaattaatccgtgagtgtatagctcgcgtcgcgtgccaatgcaccgtggcccgattcgtatccggctttattccatctccattgcagcaagcaaggcagatcctagttttagactttgtgttttgttcgtggctaactttggcatattcctaaccttaggtaaggcatatggtcaacagaatactgacgacaccaatgaccaaggtagataaggaatcaaatattttgatgttggactatgcggttggaaatataatctgacacaacgaacgaaccaaagaccacctaagaaactagggcggagataaatctaggacaattacggcctgaacctttggtttttgtctccttattaatcctttgtaaatccattcaaatatcatgagaattttgaagatcgaacagttatattggttaaaattcttggctccttctctgtaagaaacaacggcatgcttaagggcttgtttcatattgatgccatttcaaatcgtatcttttttctataaagctgtcaaatatatatatccatttagtttcttactaaactctgataaataaataagaaatcttgccaaaggcaatattgtcaacttgctaaaattttagcgatgctaaaatttagtaccacctccgttttttaatagatgacgccattaactttttcttacatgtttgaccattcgtcttattcaaaaaaattacgtaattataatttattttgttatgagttgttttatcactcatattactttaaatttgatttatatcttatatatttgcataaaatttttgaataagacgaatagtcaaacatgtgagaaaaaatcaacggcgtcatctattaaaaaacagaggtagtaagatttatttgattacaatctgaataggccttgagacgtgccaacccaagacatgtattcaaccaaacacccccttagaaacaccaccaaagcatgcctttctacaagggaaaaagggtggacaccagccaaccatcaggcaggcagccacaggggcactttgtatctaccttatgggcatctctttagggcaaagggaatgaacgaatgagaaaagaaggggaatgtgtgtgcatagcatgggaacaaaatcaagccacgatgtggttggcaaagtggcaaactgtccaaagtttaggagtggtggcgcccggccggccggctgggatggggatccaagcagcaaagacattaaagtggccttaattctttctcccaccacatctactcatcctcccttgaccagctttgtcgaggaatgtcgccagaatttatcgacgttgagtgctaaagggaggcgattgaaccactgtcattcacatcgtacttttgggcatggctcaacatcaacatttcctagctactgtagtcagcagttgtatcactgttgtaaagttggacgacgtaggtataggtttttcagagaaaacacatagtcttagctagggacatcatgctgatctctgctcgttgatttgtactacctctgacaacataccaaactagtttaattgcctatgatcagtactaaaaatggcttttcttaaaacgtaaaatgtcataaagttgcatacttgtatatgcagaaatgaacaatatcaatccattgtaacttgtgagaaggtacggctagaaattaaaagcattttggagtatgtttgcataggacgatcgagagttagatgacctgagtataggtactcaattgattgcgtctgtgtctgcattgcgtggggcggcggaactagtaatcctatgattccgtaaaggggctaagggccaaaataaatggcagtcatggctacagaaacttgctcgtttaatagtacctagtacgtacacggccaccgtaccaggaaatggcgacggacgctttgctagtagtttgtctctatcacacgcacattacttcgtcagttttcaaccaccgtgactttggactctttgccaacgtacaccggctgatcgatctgcgggtgacctaaccaatcggacgaacgaattcaattcagttgcaaggttgcaacacagcgcatacggtcccagatcggccatgcttgggcaattcctgggcattgctggtaagtagagtactgtactctctctctctctctctctctcttttttgtgacatgggtaagcagagacagagcactagtggtatactactgtacagtctcagtggtcgtccatcttggctgccacccctggtctccccctcgtctattaactgctgctactactatctcttcctcatacagacagagctagtagcatgtagtagtacactctatatactgcagtactgatggcaaagtagcaggtgtaaattcgatccaggagtagcatgtacgagaagaagtttagatcaagacgaagaagaagaagggacagacgggtacctgtgaggtgagggacttgacggcatctctgccgtgaggcgtggccgcgccacgggacccgtcctccccgccttccttggaggagcacgcgatgcatgccagcatcttctctgaccccctctccctatctgcctccctctcctcgatcgacgacgacgagacggatcaatcagtagtcaatcgctccccccacaatctcaccttgtgtatcgaactgcaaaagtgtgtgcattagcgttacatatatagtactaccacagtacggctatctatcagaattgaagccgctgtaacgaaagatcaagtttgatcagacatgccgtcatgtagacactacagcccacggctacagttgcatgcatgcatgtgatagaatgtctatccatgagatggtcaaactttgtcgttgttcgcatggcaatagtacacttagtacatgtatagtacacatttccatgataattaaacgagtgcgagatttcgtgtatccacgcacacgtatgtacgaccaaaataaatacacgccgaaagtacgtactcctatcaagtatcaacagtgacactatcagtctagtatcctctagccatagccacaatctacaatgtactgtaataacgtaaagcggtttccaagccggtgtgtgacgccattctagtaccacacaccatttggaccagacgtgccatgccatccttgcatctcacatgtaagcacgcgaacacgacatccggtacactatgcgagcacagagctatccggccggtccgtgaccacgcacacgtgcgcatgcgtgtgcgtcggaggagctgtccttccggctcgttgagcaacagagagcaatgcaagcatgcgtatgtacgagagatagctatagctagggactctggtctctggagcttcaattcgccaccggcgtcaaaacggggcaagctggctggctagctggtgcagtggagcactggagcctgcagcgacaaaaaagtatagcaccagcataacaaagcaagcaagacccatgccaatggcagcatcacagtcgttcacagctactcctgcatgcatggcatgcattcgcaggctgctctaacacagtggaagaaacgctacgcggggcaaagcagatcgatcgacgggcacaggcacagagattctttaatcgccatgccacatgacacacacacatatactactagtaaatcaaaactgaaaagcaggttgtagtagtaaaatacggtcagctacattgcggcagggaagcttctgatgtttacgcgcacatggaaatttattaaccaccagtgtgctatggctagctagctccgcccgtttgtgtatgtgttgtgcacagtgttcatgcagatgaggcgcagctacccacgcgaggtaggcaggggcgtatggggaagactccaaacgacaccaacagcagtagctcggtggacgaggcagggagccgctcagatgtgtatcagctacagtcactgcagctggggccccacgccctcccccagatcaacgtactgcctggactttattttttttttcctcctgctccatccctaccgagaaaaatatgggccccggctaaagcgaccggctatcgagtgactgcattgtggagcccggtagggtttttgctgattatcttttgcgcttttttaatagaaacacgacgtgataaccttaaacacggtattgtgtgtgttttcttttggccggtggtagtaatttcttttgtacagtagtagtatcagctagtaattaattaatgttgctgtagagggagagagaaatgagaggcacagtgagagtgatgagatgatgcttacaggtaactgacggcccccagatagctacgttagccacagctctctctctcctccgagtttgctcgccgtgtaaacagtgtgcgtacccaaaccacctacgcgcgcgctgaccgggttgctccgcctcctcttcctctctctccggcgcctgaaatgatgcagacaaaaatgtgccaaaataaatatgtatacgcctagaagcgagagcgggatgcaaggagaaacggccttttatttttgacaccaagataaacggactttgactttctggtgaacagaacagggtaagaaacggcatgcaagacgagaaaacaaaacatagaaaaagtgtaactcaacacacacacacacaaaaaaaaagcaaagcaaagataagacgaagcatcaagcaagctggttgcgtgcgtcgccgtcaccaccattaccttctcctccacgtcgccggtgagcgaacgagcgcaatttgcagcccgccggtcggcttcaccttcgccgccctttcggtttcgagctctgcctctgaatcgactcagaagcctttggagatagcacagagagaaaggcctcccttgtctggtcgaggagtggatgcggctgcgtcaatggcgccaaacacagcggcggcaaagatatcagaagctacgcagcgacgctgtcgccgcacagaaacaatctgggactgagtgggagattcctctcgcagtcgcaggagagaagagccacgaagcgagagagagagatcgaggtggggagggagagaacactgcgggcgtcgcgctgggccgtcggatccttcccccatatacgacgagagggcgccgagtgcacaggcagtgcaagccgtctcgtttccggcccatatatagtccctcccccacgggacacgcggcggtccccgcgagatcgcggccgtccgatcctgcgcggcgtgtggtcatctccctggtcctgggctgggccccacctacggtgattcgctgcggggcccgcgaaggcccgggccccggcacggaccgtggcgatgacgaacgtgctgccgtggcgcgatcaggaccgtgcgatgtgatgcatatgctgacggggctttgtcatgatcgaggaccgtccgatcttgatggcgcaaagtacgtcagcgtgtgcttgcaagcccaataggcgagtagcccatagcgactgacggagcgtggggctcctcaccgggagaccgcgctggtccccttttgccggttcggccggggaccctgggtgagactctaagctcccaatttgtggaaggttcgcgagacaggaaacacacaagacgccggcgatgtatacaggttcgggccgctgagaagcgtaataccctactcctgtgttttggaggatctgtgtatgaaggagctacaaagtatgagccagcctctctcttgttctgggttcccaatctggaaaagtccaatcatcccccctctaagtgggcaaggtcctccttttatatcttaaggggataccacatgcaccatctccccctctctttcttccaatttgacttctcttcattaacagacggagatttgcatcgccgccgtccgaatgaccttctgatgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacaggcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggtccgaccccttggggagacaaagagaagggcagccgtatcaccctcgggcccgacccccccccccccccgagggagttaggccacgtgggtgatcgtgtctgcctcaagtctctaagtcatgatactcccggtaaagaggagggcgaacacatcaccctcgggcccgacgccccctgacggtgccaggtcacgtgggcgattgtgtctgcctcaagcctctagtcatgatactcccggtcccatgtcaccgacagcgacgatgagagagacaatcagagcgacaagtagacaatgccataggctattagtattaggttcacatcaattaataaaccgtacaaattactatagggattaagatcacgagcgtctaaaatgaacctctcaaatgacggattcttcgattaattgcggtggtggaaagccaacgacgattaataggagagcaaaaacatcgccgtccgagaggaaatatacaaatcaacatcacgaaatgtataggtaggtgggaggttggagcagtcaatttttgctggagacagtcacggacatgtgtcatgtgtggataaattttgagattcagacttgtacatttttagataagttcagtttgaattttattagctcctgtaaatatcatttgcaaatatttattatgcagattcatagactatagttgtacaaaaacatggcgacgtgaaaaggatatgagaatttctatattaaaaaacagtatagtagtatatcatacgagtactatacgatcaggttctgtaatcttttagtaggagtactagcactggcacgcatccgagctatgcgcaggcgcgcagccgactagtcctatctccgttcgaaaccattgtgcatctgatgaaaacagttactcagattcccggttaaatgcatgagcctattccatctatctaccgtcctgtacctacacatgcgcttcttctgaacaatttttaaaccagcctccgctgttcactgcttcacgaggcaaatactatagtatttggatgcttcttttctcagcttctgtacgtacggcggcacagaccaccctgcaatcatacatggctgtgcacagcagccaagcgcaccggctagtgtgcttgaccgaaccaaaagagagatcaaaggatatcgaaatgaaatcataaaatactccaaaaatggcgtttctgcctttttcccgttcaaagttcaaacaggagacggggagaaaacggtggcgtttctaccgattgatttgcggctcgttctgattctaatcttatctcgatctgacgatctgcatagtttcttgagaaagcatgaatacggaaagctagctagcagcatagttgctaacgttatgacagagcgaaagcgaaagaggaaaaagcggcaacgtgatcgagtgatcgatcggtacttaatttcttgagatcgatggcaaacgaactaaattaaaggagtttacattagtgtgtggattgattttgagactcgtagtacaactcatctgaagttgccctctctttcggttcgccaagcgtcgcgacggaaagcgtgcggagtgcaagatcgatggcgagggcgagagccccccctcccccccccccccaaaagccccaaccacgcacatctggcaatgtggttttgtgatcccaatgagcatcacatcgcgcagcggcgcaggcgaaagcagattccaccgccagaacgtcgtcgacgaggacgagtgcaactctctcgttctccccgcgccgcgagacggaacggaagcaacgcgcatttgcccgtcccgcattttgatgccgcgcgcattgctggcttgccggccgggcacccaccagcggcgcgcgtcccggcgtcagcgcggtggcgtcgcggtcaaagtggcaaatcaggcacgtcagtgccggtacggggcgcgcagccttagactgatcagcccggccagccagcctcgggcggatcggggaggccttttttttgttcccgtcgagttctctgattctttcgcgttttctcgatcgatctcgcctgcgacgacgacgacgacgggcaaggcgactttggcaatttggcatggatcgtgtcgggcgagcgaagccagccagccagccggccgcccggccaggttcgcagaacgcataggagtaagactacgacgatgatccagtcgggatcgagccagtgatccacctgctgcgccgctgcatgcgtgcatgcgcaaggtcgcaacttttcatggcttaggggcctatcgctagctcactgtgcccgcgactgtggctcgtttgtccccctcggccccaaacgttaattcaaattttttagtactaactgggagttttttggggcagtttgcgagaaacctagagatcattactgtggaagccacgcgttcgagctcgagacaaaagcctaaaccagagagtcatccagcgtccacacgtgtagagtttgccgttgtacaggacgggtactgtggtgtcgtactagctaggccactggtttttgttctctgttttcgcgctggatgcttggccaaagagaggcggaaggggtggaaaatgactagacgaccgatagagatgcgtgtttgtggagcggacaaatcgaggttttttggggtgggtaaagctagcagctggctagccagcgagcgagcaaatctttgatcaggaaaggaggtaaaggcgaggagccagccagcagcaacgcaccaagcctggcctggaggagggacgggtcatgtggtttcgcgttgccgaacgagcagcctttcggaaaaggccactcgagtccacccaaaacccatgcgacgacgagagtgactgattcgagtccaccgagcgcgcgacctggtactccccgtggcacggcccgccccgtcggagccacacgaactcctcgacgcacgacacgcgggcgcgtgaaagggatcgcgattcgccgacgtctcgtcgtcgcgccctcctcgaacgtttcgtgtctataccctcctttctctctagcttcgccgtacgcgagctcgcggcgccagtgcgcgtcacatcggtgtcgcgccattttgaggggctccggcatgaagggacgatcaatcgatcgatatcgagatagagggctagtttagttcccaaaaattttccccttcacctatcacatcgaatctttggacacatgcatggagcattaaatgtagacaaaaagaaaaaccaattgcacagtttagctataaatcgcgagacgaatcttttgagcctaattaggccatgattagccataagtgctacagtaacccacatgtgctaatgacggcttaagtagactcaaaagattcgtctcgcggtttccaggcgagttctgaaattagttttttcattcgtgtccaaaaactccttccgacatccggtcaaacgtctgatgtgacacccaaaaattttcttttccccaactaaacacagccagagatagcgagagcgatttgcgcagcattgaccgtgtcaggcaagcgaggcgcacggccccagcagcgctgcagcagcagcaaccaaaggcgttgtgcgcaccctgcgtctctcatcactccatcgcctgcgctgcgtgcttttgccatctcgctggcaaagcgaagtacgtgcgtacacacacgcgtgcgtcaaagcgagcggccaaagactcacaccgtcgcacgtaccaaaggacacgtacgtgttgcatgcatgcatgcatgcacgcgaccgtgcagcagccacacagcccgcagcatgctgcgtgcgcagcttgggcgtgtacggacgtactcgcgatcgatgggagcaatgttcaggtttgtctctgcggctcgcgatgccggcggccccgggcgtgtctcatgtgtggcaaagctgagcgcatcggccggtcggcactgccgcggcacgggcagcggcgcagcgcggggagacaggcgctagtgcggtccagagccaccacgtactccgtcctgagtccgagtactgtgctacgcgcgcggtgcccggcacgggctttggcggcgtgtttgtacgtacgctctgccaggcatgccgcagttggtgcgcagcgatggaatgcttcggttgtcatgcgcctctggtacaccgtacactggtacttgcttgatcgtctcgccgcggtttgacgggtctataagtggaaactggagacgccccatctttgaatcgtggcagaatccattacgtgcaaaagagatggccgtaagagaacaaattcaagtgctcccgtctttttgggcggtatttttcacaataagaaacaaccaatcgatagcacttgtatgcattgggagaaccggtctttgttttcgtgacttttggctagcagcaggaagcaggaggactccagtggtagcaagcagggacaaactcccacaaacgacagtccatctgcatttcagtctagaagtatgattattgaggcaagggattatgatgaataagacatcatcagtataacaaaattatccaagaaatcacttcaaagtactgcagaagaaacaaactgtcccaaaaaaaactaacatgtgacccctcctagtataacgatttggacaaaagattatccagattcattgtactagttttttttttatgatagagagagtacttttttttttttgatggagagagtactaacgaagagattgctgtcacatgaataatatctaccttttgaagttgggcaaatgttacactacacatgtagtagtaatagccaaaaaagaattgtgggagatacaccgacttcatatcatgctagcaacgctattctcaagctattttacatagtcaatacttcattcctaagaaaggacatcctcttgtcttcaaaaaacaattatcatgtggacacaacattacaaccggccccatttgcagttctgcatcatcacgatgcaaagcattcctaatgacttgcatatggagaaactgtttcaccatgattcaacgtcaggaaacatactccaaaacaaggagacaccttcaagttaactgatgtattatgttctgtaactgtatatggaagtccatggagaaacgacaacctttggaaactggtagaatgaatgggtcaacctgaacaaacaaacacaaatatatcagccaaagtcggatcattcaattagtgcaggaaaaaggagaggcacataccttggacaaagtggttaaaagaacactatgcacaaatggtacaaaagcatcaatcaattgggtgcttgtctgtttgccgggaggtgtattgggcagaaatcagaagcaaggacagaaatgcactagccacaaatatagcatcaaaccagcggtggtaaaagtcaaactggatatcaccacccaaaacatctgtaatgatcaccctgtgcaaacaggcatttaaaacatcaatgtcgacaatagaatgcttttgtgatataaattacaagtactaccaaacacaatgcacagaagattaagttgcatagctccattttcagtcaacagtcactattcattgttatcttcaaaaccttcacataaatatttgtgttttccaattcccaacagaggcagattctaaacaaaggagttatgttccataactttgtgtatacctcagcaactttaggatcatataaacgcaaatggagaataaaaaccatttatatgaacgaacatcagtttggatatagggaaagacaccctcaagcaatagagatatacctatactcatttgccaggcttttccttatgagaagaatagatgatatgaagtacattcccatgatctcagatagaaaaaggacaacattggttgttgaaccactcccaactctagaaacagcaaagaagaactgcatagaaagtgagacaccatagaattgcgttctaatgctctattaacaagggtacagtaacaactaacagctgtatgtatagataactgaaagaaataactcaccttcataacatttgccaagaaacctcgaacagatatgacaaccaacatcccgataaatatgagagatatatactgcaacaaaaagtgaacaggcaggacacatgtaagctatagaacatgaacaaagaagcaaaaaggaaaggaggtaaccaggttgcatgaaagtcaaaccaagccaattcaaagcacctcaaaattaatgtttaatctacatatggtactttatggaaagagccaaaacgcaaaggacatgccaaaaaatatctgtatacctattttatgggaattttgaaaattgcttacaacttacatagcggttccaattaacatcaaatgtacagagaactgcagttcagagtaataatgaatttattctcgattctggaattgttcaccttttaattttagcatgtgtacctgtgataaaagagtgacatcaataccaatgtcaaaatgcctcaagaagatggtaattgtcatggttactggatcaacagaacctgcctggaaaggggggaaatagtatgtaggttaacaatggaaatttccagaattaggaaaaaagaaacaagcaattggtttgagtttgacgaaggaaagaagtgattttacctctttaaagacaacactctgcaaggactgaagcaaaatcaagaaaaagaaatgtaagatactgtccacaaggttgattacaattgagtaaagaatagaacacaatctcacaaaacaaaactgtaacacttggcaaccagcatatggaagccacacaatctttttaatgacatgacgaatgaattgattaatcaactatttctgtagttctagctttgtggtcttgtcagggctacatataggtatgtggaattggtgaaatgcatggaccaaaaaaatatgccacatttagtaataccttgagcatcttataaacacaatacactgacaaagcatatcctagtagattctgagcatggcctctccaagttcgagaaaacgcagcagctatctggaaaaatgaaaagaacggtgtagaaaagtttagctcatatattcaaagaagcatcgagaaattgtgcatatagaaaactctaaagaaagaaaaaaaggagacccattactgcagtaaaatgatgtacaggatataagagtccgcataattaaaatgtatgtaaccaaaaagaaatgcaatcttattgaatgattctcccagaaattataagttctcagatatatgtcagtgccttaatgcgaaaatgaaatgaaaacatcagccaatacatcagaaatcaccataatggaaggaagttatgctaatctatagggagaaatattcacaatattcaattgtaaggtacaataaccaatgaactttagcaagtggtgtaacatttatgcggctgatccgatttgttgggatagagtaacagttctcttactatctaaccaaatcaatgttaagtagccaacaccacaataaagcaatgatggcaaccccatcacaatcatagaactaaacagcacaaggttaagaaagtagaggggtatgtcctgccaatcgttttcgttttcaatcttaacattgtgatgaaaggtgcaaaaagtatacctttgcttgacggagttcatatatctcaagaaatagttgtttggaaagttcttctagtgcctggacctctgcatccaagcttttgatatcttccaagaaacaaatagggcttcatgcatatgactgacaagtgaaatggtgtaccaaacaaaaacagaaagaaaataaatacaacataccctgctcagtttgatcttcttgcacagatcgaacaactgtcccaacgatacgctttagaaatgatctggcttttagcttctgcaagtattaaattttgtattcagtcaagccacaaagggtaaacatcaacataataatagaccattctacttccaagatgacattttgttgagttaatgtgatagtatattttgcattgcttattgatagaacagatccctatcccatcaatctcgccacatgcagacaattctgcatagtacaatcatatgcatttagtacttcttattaattgaacagtgtcttatctattcaatcctactagatgcaagtacaggcaacaaaatatgactgcatagctaaatatctgtacattttgcaatgagagcaaacttccatgcttgcaatccaacagttattttaattcacatccatttgaatagtaagcacacctcttctgatccttgaatcctctccatctccattttggacagaacaattttctttttcttagcgatgcatgtctccatggattgcatgagctgcctttccaatgttttgatgtccttttcatcaatttccctgtaagccaggattggcacgcatagcatagaattaaactgaaatcaaagcacactgtgtggaaatacaacttttgagagagatcagcttataggtatatcaaagttcaaacctgataaacagtgacagatagctgtaaggcagattgacggcaccaaaaccagaaagaacagccatgacacttactccaatcacgccaatcctactaaccaactggggcatcgtgaaaaaccctacaaaatgcgcaagccaatcgaacccaatcacaaggtagtccagtcgtgaagtcaatgagggcctctgaggccaatatcgtaagttactgcggctaagctcaatccgctagtattgagagtagcaaccgtcgccatgattgcaacaccatacctttttccggagaaggcatggggaaatgaatccccatgcgccagaagccatagaggaagaccagcaggaacagcgccgcgacgagcagagcccgctccctccgcacccctgcgaagccccccaaaacgatcagccgatcagaccaaccacggaacgcaaaaaaaaaaaccgatgagccaattgaggagacaggggattcgggatgggcaggcgggcacctgagttgcgcagcagcaggtagcagtggtagtaggggaggacgaagacgaggaggaggatgaggcagaagaggtcgaggtgccagttgaggaagcgggcgtgcttggagaggacggggaggatctcgaagaggacgagctggaagaggttgcaggagaaggcgaagacgaggccgaagaggatctgcaccagcgcccgccgctcctcgtactccttgtacagccgccggttgaggaaccacagccccgcccagccgagccccaccagcgacgcccccaccacgccggccttgtacaccaccgcgccccaacccattcccccctcccccaccccacctccacgcctcgcgcgcgcgccggcgccggagccggagatggatctcgcaaggggaaaaaccgtacgcgaggaggtcgccccttcgcgtgaatctgccgtgccgtctcccccgcaccgccgactcctctgccgcggtgacgcgcagcctcgtaggccgggctggatagcctcgtcgtgcagcccattacagttgggctcaaatggctgttagggcggacgtgcggcccgttttattcgggccgtcacgggattgtggtttatgtgtgggccgttttagttgggccaggaactggattgcggcgaacgtgcgggctgcggcgttgtggttcggcctatctgcagagtcgctctccgtcaggtctggggctatcgcgtttcacgtgcacgactaatcgcctggttcatcgggaccagccaccagaccacacgcaaagtccagaacgcacaaacggatggagagttacaatctgtgccggtgccacgaaacgcaacatgcctttctcctgtagcttcccttcttccgatccggtggtcggcaggaacgcacgcagcacgacgcgccagctagaagcattctagataggcacatatacagtacatggatagctataacacgcctcactcggggggagtcggggaccggccgaagcgcgcactatctatctattcaccaccaaccgaacccccgtacgtccgacgacctaacaactggtccacgactcgtcacgagcgcgcgcgacgctaaacttgcttggcccgcgcggcgcgatcccggccggacggccgcacatgccccgcttgcttctgccgggagatgcgagaccacgcgagccatctccaaaagcctaacgctaacggaatagcatagcatagcacagcacggggcacacacaaagacgagatgctgccgtgtgtgctccgtgcaaagcgtacccccgactacgcctgcttccgagacgggcaacaaagccaaagccagcgagtgcatacgcactttgctacggccccacgtacacagagttacagcctgttgctccaccaactccggaggctttgcggcagatccatcgcagcattattgcgcgcttttccttcctccctctccctctccctccaaaagtctaaacaaaacctctcccgtcttcttcgtgttcgatctcatcatcagtgctcgcccgtgaggcttcctatcgtgtccccttcggtctcaacacgccaaagcaaatcataaagaggcatggagaccggacatggagaaatggtgagcgcgcgcgcggggcaaaagatgtcaatttcgccatgccgcgtttgtgaatttgttagtagttcgaaggattgcacgggaagctgttttgcgagttagctcgcggatcaggggggctttgccgcctcgacaaagcaagggatcactactgtaatactgttccagccatgtgatgaacatcgcatttgcgtgtcgtcgtaaggcaatcaattgtacgattgatagggaaaatgtagaagtccgaaaatcaagtacaggtggttctttgaatctttgtcaacttgggttaacagtgaaaatgagcgagacacggattgatttgatactcaaaatgaggtttcgacatcaagtacaggggattctgatcgacttggacttcatacaattccccaataggataaaacataacaaaaacatagaagagcattgctcgaaaattacataaacatattaatgcggtattgttcttgctttgggaaaactaggcgcagtccaggactccgtacaattcagcaaacggtggtcagcgcttcattgacacgtagggatccagatgatattcactcatctgcaacgatttgaagatgttcagaataaaactgttcttcagaattgatgaatcaaaatggaaaattttcacgcgcatttaccgggagtatataccgttgtgtgatcgtgagctggtggtcgagaagtcagaggttgccattggaatggagatcgagagctgagtggcagagaaggtggcaaggctgttgtcatcagctagatcaggccaggagtcccttgcctttggccactcgtcgaaaaaggggcgcagcgtctggttctcctgcttcccggagtcgacggtcacatagtcgctcccgaagaatgacaatggctccctctccaccttcggcagcgagcagatggtgttctggtccagctcactcagatttccaagcatagggtagctcgaaactgaaaatgtggaggtctgagaaggcagcaagcaccacgaattgtcaatagaggtatccatagctccagtgatgagtgggctgtgctcatctgccaatggtctcactccataagcagaatacctgaatattggaaaggcagaaatcagtatatcagtaatccacagaccaatatgttccaccaacaaccaagcatttacaactgtcatttgaagatgctaaaacagcaatgtagaagaacagtttgtgcaaaatatgatgtgcaaaaatgtataagcaaattagcaagaacttaaaacaagttctgagtgcaacctatatatacacatgagcagtccgggaacatagttcacaagtaacaactgaaaaaggataaaaaaaaaatcaattgcaaacgtttctttgtcaaactcagagaaacaacagatcggttccacatcgatacatgataatataattgtaacaacccctacttgtgaataatcacatagggcatgcattaggcctcatgcctttacttaaagcatgacacgcgactctttgactgagaataacaagtcaagggagacgaaaattgttgcatcacattgcttcgtgacaaaagtgaaaaacaaaacaaaatgggaaactaaccatctaagcaaacatgattggcagcagcaccaatcatgtgccaactgccccgcaggtaaccctacagtgacagagcttcactaaagtggaattgcaaactcgcaaagtagtaggagtactgagggaaaaagattcagattaggtgggcaaaaggagatgggcttccggtatcatgttagcctttttcagatggtttcaggcatagggacgaagcgtttttggtcagaaagtcaggagaagttttacaggtgcagaactacccgtgtttctagttcagcaattcagcctgaaacgagaagcacaagaagaccaacagcagtcagcagaagaataaaagaagcagaataaatgccaggtctgagatcgagcaggtgcagagagcaccagacactagctctgagcatagaacccagacaagttgcaacttttagttgtactcctatgtttgcaatcacacaagaacacagcctgctctcctgctctacccttgtatgattccaccagagcaccaacgccatttccaggaactaatgctacgttcagatttttatcaggcaaaaatctggtcccagaaagcatcgccagagcccagagaaaaggaggagcctaaacacagttaacagcagttcttgtgccagagctgacgacaaacatttgaagtaaacagcgccccatgcacattttcagacgagcacttgaagtgctagtagtgatgctgcactagtagtattcagatttaccactagtgtctgcagatgcaatcaagcacaataatgagaaaacttcaaacactattaggaggcatccagctctgctgcatccatccatctgacatccatcatgcagtagacaacaataaacagtaaagaaagtttgcagaaattttaattgcaccctgtacctgaaatctttgtttccggcaccagcagcaacagtcgagtaagacgcagcattgtccatgtgcagctgagtattagaccccaaggcgaacgagccaggcgcgctgccgccaccgccaccaccaccaccgcctccgttggcgccgccgccattagcaatcgccgggtacagcgagtggttctggaaggcggtggaggtgacggcggcggccggcgccgtggcggggggctgcgagtggggggcgacgagctgcgcttccacaggctttcttgaacggttgcggccgcggtgcatgtgtcgctcacagtacttggagtccggcgcggcctccttggagcaccgccacttcttgccgtccgtacgccggcaccgtccgggctccgggtccagcttcttgccgaagtaggaaccgtatccaactgcagaccaaccaagcacgcaaaaaagaagaagaaaaaaaatcacaagtcaatgatgtgacgtgcgcatctcgaaggcatccaaatccaccaacgaacgcatgtgtcggtgcgcatttggattggagggagcaatcctggaatggaacgctttacagccagatgcaagaatcgaatggcgatgcgatgctaggcgtctgttcattgaaatcaatctggcggcgcggcggccggaccggatggcggccgccgccgtgctccgtagatctactctactcaatcattcacgcccgcaacaatgtacactgcgattaaaaaaaactaggaaaagatagggacttagtactcgtttcttttggttgtttaatcttggggtccatttgatgcagtacagcttgcttaatcgcagcagtaatgaatgcgtgggtaaggctcccaacaaccagacaggaataacccctacgaaaaggaccaataaactaaccacctcttttgcctggggtcaagtcctgtgtgcatccaatcaaccggactcgaataaaaaaaactgcactaacacaggaggctaagctatctctattcctaggagcaaatcttgaacttgagcacaagttagctaatctggaatataaaaacgcaagcttttagggggctaaatccagcagaggattaacaaatgaccagaccaaattaacaaaccggggccaagtacacctgaatccctcgatccgaataaacaagcgagacaatcatgtggatgcatgagtagtactactactagaggagagtgagacggaggcgaagggcggcggggcacgtacggacagggtggtggtagaagcgcgaggcgagtgagtcgaggccacggcggatggggaggaggagatccgccgggacgggcacgccggcgacgaggtacttgtatatgagcgcctgctgctccagctcctcgtactgcgccgccgtgaagggcggcggcctggccaccgccgccgcccacctcgcgcccatcatgtgctgctgcgcctcctccccgaccctgcaaccgcatgacgccaccacccacattagtccaccaccacggcagcaagaacgaagagagagcgaaggcgagagcgaaggcttacgcggagagaggggaggagcggcagaaggggaagatgaaggagggccggtggtcggctgccggcgacagggaggcaaagggcatcgccatatatgctgccgctatctctctctccctcacacacacacacactctctctgtgcgcctctctctctctctctctcctctctgccgcttgcttgcgccctctctcttttaatgtgctgtgcttttgccttttacttggctggtctgtgtctccttccctctgtcccgcctcgctggtggtggcgccgtgggctgtgtgcaagctgatgcgagcgaggctgcaggccggctctgcctgatgaagggagggaggagggggggagacggggacgaataacgatggggctatatagccggccgggtagctaggagcggtgcgcgggggtgggcgaggaggccgacacgggagggttccagctaagggacaagcacctgcgtcttgatcggtttcttacctttgggttcgcgtgctgctcgctttcagtattcggttttgtgggagtggattataaacacttaagaatgtcctctagtatcttatatctcatctgaatagttgttaaaaattttaatatttttaataagataaagtactctagaaagatagaagtctaaatatgatagaagtctaaatatgacttctacatgttgtcgcaaaaagataaattaaactttgattactatgcatatattaatatacaccacatatttgtttttttttcttacaacatagagagttgtattgatcattgcggagtaatacattacatgtcttgttagctttttaacagccggcggtttaagattttattaaaaaaaatgagaagaaaatcaaacaaaaaaattactgaatcaaagacacatcacataatgtacacctatgtataagttttcgatggtgcacttagcatcatcccctaagtcgacgatatagagcctaaggttgcgttcgtttgtgtgatatagggtgagaaagcacctcgttttccgcgcgcacgcttcccaaactagtaaacggtgtgtttttttaaaaaatattctataagaaaattactttaaaaagtcatattaatccatttttgaaatttaaaatatttaatactcaattaatcatgcgctaatggctcacctcgttttacgtatcttcccaacctctccaatctcctcctcaaacacaccctaagttgtgtttcttgtcaccatcaacatacaacccatcggtgtcatatttcgttagcataggattccctgcaaggattgatataaggtgagtcaatgaatcatccaacgattcagataaggccgattttcaacggggacataagcattatgtagattgatgatttcaaactctatgttatcttaagatagaacctaccgtgccgatcgctatgccacggtttatgatatttatgggacatatttggatcagatatggagttaaagatttgaccatacatgtacatgaaactagggtggaggtcatgtttaacacaatattctttgatgagcgtgtgaaatgcttttaacaagttgttcttttattagtcaccaatcttgaaataaaatcatgaaaatctctactcccttggcttcatgtttattagtaggtgatagtgcatgtctgtattggggtggagacttaaatggcctaagttccacacacttagctcgccaatgtccacgcaaaaccctaaccaccaacaaacttattgaaattagaaaaggatctgtgaggatgacaagtaggaccaagggacattaccacatgagtcggtgttgtgttttcgttttcagggcccccacttaatcgttggagtggaaaaacgaaaaaacatgaacaaactaataactctgacggaatgcaagtgcaaaatagatgattacaaaatacataaataacatagaaataaccgtttctttggaacataggaaaaaaacaaatgaattagatgagagtgataaactaaaaaatttcaagaggttgaaactcttactaaatttattcaaaatccatatatgattgttcgttatgtaagaactttaaatgataggatataattctatcattttaaatctttattgaaattctctaaatatttctattttttctataaataaaaaaggtcccgtcagtgagcgtcatattaacacatcagagtaaactgtgtcgttctttttttaaactcttgtgtcgtgggctcgtggctagctgtgttgggttcaagaaggcttgacgttacgttacctgaacatgcatggcgcacgcctattcttcacctgtaaaaggacgttgtcgatgttttcatcaacggttgggcggaactcctcctattattttatctgttcaccgctcggtctttaattttacagacctgtcgagaaagccaaatcggcgcgcgtacgggcttcacgtgcagcggcagcccactcaccgtcaatccggcagtgatcacaagcgcacgactcctaccgttgtttctttcacacacaagctgctgctgctgctgctgctgcgcttgtgcgcgcaggcaacgcaggcggacggtcaggtcatcccagcgacaaaacacccgcaggcgaaggcatgcgagatatcgaccaagcagaggcaggcaggcgagcatgcattgtaactttccgttgccttacggcttatgcaacggctaaagctaagcccttgctttttggtggttccatgctttgcatgctgggaatgaacatgtgcaagaacaggatgctcaccgatcgatacgccaagttctgtcctgccctgtttgatcacattagtacacacggcgccgttggttgaaatacacaggattttctcccgttgtttgatgtacaacaagtgggtagctgtgtctatagtccagtatgtaaagcactgttcatcgcagcatcaaccagacctgaagtacacccgaccagattgaccagactcgattcgcggagctcagctgaggcggtgcagccgaaggggacgaagaaaaaaagaggaataaagccgggaacgaactgcctgccctgcacgcatggcagcgatgggctctttctttctttttccgcagaaattgcgaagaaatatctgcaatgcaagtggataagagaactggactccggcaaatggcttggtagccagctttgggttgggatgaggaggatggtccagtggaggtccacggccacctcgccgcgggaaggaaaggataatactagagatggcaacgggtatggaaccaacaagttttcactccccgtacccacacccgttaaaactaaatctgcccactaaaaacccacacccgctcgcggatgagaaattccctcctacccgcacccgcacccgcacgggtgatgggtacccatttgatacccacacccgttgcaacaatttcaattatgcacaacaataactcaataaggttataggctgcagacaaaattaaaaaactaaggcttaaacaaaccatacatgatacatacagcctgtcacattgcaaaatcaacagcaagccatctctactcatggtcacggccccagccagatccagtgacctacctcattgcacctgtggcagcgctctgaccggcgcgctgcgtccctgcccccaagcagcgaccgacgcggtggctatcccgcccccaggaagcggcgtccctggctccctggaccttgccccaggcagcaactgacacggtggatgtccgcccccacgctggtggctgcccgcacggcggcgccctactccatcggcgcgaccgagaccggctggcggctggtgctgcggccgtgcgcgcctgcgcggtggcgtgccggcgtgtggcgtgcgcccgtgcggtgcggccgtggcttgggcacttgggggatggggggcggcggagaaacggagacatgagggagaggataggaggagaaggggaatagggtttagaggagtgaggaaaagaggatttatacctagggttttgatggttgtgggccttaggccatctgcatattgggctaggcctacgggtattttcaacccacggttaatgggttcgggtgacaggagaacgtacccacacccgcgtacccgatgtgtgaaggttttgcccgttaacgtactcatgggtatgatgtttggaacgtttatacatcctaaaagagtaaaaacccaacggttttcgggtcgcggggcccgttgccatctctagataatactagtagcacatcatgcacgggatcagggcacctgtacgctacgggcccgtgcatgcaccgtgtcgcgcgtacgtctcggctgcccgcgcgtaggtgtccggctacggttggtctttgctggacagctggtgcacgtgatggcccgggagggggcatgcctcctccccatcagtccgtcaccccatagctatagctgtagacattcctttgtctctcaaaaaaataagaatggaaaaagaaaagcgttactcgtatcatccatcatctttttcttcatttttcacgacataaaggatcgagtttgccgtataatttgttttccacgccaagcatgatacgtctcggtgtgcgactataggtgtatatatggacacgttgcatcttgccatgtgtgaggactcgatcccaggtctaacaagtcacaggtccttgtacagtgctcaaacacctccccgtctctcgtacacctaccgcaccatttttccctgattccgtcgacgcgcgccgcggtgttgctttctcgcaactatatttgcatcactagtacatgagctcgaaaagcgaaagtagatagtttgtggcatttgagccgcgcgctctcattttgtggacttgtaggggacacgagaaattacgcagaggcacaagtttccacggacagttggctcgttaaatccggcactgttggagggtagccggaataatctggcctttagcaattgagggctcttgcttgatgtccagctgttctcctccaacgtgggaccgatgcccacaccttgcgcactgtagtcaatatagtccatgggacccatcttgtggtatgccttcttgagacgcgtcttcgatctcttctaggctgcacttggttcaaccgatcggtgcctcggtggccagtgcacacgtcgagtccacgagcaccggcgcatggaatggttagtggcatatgcacgtcttcttcgaccttttcctcggcatctagtagctaggggtagctctcggctggcagtgggcgagcagccggtgaacgccgcgcggccgccgtcaatgccgtgcgtcacgtgccgcacatcgttcgctcgcccagtcagcgtccgcaaaactgtgccgggccagcgatggtgcactgtacgtctacacataatacggcacgcacgccagcggcggcggcggcgttgctgctgttgcatagcagtggcggttgtttgcggcgaggcaagggggaggacgctgtagtgctgcatcagtgcgtcgtggtgcccggccccccatccaaaatcgtcaataatgcagagggggtaaaccaaaccttacccaacccggccgcgcgcgcgcgacgctgcatgccggtgggtgctagcgggcgcggggccaccgcgtcacgtgacgcggatagcgattcgagtgtgtgtttggggttggttgcgttggttggatggggcaccccgggggactcggcgttgtgcctgttggtgcgaggtttacctcgtttggtatgggaggggacgaggctggcgatcggatggaggcgggtgcgtttgtccccgccggccggcccgcgtcgtaccgtgatgagttgcccatgcgccgacgaagagttgtctccacgactccacggtctcggcgggtcagctgattttccagctgatgttatgcgtgtcgtgttaggagtgttttcacttggatccccgggcccctcttaattctaacgtccgagtgaaggtagcacccgagaaaagtatacggaaaaggcatagagagggaaggacgattcgctgcccctttgattcgtagggtaggaaaaacacatgaattaaagtagtatgtttgttaaatcctacaagaataagtaaatacataataggagtcatttaataatgctatgagaaaaacaaaggaaattcacaaagagatcatatcccttgctatttttcctatgaaatgtgaagcataggaatacaatctataggattttgaatcctataaaaatcctttgccaatcctataaatcaaaggggtcttaaggccttattcgatttagattattgatgattgaattgttgtcatgaattactacttaattatatggataaattataaattaaatattttttaaaactaagattaataaatagttcgaaacaagtgccctaaacaattcgatagaagacttctattttggagaacattaaccttttcatttcattaagaaatgggagagtttctcagggaaaaaaaagtgaatcagcaaaaaaaaaaagagggtgcgttctatactacgcatttccagtttgtacacctccttatttttcacgcacatgtttctcaaaatgctaaatgtatgtttttagaatatctgtagaaaaatttatttaagtaattatataaatatattttaaagttttttagttaatatctaattaattattatgtgctaattttatcgctctgttgtgcgtgtcaagaggtaaggtttccaataaaaaaaccaacacaagcatgtacgtctaagatctaaataaagaggaggccagcagcgggaggggatagggatcagctctttggatggtaaagacccagttacctcatgcgtttgcgtcgcgtggtgagaaagctgtccgtctcgagtcgcaactccagtcttgaccggacgccccacgctgcagatctctgcaatggtccaggctccaagtgcaggacaacgtctcgttggcacggcaggcgcccccaatgtcccatggcacacgagcgcgagtcgagccgactgcgaactccccagaccaaactgacgaacagtacgacgcctacgcgcgcagagatctcgtcaaactcgtgcacgagtctagccaaaagcacaaaggctgcacgcgcaaaacgtcacccggccatatgtacgaacgcacgcacgtacaactgtagtaccacgccggtacacgcctgtgatttatctggttcgcgcgactgcgcgtgcagcggaaacacctgaaaaatcccactacacatccgggcgcggtctgcggcatgcatgcaccagcagtccagcaccgcccatgcaatcagcgctgcgacaccctgcatgcctgcctccctgcggcaactgatgacatgaatgaatcgattggttttctttcccgagtcaactaccaaagcggagccaccactgcccatggaggcgtacgtagaagggcaggcaatgatactagtactctctcaatctctgtactcccgtacatacgtgttaagtaatgtagcgtccaagcaagcgccccctttgcgccgtagtacgcacactcaaacgccggtcacatgcagagttcgtggtggaggagatcgatcaatctgaaattttgagctcaggacaagcgaggagcgtccaaagttttcacagtggacactgacccatttttatggaggtgtgtccaaagatctcgagtggtaatagccgctacgtgttcacggggacccgggcagtgatgagacccaaaacgattttgctaaatatttgtcgggtgatttttttcataggatttgacgtttttctagccgcacgatgttttccaagatttgcgcaaaagcagggtcagttgagtccatgaccgagtcaacctgactttgtattgatggatttctgtacatcacgcatatcaatagccatttatttcttcgctctatttctttctttaccaaaatttacagtgcactttgtgcacggtttctcaagcaatgtatttgtactaaaacgacaaatattctagttaacaaaatctacagtgcacttgtactaaaattacagtgtacttacatgtcatatctactgtttttacaaatgtaattttagttataaaacactgtaattttagttataaatgtaacatttgtgttaatctttactaaatactactgtactaacatgcacaatcacaggctatctggacggtttatctgtactgttttttttttaccgttggatgcagatgcgaggggagaaaaaatttggatgatttttttcttaaaaatcacaagacagatgtctagacagtcccgaggcaaaaaacgccgaggagatagcgctgcgagaagcccaggccccaacgagctgactgaccagctcggcccagtccgggaggcccacgcgccccggctttaccagacagcacatgcacgtgacggcacggaggaggcaagcgcttcacggccgctctggccggaggaccagccttgctcgtcacctcttgcactgaccccccgggacccacctgtcagtgggcgtgcccatgaagaatctagctgtagcagcacatcagttggtgattttggtgaacttctcctctattttcctcacttatttgagattcagtttcctagagatgtacatgtagggactaggggaagcagttcgagaggactcaaagaaggcggcgacccaagatggccagctgaaaacggacccaaacaagtcagagagatctgcacccccatactgaggggctgtttagtctgtgaaacaaaaagtttttagtgtcatataggacgtttaaccggatgtcgaaagaggtttcggacacaaatgaaaaaactaatttcataactcgtttagaaaaagcgagacgaatctttgaacctaattaattcatcattagcacatgtaaattactgtaacacttatggctaattatggcttaattatgctcaaaagattcatatcgcgatttacatgtaaactgtacaattagtttttctttttatctatatttaatactctatatacgtatccaacgatttaatgttatgtttttgagaaaagttttttttttaactaaacagaccctgaggaagaaaaactgagtagtagtagtagttcatacataggtttgtccgcctgccgggcacagagagacttgcacccacaaatacagcataaatgctgctagtgccactgtgcgtacaatagagatgtaaacatacaaatgacacagtactacagtacgtgtttaaagtagagtagagtcgtagtggtagtaactgatcgatcagcctctacctgcataagctttgctcatcagtgctactcaaaggcgtacagtcctttgtcacatggtgcattattattctcttgatgcgacttgggaaaccatccatcagcatcgcagcaccaacaggcaacagtaatggttcccaacgacttattgttatccctttcttacgcgcgcccagctacagctagcaagttccctccagatctcccctctcggtggcaaggcgtgtatcgacacctatcacaccctatgccgcttggcccatgcttccgttccatcagctgccacagcacctgagcctcgttgataaagctattagcacatcttctagtagtagtacattactagtggctggtagtgttatcaacaacctttctttcccttttttcacatcaagaacttggacaagaactaaagcaacatgataccctacttgggcaataaacgaagtggcacagcacacacaatgacaggttggagactaatggcaagtccaatcaaatcatcaagctacggcaacatgggctgggcgctccaacgggggccacccacgtggtgcaaagcgagcacacactgcaacgcccggggaggcgtacgcgacgcgagcgcgaaaaggaggcaaaagttagttggaatcgctcgctcgcctcctcggctcggagcggcaggtacgcgtgccgccgatgcgccgacaggcttggcctgtttgcacttggctcccgatcgatcggtttttgatgaactattgagctgtactatctgtgtgtacccaccaggcccggccgggtgttagctaggtctacatgcttaggaattaagatactcctgctgaaactgttgattggtgtaaatggtccacgcatcatccatgtacatccacagaggtaatgtgccacgcctcacgcgtcatgatccaatgtagcgtgccttttacattccgtgttttgaaaaggaaaaaaaagttttatgcatggagagctaatgaaatattttcactaaaatatggcaccatatttacgtactccaattaacatggtactatatttagtaggatttggcaccgtaaacagtgtcatgttacgaatatatagctccgaatgtaaatggcgccttataaattaagggccaatctctgtaagaacgtacattagtgatttatcttgtggaaaatgcttcagaacgtggaaagcttctgtatagcacagctagcagatcttatttgacggaccactaattcgtgtggactgcggagattactcttgtttgagatgtgcaagacaaaatgatgtggatgaacagtttcgtacactgtgtcgcatttacgtgtaccccacagtcccatacgcgtacggtatgtccatcgcgtattttctgttttcatcagttggtcatgttctattttgtttctccaactgcaaacatataaaatgggcttttccccaggccccatttgggtctctcttgattaagttagcaggccttggctagctaggcttagatagaagtaaaacaactaatgaaaagtctatatcatctaagcccttatacctccaagtctccaactataacctgagtctaaattatacacctcaaccccaacatggcaccttttatcaactgttgctagtaagtatgttacctagatatggggatacggatacggatacgcgatatgtggatacgggcatacgtcattttttgaaaactaaggatacggggatacgttaatatatgtatatataaaataaaaatatagaaattaaagaacttttgtagtaagaaattgtaagtcgattccattaccatatatcaatgttttcaagttctcttattctctctcctagataattcaagttggcgaagcaattaagcttgcctactgccaggccagtagtttagagaaaaatcaccacatacaagtttattatcatgttggttataaactgataaatcaactacacaagtagcagcacgccagcactaagccaccaaccaaccaccggatttcacttatggtagttcaaccgacacccaaacacaaacatgcagtgatttactcacagcctcacaggggaacaaaggaaaaactgcttagtggtcttgtgcctgctgctctgcttggtgagttggtggtcttgtgcctgctcctcggaggtggaggcgctactctgttgctggccgcggaccgcatagacggctgcgcgcggaggcgttgttctggggacggcggccagcagcccctagcccctgacgtcggcggcggaggaggatatgcgccggttgcaccgcgggacggtggggctggaggcgcagtgcccgccggcgaaggaggcgctgcggctgcgcagacggcggtgctgcacccgacgatggcgacggcaaagacgatgtggggagaccgggagtgagtcgtgggaaagtatgggcgtatcaatacgtatcagcaaagtatccgtaattctttcatttgtttgaaaatcgagaaaatgtcagatacgtatgggatatgtatcggagcgtatccgtatccgtcggcgtatccgatacggatacgcgagctcagcgacgtatcggggtaacgtacttgttaccatttcttttactcacttaagaccgcattaggcagcaacgcgaagagaggaaaactgtagcgcccgttccgtcgtggcgcatagcgggaaaattatctcttaaaaaccctaattgcgaaatttgtttctttgattgttgtctagtgtccgtgccatctcaagatctcaatccccgatctatcgtcgagttcaactccgaatccaattccttccaaatcgaatccctccgcaaaagtctagtttgcctccccaggttcgatgggccgaatctcgctcggcccatcttcccctcttccccggcccatctctccctctccccccgggcgctctcccgctctctctctctctctctctctcgcgcgctctcccatctctcccccccgctcggcctcgcccgtacgctgctcgcgcgtgcgagagccgtcccgagcgcctctctacccgctcccccgctcagcctcgcccgcacgccgcgcgcgcgtgcgcgtaagccggcgcgccgagcgcccccttcctttcccctcgctctgccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgtccgtcagccctctgcacgcgcctgtcgccagtgtcgccggtccgctccaaaccgccccgccgtcatcgccgtcgtcatcgcccggcccccgcccctccgcgcgcaagccgccaagggacggagccgcgcccctcctccctctgccgcgatgctcccgttcccctccacctttttcccgaatcggcaaaggggcaagccccctttcttcccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctctgccgtccttcgccaagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttaagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagctcccgaagccgcatagatgctctcaccgccgggaatcgacctctcgtgacctcgtcgccgtttccctcttcttccgccgccggttgccgccgccgcaatccgccgccgtcgagcaacctccggcgaatccgagccgatggctcgccttcccttgtcacgtgcaaccgcccggtgtgcacgcttttgcccgtatcaccgtggttcgctctgccgctcgccgccgccgcccgccgtccattcgcggccgggtcgtcgtctacctcccgccagcccacgtggccgccacgtaggcgccacgtcggcgccagctcagcctagaccggatcgagccaaccccggtcagtccctccccgtgcgcgcgttccaccgcgagccgtgaggctgcgcgtgggcccgccgcacctgcgtccaccgcggaccgcgcgcatgcaccgcgtctcgtccccgcccgcgcgcgtgcgtcgcatgctccctccgcacggtgagccgagccgctgacaagcgggtcccacccgggaccgcgcgtggtgagcccggtccaccggactctctctccttcctccgcgcgcgcgcttcttgggccactctgggccgccttcttgggccagccggcccatttagctcggccggaccgctccatttctcttgggccgcgccctagccgcccgagaaaagtctataatccctccctcttttcttttctttatcttttccaaaaaaggatttaattaaatccttttcctttagatcaaaaattcaataatcttagaaattcaatatcttcccaaccgtaaatccgtttgactccattcaacttccaaaattcctcaaatctcgagatctatctaatggcacgcttagaggtcgttaatagggctttattttcgccgtttgttgagttgtcccgtttcgcgtgtagtttcagagcccgaagacccgcagtgcgaggattttgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgttgacggagctcgtggctcctcatcgggagaccgcgcaggcccccctttgccagttcggccgggggcttagggtgagatctcaagctctctctgtgtgtggaaagatcacgtgcccagaagaaacgcgagacacggacgatgtatacaggttcgggccgctgggaagcgtaataccctactcctgtgtttttggtggatctgtgtaagagcaagttacaaaatatcaactagccctctcctcttcccggaaaaaatccagcccccttctctgtgggcatggtcctccttttatatcttaaggggataccacatgtacccttccctttccaaactggacttttcttctctttatggacggagattggtatggttgccgtccgaatgacacttcgataggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagacgcaataaatgcggttaggtgagccctatcgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcataacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggttggcgagcataattaacgcacacacgatacgatctatctcgactaccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgccctaaactctctctttgctgcgcctcaccttcgccacacacactcgttctcaaccctctctttctccggcgacatggcacggggctccgctctgctcgacggtagcgtactaccgccttcccgcattgtgagcgagaggcaggctgggctgccgcgccgcttcatgccggaatccgccaccggccgggagatagtgatgctgggcgaggcacgcccagcaccagattacccggggcggtccatcttcttcctccccttcgcaatggccgggttggttcctcccttttcttctttctttatggatgttctggagttctacgatctccagatggcgcacctcactcccaacgcagtgatgactttggccatcttcgcgcacctgtgcgagatgttcattggggtgcgcccatctcttcggcttgttccggtggttcttcaccgtgcagtcggtgtcgccgccgtcggtggtcggcggctgctatttcctgccgcgggggccggtgttgaaccgctacatcccctgcgccctccgcaaaaagtgggatgactggaagagcgactggttctacacccccctcgccgacgaagcgcatctccgacttccgagccagcccccggtgcaggcttccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatacggacccaccagggggtcagatgggattgggcccccgaggacttcaagatactgatccaacgggtgctaaatctcaactccgtggaggcgtccctcatcccccacggtatcctccccctctgcagcgacccggatcgcgtctccatcttgaccattatgacgacggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaacacctcccccatctcctccccgagggggcggggcggcgcgtgccagcagcaggcgcccggagggggccgcgccaacatcgcagcccgagggggagcgcaagaagaaacggctgcgcaagatgggggggacagaaccatcccagggaaacctaatttcccctccaaggtggtcatttaaccgaccccctcgcaggttcgtcccgctctctttgcgaccgtcttttcttccatcccaaaagcaagttttaccttacccattttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggctcggcaggcggaggataccgctcgggaggaggccgcccgggcccgccaagccgaggaagccgctcgggaggaggccgcccgggcccgccaagccgaggaagccgctcgggaggaggccgcccgggcccgccaaactgaggcgatggcgtctttcgaggcagcccacgacaaagctgctggcgcgtcgcttgggcctactccctcgggcgacgctcaggcgacagcctccggggcggctcgcgacgaggccgcgggcggatcgcctgggcccgctccctcgggcgacgcccaggaccaaacgggtccgggggacatccccgagctcagtgcgtcttctggcgggccgagccgcgtcgcattttctccaaggcggctcttctcctcatcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgtgttgaggaggggcggcgctcggtggacgccatggtggaggtgggccgtaaggctcaccgccgccacatctcggagcttgaagcccgcaaggcggcgttggcggagatcgcccgagaggtggaggaggagcgagaggccgccctcatcgccaccaccgcgatgattgaggcgcaggactccctccgccttcaacacggacgctgggaggcggagctaaagaaaaagctcgacgccgcccagggggtccttgacgccgccgctgcccgagagcagcgagtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcaacggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctgggctacggtgcattgggtcgatttattagggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgattcattacccaaggttgacaaagattagatatcaagtaaacatggcacaagcgagcagataggtaatacctggatcccatgtaattagcaaaacatgcatatttatttgtaaacggtaaaacatttataaattgagatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctatagttaaactcgatttattgcgcaattattatttatttttacaaaggaaatggcatttgctgacgtcagcaaggggaaccagcgccgacaggcgggccccgcacgtcagcggcacaaaggggcggcgcatggtggaccaagtccacacgtggcctcgggtgcgcgtccaccacatggacggcccagatcggcccgaagccgatcggacggccacgaggcggcgcggctagggcacgggcacggcacaaggccggcctggctgagccatggcgcggcggcggcgcacgagagaaagcggcgacgcggcgcggcaagggggggggggggtccgggcggcccaggcgagcggagcggcggcaagccggccggccgacctaacagtggcggcgcacggcccggtggtcgcaggcggcggccaccggcgcggcagcgcgcacgggagacagaggagggaggcaaggtgggagaggaggagctcaccaaggacgcggcgacgagggatggggaaaggcggggaagctcggcgtcggcgctcctcggggcgaaggcggaacggcggcccggcggcgttccgcgagcgagaaccggcggacggcggccggagggaccggcgcgaggggaaccgtgttccggcgggatcccggccgtgaaaagcggcggccgaggtgctcctcggcgctgcgaagcgagcggcggcgacggcgcgaattggggtgattaggagcggcgccaagcggcggctggaagtggtaaaggcggtggagagaggtggtgcgcgtggcgacggtgcctcggaagcggggaggggaaaaggagcggatgccggggtagagcttggcatggcgttgccgacgacgcaaacggcgaggtgcggcgacgactaacgcggcagcagcggccggctgaaggcggcggcagcggggaagagaggtggtgctcgaggcggcagtgttccagaggcggagaggggaaatggagtggaggccgggctgcggcacggcgccgcgaagccgacagaggtggcggattggcgcggcggtgggtggagcggctgaatcgaccggccggagctcgccggaaagcggcggtgcgcgggagcagcgtggggagggcggtagggtggcgcggggagctcgggaaaacgggaaaaaaggaagaggagtccacggggattgattttatagctcaagggggcgaggagagggccggggaacggcggatttcgaggggaagtggggcggcgtcgtgggggagagagagacgcgggaggcggcgacgtggccggattttgcggggagagtggggggaaacggcgcggacgtgggcggcgaggtcccacggacaaacgcgcgcgcgcggggtggaggaggtgggcggaaacggcggcgacgttggacggctcgggcggccatggcggttgctggcccgggctggaggttgggggtgaccccgacaggtggggcccacctgtcggcggctcgggggaaaggagagaggaggagaaggttgggggggacgatgacaggtggggcctcgggtcccacctgtcggagagagagggagggagaggccggctggggaggcaaagcagacttgagggagagagagagccgagcggcgagctgggccgagggagagagagagcccgagagggggagggggaggaatttgggccgagcccgaaagcaaggaaggggaaaattattttcttttctttttattctaattggttaaatgaactttgtgctattaaattttcttcttgagctccgaaaattcacgaaaaattccggagagtattttagggcacaaagaatattgcaaaatattcccggccaatgatttttttaagggaaaattttaattctcccattacttcacttgattaaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcaaactgattgattgactggttgatcaaacctgcacgattgaactggctggattcgacctttctgttcctttgctttgcgaaaactagaccggctagttctgcttgaactgacccagaccagaactgtggctgctcacgaaacttacttatcttgatctgaactgttgacactggcagtttgataacctgacaattcaccaagctggctagagaagggtgaagctgttcctaagacttgcatctggcatttgtaactcattgatcctacgtccgcttgaacgggtcctggctcgaatgacaagtaattccaggaaaacctgcttaacctatctttcgtctgaactgcaaccatctgcttgacctgtctaagctaagcggttgaactggcctcatgggtgtaccttagaattcaatcggttgctcggggatcggcttaattcttctgataccttgcaacttgcttcttcaagtgctaccctgattgcggcactggttgaaccttcaactgaaacggcaacgaggttagccaaaactcatatgtgagacctaccccccttacagtgggtagtctttctttcgcctgactgagaacctttgaactgttgtccttgaaaaataaccaacatttctcggatttacagatgccttgactttgaatactgaaacttcatcggtccatcaaattgaagcaatggcgatgcaccttcatcccgacaagatttggaacttaacccttagttgatgataggaaattccacataaaagtgactctcatttagctcatgaacacactgactcttgactaactttcccataagtaataactactggcatgactgtccttcttctgacctgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattggtggtgacttagctgtgctggtctgctgaagacttggtggcgtactgtctgaggttgcaggtgcttgctcttggaaaacaaactgactttcgctctgatcctgattccggcttgcatctgagcttgtacttgttgtcggagacattgtcgttgcatctgctgctttggactctacggttgcggtatcaacatctgacacatccatcattagatcttggctagccaggatctgaccggagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcctggataccaaatgttgatcacgagcagggattcttctagcattgggagtaccttgtagctttcgactgatccattgttctgtgactttcatacaccgttgttgttgctcttctctctgatactgaccatctgttaccagaacggaagagaggtggaagagaggggttgctaaagataaggtactaaccacttgcctactgatatgttgtgagtacacttttattgttcaagttgcttaagcaaacaacctagtatggtcgcatccccaccaatgatgcaaaccatacccctgcacacaagcaaacaacacacgatctagaaagctaacggaactactcttctcggaaggattgggtttgggtcagcttcggggaaactt

SEQ ID NO: 78411 - DNA, 2218 bp, Oryza sativa
cctgcagccccactacttactccgttataaaatataataataaattattttagttttcttgttcctgaaaatattctatctatctcctaaaatataatagtttcttcatcagtattctattttgtcaaccagttaaagccaacccttatgccttttaatttcgttcacctaattaattttctcaactaatcatattcttttttaagctttggtccttcttaattaattttctcaactatttttttcttttaatttgtctgttgttcacactactttttctaacctcaaattttttttatatttcggaagagagataattctgtggagcttgcctggatgttgccacctgccgccaggcgtggagctgtcacctgtcacaagaacactcaatagctagtatcctgctaattaccagcgcgcgacgcaatcgctgccgccatcagcacagataattagcattaagccctgcccgatcattctccctaattattgcgagaccaagattattttagagtataattaggtgctactactgctggtattgtatcccaaccaacctgccggtgccagccagggacattgctcgctgccctgagcctgtattggcgcctaacctgatgaatcatatccatcagggtcgtcgcgtacgccgaccgcagctcgatcgatcgcacgccggccacttccacactggggattgtctgtggaactagggacttgtttagttaccaaaatatttttcccaaaaatatcacatcgaatctttagacatatacatgaaacattatatatatatatatatatatatatatatatatatatatatatatatatatatatatatatatataaactaattgcacagttaatcgtaatacaatttttttagcctaattagtctataattaactataagtgctacaataactcacctgtgctaatgatagattaattaggcttaataaattagtctcgtggttttcagacgagttatgaaattagttttttattcgtgtccgtaaaccccttctgatactgataaaacgtttgatgtggcacccaaaatttttttttcgtgaactaaaacaccctagcttgatcatctggaccagcggctgccaacgaacgaggagtcagtagaaaaaacttggtgttttcatcgctcttgtcactacgtgtagcctacgtatgttaacagtacacgaaagaggagagatatttacgtgcttgagaaataattttctacggtcctgtcgtttcgctcacgcttatagttattcttattcgtattacttgttagcaatcaaaaaataatttaagtaattattttatgtgtgtacttgatgattcagaattaaatattgtaaaataaactacgatgaacaaatcatgaaatcagcttttaaaatttaaattttgtcttataggtttcactataagtgaaatgataaggttgtacgtatcaaagctagggcatgttgtttttaaggaattgaagaatggaatgcatgagttattagacggtgtagttttcacaaagaaattttctgaaaaaaatggattaatacctgacctctaaatccaaacagttgtacacatgaaaagaaagtaaactgctttaaatttatattttaactctatgtggtcacaaaatcattcatctaacccgaacaaaaatcaagccctaattagagttaattaacgcaagttaattaatactactacatgatttaactcctcgttttaagtgagctcctgtgttttcttgctgttggcttaggtggactggtgacgagtcaacgactgacatccgctgctatttcctgttttggttttggatgattgctgccttcttgtcaaccaattatgctctgttactgttgatgttcacacgtccatctggtgtgatctgatttgttttgaaggagtctacgccacgatcatccaattgccctattgttgttgttactgtataagactaatgtgactcgtcagaagcgaagagctccatatctctgacggcatcgtataaaaatagtattatgtgttctctcctgttgtgtttttgttgtgttgtgccaaactactacttttcagcgtgacctaatcctttcgtcacaggttgtcaccagccacgagcacgaaatgataatgcatgtcattgatccttctcataaatcaatcgtatcttaaagtctgaaattaacgttttttttat

SEQ ID NO: 78412 - DNA, 2237 bp, Oryza sativa
attcctgcagcccttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattcgccgctgctgacctcccagcgttgatggcgatccaaccatatcttaccatatatccccgagcatccctgctaagagcaaggataatagtgggctataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtaagctatatgtttatctgaaagagaaagataaacaaaaaaatagggagtattggctctcatgcaagagttaactgcacacaaactccaagaaatatgcattaaattcatggtgagagaaagagagaggatgaagaaaataatgataaacttatagccaatttactatacatgttagctttaacattgactaatagtaagtagtgagctctactattaaacttgctctaatgctgccaatggcaacactgttagcttccataattactgcgcattatactgcctcatttgaccgtggattttttttctctgcatttctgcctcctgttcgtggccaaaaattcagacaacgctgcatcagacgtgttatagtactcttgttatttagtatttgacttgaaggtcatctaatctaccggtagagaggcacattcgtatgttgctcattatagtggtacacttgttggttagtggtaatgctatccagtgggcaggcagtggcatctccattgcttttcgccattattatcaccgtgactccagctgcttcaccatgtgatttgctgaccgtcatgttggtgcatgcatcaactcttttcccatgtgtttcttttcacataaattgatctgacgatcttcaagttgcttgcagtaatacgtacagttcgtttggtaaaattcagagaggtgtatcaatagtaggagtagaatgaaccttgtgttcagcttccacgcaatgtcctccgacatgacaaatgacagtttatgggactagatcaaacgattatctatttcattatctttaaaaaaatcgacggttcagtcaaaaagtactgcatttcttaggataaattactcgttattgttcgtcgcgatgtgcagatagatgcagtttagtttggttttgcctgcatccacggatgataggtacttgacagaacaacgagcactatgcgactaagttggatgcttcagttttacaggaaaaagagcagaggactgatgttgattcaacctgcagtacctgaggccacaacactttgcctaagtcatgggtcgttgacatttgatatctataattttctttaatctatagcgtcttttactaagggctgcaggaat

SEQ ID NO: 78413 - DNA, 1090 bp, Oryza sativa
tttttgatggactagctactctctcaccaggccgtcactcagtgctctaagattagtggcaagcttttgcggcatcgccaccataataagagtaggaaatgtctcgactcccttgtcaactatggaaggagaggaatgcccatgtccttgatgatgttctatctcaagtgctgatggtggtggagcagattgtggaagaagggaggcaatgggtggcgacaactgccaatccagttggagagttgttaggcacatagcttagttatgtttagtgtagtttcttcctctctcggtctcagcttaggagctttgttgggtgatcgtctaggcgtgtcactttttttctaatatattaacatgcaagaggtcatagcttaggagctttgctggttgatcgtctcggcgtgtcacttttttttctaatatattaatatgcaaagtttttttacgtgttagcatatatatatatatatatatatatatatatatatatatatatataatatatatagagagagtaacgtctctgactttttaaaggtgacaagaacagtagatcgcccattggaattatccatagaaagctgatgagtacgatgaattaaagctggtcatgggattggtcaattaatataacactatatgattgccttttttttcctccgcttggtcataacaaaagacagagaattgatacatagggctcggtcattttcttctagatacaagaaaattttgccccgttcttttctaattaagattcatattttatctcagttttcgttagcacacttttcaaactactaaacggtgtgtttcgtacgagaactttctatatagaagttgctttaaaataccaaatatgtggatttgtcaagtttgtaataattaaaacttaattaatcatgtgctaatggcattctcgttttccgtacgccaacttaattttcatcttcatcggttttatgtcaagtcagcatattttactctaccaattactagtggaaggtgcaatgaagctgaaaaaacatgtgaggaaaacctgcagattaaaaatatatttatatagaactgatataaatatattttt

SEQ ID NO: 78414 - DNA, 2118 bp, Oryza sativa
  unsure (1)..(2118): unsure at all n locations
atatgtttttttacagcaatctatcgtatagcaaactttttaaaaaaacaccattgtattacgccagtattaaataagnngcgtgacgctgcgaaaaacgagagagatgagttgggaaacctagggtaagaacacaaccaaatgatgtactccttccgtctcattttaaacacagttgtaattttctatgtctaatatttagccgtccgtcttatatgaaaaatttgtgaaataattaaaataatgaaatacatataaagtacaattcatattttatcatctaataataaaagaagtattaattataaaataattttaaattagacggaaggttggacatggaaatggcacggaggttcctagctggactaccggggtagcgtgtcacactgccacattgctatgtcacgtcttatcaaaatttagtgaggagcaaacctggttgactacagtccggcctgcttctcatctccttttctcccttctctctttcttttgacagtggccgctgctgtttaggagtagtaatttttttattttaaccgttcatccatccacagttctctcctcctttccttccttcgtaaggttcctctctggctgctctacatattttctttctccatcgccaatttcttcctcgccccatcgtcctcctcgcttgatcgagctgttcgtctaggtgggttctccattcttccttactaaatactccgttcttgttcccttctcaggttggttataatgtcaaatgcaatacttgttttttttttcccttctcaggctgtttatttgatttctaataactgagcttttcgggctgtgtacatccactttgggtgcagaggccggttaatccattatctaaaaaaaagtagcttttcattgcttgagatttttcatttgggtcccgctcgtctacactacaacgccctttcaccatcttttgggttcagtcgtgacaaaactgtgaaaatttgtctttttgcaccgtcgcatttgttttttctctgattagcaccaacccggatgtggaaatttctctgattaaatttagcttccaagcgggaaatatggtgattcacaggcctttttgttgcattgccatggtcctgaactagtgaaaggatgagaaaaaaaaatatccccactgagaagtagtgattttttccgacactgtaggggtttgttgaaagatgggcacgtggtgcgaaagatgtagacggcgcgatgagcaggactacaggaatttggatgattgccagaaacactttttgctgcttatgatgggtgattttcaacatgagattgtaagccaaatactctattatttatgaaaatgcaatgccttcttttcttgtcccttgccttatgtaacttttgtgttactttcctacttgcagacccttttttttggaaaaggattgcagacccagtttggtagtagtaggttatttcaagcttataatcttgatcttccttgcaaatttccatattaatcgatgactagattgtaccctcttaaaaagaataaatattgatgaccagatttaagccaataacataacagcacattaggtttgttggttggcaccagatgtcatcatatctaaaagagcaagaaattgggcttttcaatttcatcagtttgttctgtagtcacatacagaaatcagggcctgccctgagatttttgtcgcacagggtggaactaaaaagaaaggccccattttgaacataaacatgaaaagtactcatatgaatatatcaatggcaaagatcgtattatgtgcatgactgacatacatttaaactagcaccaaaattatgttaacgtcgctgtagcaatgaaagaagagtctcgttacggtactctttactggtagtagaaattaatctaaaccgtgggtctagggcttgttcaaattattgtcaaaatcaacattgccaaatttttggtaagttgataaaattgccaaattttggtaggatggaataaatatgttgtgccaaagtttcctatgcgttaccataatttggtaacaatctaaatatagtaatatatttgtcaattttaccaaataatggtatagtttaaaatgacaccaatctaaacag

SEQ ID NO: 78415 - DNA, 9267 bp, Oryza sativa
tcctccgcatataccagcgcacagctcctccttggtcttcgccggcgagcacgtctcctcctgtcatccccgttgtccccgccacggtaccgtgtctggctctactccacgccgcgcccgcaacatcaaagggaaggagagagagagagtttagtactagttgtactccatatgacatgtggggcccatgttattcttttatttttttcggattggaatgccacgttagcgccacatgtatgccacatagaaccaaaaccgttccggtttggagggggggggggggtaatttgtccggttttacaagtttagggtgtgaaatatctggtattcaagtttagggtggtaaatcgggcgaccgcgatagttcagggggtaattcgtactttttcctactacacatcccgtttataagtatgtgtacaaggttggatcttatgttaaaaatctttaaaatttctatgtttgaaccaatccaaagaaatttcatataggatttttggatggatattcttttggtcctaacaatacataggaaagaatttctatagggttgaattcctctaaaattccttaaaaaccatttgttctaaagtagccctaagtattgcactaagcatccaatgaaacatatccgtatcttatactactgttttaagttctaaagtaatgtttcacccttctattacaatgttgcattgattgtctagtaaaacacagcacgttcgattttacagttcagatcgaacgtcaacgtaatgtccttgagaaaaaagaattacaaaacataaaatgcagggaaagacctaagagaatgcatgattagtctacgtttaatacttcgaatgtgtgtccgtatatccgatgtgacacgcctaaactttttaccctgtatgtaaacacaacctgactttgtatgctcatagcaggccaaatgctatgttatgtccaatgagcagtaaatttggtgagacgcattaaaaaatattagtataatctaagatggttcattatatggctactcctaggctgtgtttgcaatcctggattcccaacatgcttgtgcaggtttagtagtcttctatgaaattagactaatctaaattactactccctctatcctaaaatacaagagaatttagttgaatgatacaaagaatttacacaataggtcaacgttatctttttttatgctagtcactattttttttaaatcttcattttttttagtttataagaaagtccaaaaccttacgccgaaaaacccaaatccataaactaatataaaatcccccatactccgcttcttccttcccaatcactatcctccgcctccgcctccacctcttctctctaccaaggaatgcccaggccgtgtggcaaagagctctccgatcgccgcatgtgatgtgagcgagggtgtcccgatctttcgatgagaggataagtcgattggtttgagcgacgttggcgatccgattacaactatccagggatgttgtgccttagcaatcgttacaccaactccagaggcggtcatgaatctcgacggatgcacgataagcccaaccacgaggtgtttgttcttgcaagcaattgagaactagcaagaacaagatgaacaagcaactcaatttgtgaatcaaaagaagatggattgtgtcgatgggggatacccgtagacaggatatagagggtattggggtacgccggtacgagcatctacgtagtacgacatcaaggaaacaagagacagagattatactggttcaggccccttgataggtaatagccctaatccagttggtatgggattatatagtggaaaccacggattacaaagggaataacagaactcgatgataccgacgagatcgtagtcgaattggttcgaccagatcacctggcgacttggctcctgtaggctccggcttcgtaggctgtggtggatgtcttagctatgagattcgatgccttaggtcctcccgagggggtcccttttatatcgcaggtcaggtggtctccaagtaagactcggagacatcggaccctgtatgatacagtgacgacccagtcctatacgggtagaaacctttccattggtggacttcgtgatgaatttccttagcgtatacagagaacgtccgtacacgcgcagatgtaccatattgccgtatagcgtacatccaagggtagagggtataccttatctgtaaccctgatagtagcccctaacttctgcttaaatgaactcatgtaaccgatcgcgacttctgatgttggagttgttgtcattctcgactggtcgatctcgatgtgagaaccgtagagacaaggagtggtcgacaacaccatgcgaagttcaactgttatgagtaaatttaaattgaagtccaaaaaccgcctcgcgtaacggacccagaaatttccggcggccatctctctcctttccttggaattcgcaccgttggtagtgcgcctatttaaggctgttgtgaaaactttctagcctccaaacactcttcgtcttctccgcttccacgcaaaccctaactcacttgcctcggtttcttctctggcgatctccggcggcaatggacctcgacaagtccacttctaccagcgcgtccttgaagaagttgcaggaggagggcgctctccccggtcgcgggaccatggagagggaaccaggaggtactgaacctgaacccatcctgggccgcatggttgcggttgaggactatattctctgtggttttcttcctccgccttctgagttgttccttctcgtcttgaatttctacggtctttctctgctccatctgaaccccaactccatagccttcctcagcattttttcccatctttgtgaggcctacattggggtagagccgtttcctgacctcttccgtttttactacgagttgcgctggatggaacctaagaaggtatccgggtgtgttggtttccgacttcgggatggcctgaagtcgcgatacatccccttccagtgcccctcttctcgtagtaaatggcgggcgaggtggttctatcttcagatagaaaattcggatccagtcttcattgtccctgaggaacaaccagacaagattttgtcttggaccgccaaacccgccttgaccccatcccttcagtctttcatcgatatcatcgatgacctccgagtgagagggttgtcggggtatgatgtcgctgccgacttcattggtagatggatccagcagctccaggctcgagcccatccagcttgactactctgggctggaggacgcgacccgggtttcttctcggggtatttttcttgtattctgggttcctttccttacgtgcgcattcctcctgacttatcgaaatttggttctcgatctacaggtttgaacagcgaaaccgtggagcgctgtgtcggccaggtgatggtcagtggccccatgacggcgagcaacgtccccgcctccccgcccctctttgagagaaaggggcggctgagcgcgaagccgcaatcaacgtgagtgtaatcgatgaccctttatctttttcctcttagatcgcatcatgacttcatgttgtgcaggctctccctcttactgacgtcattgagccgctcgtggaccaccaggcggcggcttcgttgaaagagggcgtcgccctagaggcgtccgacgtggccattgccgctgttgctgccacgactagtggcggcaatgttccgaggaaagggaggaagttttcctccgtgctcggcaaccgccagaagacgcctaccccatcggtaagcctctttggttatcgattgcgtagtcagaagatgtcgccctcacatcgtactcggtttacttcggcctcgaatgcgtctcccccgcctccacgacgacagaggctggtgacacttggcgagaagtaagtggacgaaatttgaggcccttgacttaatcaaattctggcagcttgttataatgaccaacatggaattctttcatagggcggcacgggcgaaggcggcgcaagatgggtctagagggaactccagcgcgtctcctgcagtggcctcgacagatgacgtggtcgtgcccaggagtcgtgaggtgacgcccagcggccctgccagcgatcttgtgcccgctcgaggcccgcctgctgacgtcctcacctgggaagagctccaagtcgagatggggcgcatcctcgaggccggcgctcacggcataagtcgcgagatcgcggaggcaagggcggcggcagcgtcgtcggcgaacgaacgcgccgacaagctagcgcgtgacctggcggaggttcgcgaggacctccagaaaatgagggagctggtggccggcaatgagcggcaacggcaggggctcgagaaccgcatgtcggaactcgagaacaacctgtcggagatccgtggttcgctgcgggtgtggtgtcacgaccaccatcccggcgaaccctgacgagttctcgctgacgtcttcgctcgcggaactggcgacggcgatgaaggcgatcccctccaagcacgcggccaagatcggggaggagacgtccaacgggatctacaccggggcgtgtcacgtccatgcctctggtttttgagggggtgattatgatccaggaatggtgcactgtggtgagttgtgttatgcagagggtattgtcacagcctctattcgggtacttttcagtatcgcgacgcatagtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatctgttcagccgggtatggttgttcagaatggttgggcctgtgcagcatgggtgtgttgttcagtgttgattaaaatttctgattaattactccactgttttacttctcttaaatgttttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccctagttgagctgcctgtgggagtggagccggagcttcgctagattttattttccgcagcagttttcttcatgatgaggactaagtgcctcataagtaagtatttatcgttttagtcaatttgatgaatctgtatattaaattgtcagtttgtgtacctcggctgattcctggacgaggattttatgcacaaataagttcggaaattactagtgaattttcgggcgtgacaaatacccaggaaagcctcacaggcatggatgaaattacaatatgaactatggaattggggtttaggtgatgcaaactaatcccatagaactccagaatcccccggaagaatcttgaggttggaagagaaaacccactgtagaagaaatgagagaacaccacaacttcgtgtgtgtcaggggtcaggaatgcttcgccgcatgccagacgctatccgatgactctttcgctggaagaacaccatgcgccaccatctccttcacgttttcctccgtaacatcggagggtgcccattaactttcgaaggtttctctttcctctgccatggatgtgagttgaatgatgcgatttgatttggaagtggcaagaaatggatgggagatcgatgcggtggttgcgcggaagatttttgtgggagctgtgaagctctagagagatagattggagtagatctttgaaccctagctttcgccggtgtggttttgcactatagcagaaaatggggaaagtggcgaaggtttcggcggggaagacgaaacgacgccctgtcttcagcatttatttcgctagggtatcgggagtgctaatgggcctgggcctaaacaatactttcagcccaattttgttatcagcgtggctagttgtgatccttggggacttaggcatttgtttttgctttggcaacacttgctcatggtagaatagcccaatgatgttaaaatccattttaacatagttagataattctttggaattattacgatgcaaataaaaaggtgccaaacagaaaagtgctatactaattttgtaggcctttttaggctacaaagctgttcaggtcgcattgagatgactgatattgaatagtcactctcggcatgttatatgcttactttggtaatggcgtgagtcatagcttaggctatttagactcctcgtttatcatgctttataccacatttgatggatctttttgagagtttttactcggatttttgtcatatgtgttgatttatagacctttagagtgtttctcactcgggcctcttctatatcttctttttggcgtatcaaggctaaagcagtcggctggatgttttatcagacgccgcatatgcttagctatatgatcccttggatgattcggttgtaaaaccactcggatggatgttcagatgcactttgactatgtgtttagtttttatttaactaatcacatagttgggggctacacctaattaggtgcatctagtcgatgcacctgatttttttattttcagcccatcacagtctttgattttagtactcaggagaccaaggcaaaggaagttgaagcactcggatcaccattttgaattacgagggaagactatttcgtcgactgtaaaggtctcaggggctactgtggagattatggatgccccatacctagacggcatgtatatccgactgggtatgggttgccatgtatagatagaatatctttaaagggactcgggttaaattccaaacttgtatgtcaaggaaaaacccgagatcctagtcggttacgattgtatcttatctgtaactacctattccgttagggatatgggctgtactttgtaatacggaccccttcccctatataaggaggggtccgggtgcctcttggggtacgatttttctcccagatcatacgatcaataatacacttggcggatcaatccccggacaggagtagggtattacttcttattaagaaggcctgaacctgtataaaattccttgtttctaaacccatccagttttctagcttgatagccaccccttttagtattgccgaaatcttgtttcgacacgcctcttcggcttcccgtgtacatacaaatttgtctagttttttcagcagagcgaagaaaggttgtcctcgttctcccatccaagcgacgaacctgcttagtgccgccatgcatccggttagcttctgtacttccttgagtcttgtaggcgacttcatgttcttaattgccttgatcttctcggagtttgcttctattcctctgccagagacgaggaacccaagcagcttgcccgatggtactccgaacatgcactttcagggttgagcatgaggcgatatcgtcggagattgtcgaaggtttcccgtagatcgtcaattaatgagtcgcctgtcttggtcttgacaacaatgtcatcgacgtaggcctcaacattgttacccagctgatcattaagtgccccttggaccgtgcgctggaaagtatttcatgcggttatcagtccaaacggcatcttaacgtagcagaatacaccgaacggcgtgatgaatgctgtcttctcctcgtcctcttttgccatgttgatttggtggtagccggagtaagcgtcaaggaagcttaacagctcacaaccagctgttgagtccactagttggtctattcaagggagagggaagtgatccttggggcacgccttgttgaggtcggtgaaatcgacgcacatcctccacttcccgttggccttccgcaccatgactgggttggctagccactctggatggagtacctctctgatgaaaccagctttgagaagtttgtcgagctcttctcgtatggcctatttccgatctggtgcaaatctccgcagtttttgtttcactggcttggcatcgggtcgcaccatgagtttgtgcttaatcacctccctagggacccccggcatgtcgggcggctgctaagcgaacacgtcagcattgtcgcggaggaaggtgatgagcgcgagttcttatttctcgttcagtgatgccccgatcttgactgtcttgtcggggttggcactggagagtggaacgattttgattgcgccgtctggtttcggcgtcttagttgttttgctcactttcttgggtggctcggctgtggcgggtgggctgggcatgtgctcgaccatgtcgaggctccgcttgtcgcattggaccgccagctttgcgttcccttgaatagtgattgttccctttggcccgagcatcttgagtacttgatacgcgtagtgagatgcggccatgaacttcgctagtgcagttctcccgatgatggcattgtatgctgtgtcaaactcagcaacatcaaatgtgatctgctctgttcggaagttgctcgcttggctgaaagtcacaggaagcgtgatcttgcccaatggcttggacgatgactgaggattgatttcgtggaatggttgatcggtgggtgtcaactcacttcgtggaatccccattgcgtccaaggtgctggcgaagagaagaatgaaggagctgccgccatcgatgaggactcgcgctaccttgatattccgaatagtgggttcgaccacgatcggatatcgtcctgggataacagcagccttggggtggtcctcatctgaaaactcaaacttctgttcagaccacttcatcttgggtgcagccccctgccatgtcgaacaaacttcacgctccactttcttgtattctcgctttgaggagtacgtcatggaacctccggagatgtgcgagacatgaagatcggaatctgggtacgccgagtccgagtcctgagtggaagccttggcggctttctgtcacaccctgaaaattcaaaatatataaattgttgtttaattggaattttttagaaataattttaaaaagtcttgaaaagaagatctaatttttaattaataaattccaatataaaatgggcccagataaaatttccttaaatactttgcttaatgctataattcctagatttttctgggatttatttgagctaagaaagtattttttaataaatgaaat

SEQ ID NO: 78416 - DNA, 2540 bp, Oryza sativa
cagctatcccaccgaaagcttctacgcgcttcctcctcctcctcggtgcggtgcggagccgcccgcttagtcgtcttccacttcgcggtgttcttcgcttcgcttctgcttctgcttctattcgttgcgtgcgcggagcgggaggagggagagaggggcacgcgtcccaggagagagagagagataaaaagctccaactgactgacaggtggggcccaagcgtggagggcgacgtaggtgtgtggttaccccttcgaatgacaggtggggtcgggttaaggtggggcccacctgtcggtgggggttgaggcgcgaggtgggagtggatggcggtggggaaaagtggagtgacctcgtggggcccacggttggacgctcgaggcggccacgtgagcttggtctatacacccacgaccggggggagtgggggtttagggaatgagacggagaaaatttggagaaaaaaaagggtgttgacgaattttgcacggcggcttgaacagtgaatttgaaagtggaaaagtcgattcgtacaattttcttcaagaaaaaaaaatcttacaaacgctgaagtggcatggtacaagtaaatttagatttttgtataactcctgctcctcatatagttcgatttaacgattaagaacttttttgtgattgtttttaaatatcccttcttctagatgtggtttttaaaaaggtttttccaaatccttattgaaaacagggaggtaaaagcttccaatcatttgcctcacagtttataagccgttgttaaaatttaaattataaaactttggttttgagttaaatttaggattttttttattcaacactaacttttaaaccgcagaaaacacaaacagaaaagtttggtccataatttatgacttggtttcttatataccgtttttggttagtagtagtacaccagacgatatatatagtaataatagaaaaaaaaacagagaatctagttcaaatagaggatacgtttgaaaaaccattcaggcatcaatccatttatgttcaacttctgttgatgtacacttgagaaatcatctgcaaaacatacctatttgtggacatttctttcgtcttgattgaataccaaggctcctacctataattaattaataagaatacgactttgtgcaccacatgccgtagttggaaaaaattgtttgtagtctattccaaatttctactactccgtatggtccaggtgcacagagcggttgaacttggacggcgagaagaaggttggtgcggtgttacggtcatttgtcactctcgtaatcggtggttatgaacttgtttgagagcgcaaactgccggattataaaaaaatatcctacttgtcgtcgtgtagcctcctctccattcatgattagtgcatgtattagcgaaagatttcgctattattaattcgaatgattagattgagtggttgcaaaacagctgttacgtcatccccattcaccggccggtgtaactttgtaagtccccagttttcaaactaaataaagcgtagtaagtccatctgttagagtacctgaattgaagtaaagcattttttatttttgtcgatgggtgattttgtgttatcttttgcagtgatgaagagatagaaaaaggaagagtgcagtggtggtgcgaactcccggttcctctaggcccatgcaattatattccatgggccttccttccatttatagcctgtttatccggcacgtatataatgggccgcattttcgtctctgtacagtttcagcccagataaaatgggcctgaagtgactggctaacgttctggcccaaaaagtggccagcagccagttgcggcccaaaacttgttgcattcttcacccactctggtgtcagttagcattgatcaatgtttgttttgcgtgcaggatccacagttatctcaaagactctcaaccctaccaattttttggtattaccaaaatttagtagggtaacaaactaaacaaactcttaccattatcactttaccaaattttagtattaccaactttgcaagcccttcacactactaaattttaataaggttaatttcgataacaaaccctactggtttgctttctagactctgaattgtgatgagtactactactagctagctagcgtccattttgaggggacacgactcgtggaaaagaaagaagagaatgatcgagagtgtggcgaccctttttattgctgtttgttaccgggtcgattaaagtacatttgtcttctttaattatgatgagtaggcataaaggtcactcaaggtgagaactgaacctgccgatcgaatttgggccagctagtttagtgacggtccttttcaggtagtttcactggacttggaggtgaacatccgtttcactaccaatgaatactcgcacatttcgaatcgaaaaacgggtactatggccatgtttagttcctctccaccaactacaaacttctaacttttcatcacatcaaaaactttcctacacacataaacttctaacttttttttcaaac

SEQ ID NO: 78417 - DNA, 7333 bp, Oryza sativa
agattaagcttttacaactttgaccattaataactttaaaaatatttagtttaaagaaactagaaaaacatatatagatttgtctttcaacacattataataaaagtaaacatgcatttatttattgtatatattataatagaaaattaaggtcaaatgtatatcttgtagagcgtgtcattgtccaaagcgtcaattaaaatgaaaccgaagggagtataatacagattgtactacctccgtttctaaggatcgttcattttactaccatttttaaccttatctttttagataaagttataaaaaatagctacatttaatttattgtcaaagtttagtaagtacatataaagtcttaccaaaatttagcaaccttgctaaaattttggtaaccttaccaaaatttggcaatgccaaaacttgataaggttgaaatggtagcaaagtgaacaaaccctaaatatttgataccgttgaatttttagcacatatttgattgttcgttttatttaaaaacttttgtgaaatatataaaattgtatgtatacatataagtatatttaacaatgaatcaaatgataggaaagaattaataatttcttaaatttttttaataaaacgaacggtcaaacatatttaaaaaagtcaacaacgtcaaatatttagaaacggagggagtatatgacaaccacgccctctagctggtgatcagttaaattcatatatagtgtgagaaagaaataggagaaaaaacaaagctaatcttatatttaatttattatacatgttagctaaaatataaaatggttaagtatactattataaacatgcttattataaacatgctgtcatatgcaatctgtatattcctacaaccaaattgtaaaaaaaaaagacgcaaatattatagaatgatctaatatcaaataattagaattggtgagacttcgaatctatatcatttagcccattaacttatgagggcattcccaacccaatgactagaatggtgtccatagcattaaatgagttgccacctagaaaaaaaatgatgtgacaagtgaataaatgaggaaagagaaggaaaccatgtcttgcatgagacatggttcctacacaatatccaatacatcatgtgagataagtagcattaaattgaagttatggaatagtggtgtttgcattgaaagagtagtgtctagtactattttcttaatgatgtggagtttatagaaatcatgtctagtgttatgggttggtactgtcctgaagctgatacgaaacctttagacgtttcaatccaattgtacagactacaaaaaatacacagctagcccaatttgtctttcgttggacgcactggcaaggtaagcaactaaagtagtaagcacccaccacgtatatatgtatgtgaagcatatggattatgaagtttattattcaaattcatgcacttgccacgtgcaatcccaactatactgttttgacatgctgacgatgatgtaaagttataaacagcagatcgattaagcttagtcgtactaattaattcctcgcaaaaaaaggctaattaattaattaattaatagtcgtaattaaacaaactaattattatcggtctcacgctagcacgtcattactgtttctcaccgatcacaagggaaccgggcgatgcgtatcgttgccacgtccaagtaggctagctacttcttcagcttaacaacgcaacagacgtgtctacgaatgacgccgacgtctcgaccgtttaagcatacataaccgcttctgttgatcggctcaatcaacgaaatccccgaaaacgagcgggtgcactccacttattactattatgctaccaatattattaagaataaaatagttatttactaataaaataattaggagttattttgcatttatattttttccgggtaaattgattatgatcatccattgtgtgctagcacaattcgtatttcatacaaaagccgaaaaagagagaaaaaaataaagtttattcactatgacaagacaattatatccctctatacttattttataataatactttttaatattggtggtagtataaataaatccaaacaattcaatcatttatgagataaacggttgttttctactactgaaccgtttgggcgaagaaaacgctggtagagatttaactcgatgatgatgtcgccacgacgccttgtatatatttagcgccgctcgcatatctcagactccagtcctcaccagctacagatgattcttgcgcttttgattttccctacgcttttttgactaaaaccctcgattcctcctccaagatcctggagagactagcagcagccgtcgctgtacgtgtgtatcgttgcatggtgctgcaatctcacgatgtatcggatctctgcatcggcaagccgccggtgaggtggctgccgccgtcctccaccgtcgccgatgccatcgccgagatcgaggccggcggcggccggggtccggacgctgccgtcgccgtgtgggacgggacgaagggggaagtggatggcagggtgtgcatggccgacgtgcacctcttcctctgcggcggcgacggcgaggcggccagcctggcttccccggccgccgcgcttcaggccacgctctccgacctcctcgccgccggcgcgccgcccgtccgccgcatcgagccccacgcgaggtcgcgcgcacgccacgtgtatcgatcttgaccgccggcgccacatgcgtttcgtctgacgaaatttgttggttacagtgtggtggaagcggtggacgccttcttggacggcgcgcactgcctcgtcgtgccgatccgggagcggtggcggcgcgcggcggcggcgggggagatgtgcatgtgctggctcacggtggaggacgtcgtgcgcttcttcgtcggctgcatcggcctcttcgccccgacggcctcgctctcggtttctcagctcggcatcgtccgcgaggccacgctcgccgtcgccgccggcgacagggcgctctccgccgtgccgctcctcagcgccgcgctggcgacgcactcctccgtcgccgtcatcacgggcgcaggcatcgccccccgcctcgccggcgaggtgtcgccgtcggcgctctgctcctgcgacgtatccgtcgcggcggccatcgccgcgctctcggctggcgacctcacggccttcctccaccgcagcgacctccggtgccgccgcaacctccccggcatggtcgacctcctgtacgccggcgacccttcgtcgtggcccccctccccctcctcctcttcctcctcctcgtcgtcatcgtcgtcgttatcctccttctcgtcttcctccgacgacgaggcggaggacgggtacaaacactatgcgccagcgccgtgcgcgcggcgagacaacaacaggcagatcatcgcgtgccacccggggagctcgctggtggcggtgatggcgcaggcggtcgcgcaccgcgtgacgcaggtgtgggtggtggacttcgacgacggcgagctggtcggcgtcgtccgcttcctcgacgtgctctgggttcttcgcgaacacctcaaccaaccaccccctgatctacccatcgaatttctcatcaattaatcccagtactaagcttcgttgatgtacatacgaggacaaaaattgcgaccatgaactgaaccttttgttcatcttaaatttacgccatgtgtttcgtcggcggatgaacttgaaacgaaggaagagtcaaaagattgatggaggacagaaaccacctgtcccgacaaattttgcaaagtttgttggtcgatatgtgacgtctggattggatgatgcatacatatggtttcagcgagagtaaattcgggttggtggccaggcgagctacataccagattagtccaaggtggattctaatatatcgaatagacattcacccgtttcttccgtattaactatataattataaaaaatattaaaaaatatacacagtagattaatatgtataaataaatcactagtatacgtatatataaaaattattatttttattataagttgtagaagtcgaattttaatatgtatatttgtaaaataatatattacatagtattaatctactttgtcaatttttttaaataaaaactgtttagtttcccagcttagtcagagagattttttggcgatcgcaacgagtttgatcagatgagagcccgtacacgaatgacatttcccgatgttcttttgtatccatactggagtaggagcatatgaaagagggttttgtgttttggcggtagcaaactctgcatattgctccagcatatgcatggctggcaccaacataatcttgttttatctgccttctcggcaactcaacgttttgtctcgacgcgccacaaaaacgcacgaggccaactgaactgatgcatatgctgttgtggcatttgcatctagcaacacgtcactaggctctggatgtttgtgaatcgtgtgagacgcaactggatctccttgcctatgggctatggcccgtgaggcatggcccatatcagcgacaactccggtttcactcttcaatgggccttacttgattgtcaccagacgtgggccacctatcaggcctgattccaactggcaagttaatttaggaataggccgctatccacagaacaaattaggcatgggctttgggtcgttgggtgtcctgatagataaaaaaaggaaaatgtccactatagatacctcaagtatgagtcttagttacattcggatatcttgactgcaaaaccggatacagtgttggaattaatagatgggctaaggcccattcgaagattaattctttggaaaatctcaaaagcccacctcatgggatggcatgcatgtggagtttagtaccaccttgcttattctaggagagggggacctccttaaaaaggaggatgccctccttgctacttgaaacatgtgtggtggagagaagaggggaaacacgcgcgctcacttgcctcgccacgtagggacccttgcgcagatgcagcctccttttgcagttttgttttgctgcgggattcggatgtgttttgttttggaaacattccgaaatgcagttttgttttgctgcgggattcggatgtgttttgttttggaaacattccgaaaatccggtgcgtgaaaatggcatggagtccggataggttacgcgcgacttatccggttcggtttacgcgggcgccctgatcaggcgatctatctctatataaaccgagccgccaccttcacgcaacacacgcgaaatcaatctagggtttgcctcctactctgtactgcgccgtcgctcgtagactactccatcccgctcgccggcgtgcaccggcgatcgggagagcaggtctccagaacctctgccttcgacgtcctgtaccgggagaaggcggcaataaggtttttgggaagcgcttcgcgcgactgctccctgttcgttcgcgacggctcgccttcctcttcgctcgcgtgctttgcgccttcgttgacgctcgcaactgcgagtagttcatgccgagcaaccggactttccgccacctcggtacgtattcgacatattgcgcatatttgatttgttcatgttttattgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgaagcactgaggccggataaattcaccggtgtgcactttaagagatggcagatcagggtcactctgtggctgacgtctatgaaatgcttctaggtgagtactggcaaacctgaaggaattcttactgctgatcagcagaagcaattcgaggaagccactactctctttgtgggatgcattcttagcgttcttggcgatcgtccggtcgaggtgtatatgcaaatgaccgacgctaaggagttgtgggatgcactgaatactaaattcggtgctactgatgttagcaatgatctgtatatcatggagcagtttcatgactacaagatggctggcaaccgttctatagtcgaacaggctcatgagatacaaaccatggctaaggaactcgaactccttaagtgtgtcttacccgacaaatttgtggccgggtgtattattgcgaaactacctccatcatggagaagtttcggtactgcactcaaacacaagagacaggaatactccgttgaggggttgatagcgtctcttgatgttgaggagaaagctcgggaaaaagacgccgcgtctaagggcgatggtgggcagtcctgtgccaatgttgtgcacaaggcccagaacaagagtaaggggaaatacaaagctcaacaaaccaccaatttcaagaagcagaagaagaagaagaagaagaacaacaacaatcctaactaggatgagaggacttgctttgtgtgtgggcaacctggtcatctggctaggaagtgtccacagcgcaaggggatgaaggcacctgcagcgcagacttctaagtctgctaatgtgaccattggcaacactggagatggaagtgggtatggtaatttacctactgttttttcagttaatcagtctactaattggtgggttgatattggggccaatgtacatgtttgtgctgacatctcattgttttcttcttatcaggtcgcacggggttccaccgtcctaatggggaatgggtcacatgcttctgttcatggtgttggcacggtagttctgaagtttacttcgggaaagatcgtgcagctgaagaacatgcagcatgtcccttctatcgacaggaatcttgttagtggctcccgtctgggtagagatggatttaagttggtttttgagtctaataaagtagtcgtgtctaaacatggatattttatggtaaaggatatgagtgcggaggcctgttccgcttttccctttctgatttctgcaataattctgtgaaccatatttgtggcagtgtggatgatgaggctaatgtttggcactcacgtttatgtcatattaattttggcttgatgtctcggctttccagcatgtggttaattcctaagttttccattgtcaaaggttctaagtgccatagttgtgtgcaattgaagcaacctcgcaagcctcacaaggctgccgaggagagaaacttggcaccactagaactcctacattcagatatttgtgaaatgaatggggtgttgacgaagggtggaaaacgat

SEQ ID NO: 78418 - DNA, 7676 bp, Oryza sativa
actcttgcagtcccattatgtggagaagatcttgaatcgctttggctacattgatagtaagccttctccaacaccttatgatcctagcttgttgcttctcaagaacaaaagaattgctaagaatcaactggaatactcccaaatcattggctcgctgatgtacctggctagtacaactaggcctgatatctcctttgctgtgagcaagttgagccggtttacctctaatccaagagatgatcactggcgtgcgctcgagcgagtaatgcgctatctaaaacgtactatggaattggggcttcactatactgggtatcctgcgatactggaggaatatagtgattctaactggatctctgatgtggatgagatcaaagccactagtggatatgtcttcacactaggtggtggtgctgtttcgtggaggtcttgcaaacaaaccattttgacgaggtcaaccatggaagcagaactgacgggactggatacttctactgttgaggcagaatggctacgcgatctattaatggatctgcctattgttgaaaaaccagtgccggctatccttatgaactgtgacaatcaaacggtaattgtcaaagtgaatagttctaaggataatatgaaatcgtctagacatgtgaaaagacgattgaagtctgtcaaaaaattgagaaactccggagttataacgttggattacatccaaacagctagaaacctggcagatccattcacgaaagggattatcacgaaatgtgatagataatgcatcgaaggagatgggtttgagacccatatgagttatactatggtggtaacccagtctatgtgatcggagatcccgtgaattagaacctgggaagaacaaaccattagtaaactagaggagagtaccaatctataccctctctaagtgaagatgcatgtactcttgtgagttgcaaggcaggttggctatgccttaatgagttctgttggctttaattagtgaagatgttgtcctgcagagcagtcttgaaagaactcacctttgtaagcttgactgttggtcgcagtctatggagattttgggtgaatcttctaggaagcttactaaagacctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatattcaatcttaatcggtctccatcgaaccgctggtatataaacagtacattggaaaaggcaaatctcagtgggattttgagatttggttggggattgttggaattaatagatgggctaaggcccattcgaagattaattctttggaaaatcacaaaagcccacctcatgggatggcatgcatgtggaatttagtaccacattgcttattctaggagagggggacctccttaaaagggagaatgccctactagccacttgaagcatgtgtggtggagagaataggggaaacacgcgcgcgcgcgctcgctcgcctcgccgggcagggcaggcggcgcgcgtgcacgacgtacgcgtcgaatggtccgcaaaattggctcctcacccttgcgcagatgcagcctccttttgcagttttgttttgctgcggaaaatcaatatagggtttgcctcctactctgtactgggccatcgctcgtaaactactccatcccgctcgccggcgtgcaccggcgatcgggaaaacaagtcttccgaacctttgacttcgacgttctgcgccgggagaaggccgcaataagggttttgggaagcgcttcgcgcgactgcttcttgttcgttcacgatggctcgccttcctcttcgctcgcgtgcttcgcgccttcgtcgacgctcgcaaccacgagtagttcctgccgaacaaccgttttttccgccacctcggtacatgttcgacatgttacgcatatttgatctgttcatgttttactgcttagtttacatgtgtagatctaatgatgcgttcaatctagtttatatctgcaatgtcatgatttatttatggaataaattaaatcattatgtgcttataatttcaacatacagagcatccgctgaccatcaaaaccagtataaattgagtatcttgcttaactgcaagatagtttatcttacgtaacatattaactttgtcttcatatcctgtaacgtctacataacacttagtacatggcaaatcgaaccgtatcttgtcaagatcaacgtcgaggaacgcaaatgaaaatcatctcgtctaaaattttccaccaaaaaggcccaaactacaaaagcattgggttctttacttgttagggcatgcgcaatgtatcttacccaactagtaaataagatgggcccatgaccaggaggtagtaagctgcaactcttctcacaatgcttatatgagtgtagtggtaaacaaggtggggtccacctgaaaaaatccatccatcccaaccctccattacctggatcctgtcagaatcttcatattttatttggttgttaccggcaatagcacaaatatcaggtattaactactacctcttcccacaatgcttactactgggtagtaggcttgaaataaatgcttgttacctggttttttgccacattgtggttgctcttagccgctccacatgtttgaggtggtcccacatggaaggggagagatcccgtggatgttgggacgtttggtgcagattgaacatgatatacgcacagtacgctaatgaattttgtaagtacgcactagtaagtactctagctaggtgtttatcatgcagggtacgtaccgatgcttaccgttaactgtaagaagcggtacgccgttgaataaaccagtcgacgtggcgatgtggcagctgaacacgcagcggtccacgcgcccgccgatggacgagtctcaccacaccttacgcgccgctagatctggccaagccgtgtgcaccaccgctccagtgaaaagtgacagttaatataaaagttaatcttgatcaagttttcaaacaaaaagttaatcttcatcagtgcgactctgtcccacacactccttaaaccctcatcgatttttttttagttttaacttaactagtggtggattattggtgctatatatgtaaataaaggtaattaatctgctgagtcacatctccgtcagctgctcggaccaatcagagcttgtgaaacgcacgtctccgtcgagtaaagcagaacggaaagttggcaagtatcaagaatccaacggcgtaggatagaaacatgccaaagaaatgtactcctggagcaaaattaaaatggcataattacaaagtatgacgacgaaagcgaccgtttctgacttactagctagtattcctggagctgtcgagcatgagatgagcgtgtggcagtagtaagcgtgcaaaaggctatagatatagaatttctacaataccatcggataacaataaatatgtttttaattcctaactattacaactggcaacctgcatgcactcgatcccttagcagtactccctctgtttcaagtcataagatttttttttaatttgatcaaagtcaaaatactttaaatttaattaaatttatagaaataataataatattttcaagccaagacaaatttattatgaaaatatattaaattattgacttaaatcagtttgattttggctaaagtcaaaatgccttataacatgaaacacagagggagtaacttacactagtacaacaatttcatgcgagttgttccttggctccttgcgatgcagcatctgttgacatcttccatactgcttatgtaaacacacagtttggactgtcatgatccggtagaggatactagatctcatcagcaggattctgtcagccgtaagctacatctaagtagcaatatagagattattaacaactctggcctggataagcgtctggccaatctactggccatccaagatcagcgctaccgacctggcgacctgtactctagtcacgcctcctgatccaatgcatgtgctcaactgctcatcgctcgccgctcgatcgacctgaccagtttttaatcaccataattaacacgcgtaacagcgaccacaaacttgggattactactagtataaacacgttcgttgccgccctgacaagagagagaaaagagagaaaaaaaaaaggtgactcgctgccgagtcggacacgtgacaacacgttggtgccgcgtccggctcaaccgcttgctcgcgcggaccttatcgctccggtccgacgcgcgggtgacgtgtaccgagcgaccataccgtgccagccttatccccaatccgggcccacacttttgtcgtcgctcggtgtgggccccaccctgtcagtgtacggctcggcgctcaccggcgtttacctccccagcccacgggaaggaggcggcgcgcacgtggcagttgcggtgggtgaggctgtgagggcggtgcgcgagcctacgtggcacgccgcgtccacggaggccgtagagaggtggcccccgtgagcacgcagttcgagtaggcgatgacgtgtccgacaggtggttcagcgagcaataattacggggtaatataataaaccgctcccgccaaactaacggcggcagcccacggaaaaggcgtccctcgctgctgtttcctccgtttttcgctcacctccggtcatcctactcggctaccccggcggcaaaaacatgaagttctacagatctacgacatcagtttactagtttgtcttttgttctactttgctctttctttcttgcgaatttctttttaatcacgttttgtgtagaccatgtacagcatcctcacttgtgcagggtaggaatttcacaagaaaacagtgctcgtgcagcgactcgatagaaacggaagaaaaccgtatcaacaaccaacacgaggaggtgtgtaatactcctttcgccttgtaatataaaagatttatatagatggataaattttaatactataaatttaaacaaattttctatgtagattagtagtatgtgttatatctatttaattttttttatattttaaaacggaagtagtaaacaattacttatgtaggctttgggtgcagggtaccgtagggggtgagggcaccgcacgtcacggttaaggtggccggttactactactggtgtcacatcggcagcggcaactggtattacgtgatgatcttatcctcgtcgtctcgccgtctttatcccgttcgctgcttgctttggcttctcacatcagcactgactccaataacacgctcatcaaacagcgcgcgcgagcgagggatggataggatattttcgttcgcgttcgtgccatcctaaatcccgtctataaagccgtgcacatctctatcctcacctccattccattccactcgccaacccgacacgtctctcatcttcacgcaacgaacagcagcagcagctcaagctaagctaagctaaagtactacgtgttctttcgtcttcgtcggcgccggagtttgattcgtcggagctagctagcaagaggaagaagaaaatgttggccatattccagaagcaggtggcgcacgcgccggcggagctgaacagcccgcggagcagcgcggcgaagcccaagaaccccgacgagatcctcagggacttccacgccctccaccccatcgaggccttctccacctccttcggcggcggcgccgccctcgcctgcgtcgccggccacgcccgcaatggcctctctggctacgagaggtaaattaaatcaatttaatcgatgaggcaatgaatccgaataattaaggtgattaaaacgtaggggatcgataataatggtaaatgggtgtgtacacaggatgttctgtgggctggatgacatctactgcgtgttcatggggaggctggacaacctgagcagcctgatccggcagtacgggctgtgcagccgctccaccaacgaggcgctgctcgtcatcgaggcctaccgcaccctccgcgaccgcggcccctaccccgccgaccaggtcgtcaaggatctctccggctccttcgccttcgtcgtcttcgacaacaagtccggcgccgtcttcgccgccctggtaatttaaaccactactagactggttttctgaatcgaattgatgaatttgtgcttcaaattgaacttcctgtgagtgtagcgtggccctgtccccttcccgctgttaggagttgtgtttagccgccgtagtagttcctaagcttcagtttctgattgttctgcttttctttttcttatatattgacgttcattcgctttgcgcgatgcagagtacggatggggaggtgccgttgtattgggggatcgcggcggatgggtcggtggtgatctgcgacgagagggagatcgtgaagggagggtgcggcaagtcgtacgcgccgttcccggtggggtgcatgttccacagcgagggggggctcaagagcttcgagcacccgatgaaccggctgaaggcgatgccgcgggtggacagcgagggcgtcatgtgcggcgccaccttcaaggtcgacaccttcaccaagatcaactccatgccccgcgtcggcagcgccaccaactgggccgccacctgggacgacgctgccgcctgatgatggcgctccgtacgccgtcgtctcgtcgccgtgcgcctgccctcgccgccggcctcctcgccgtttgccgccgccgctcatctcttcctcctcttcttcctcctctctatatccgatgtgcttctccgtccgaagcatgcagattattagagcgatatttgcagctagcgtggaagcgcgccaatctatttttctgcggtgtttttacttaattttcacctcttctttttaaatttttatgtccatctttgggctctcgcctctcggcaatgtatattctcggtcgcgggtggcatgtcatggtacatactatgaatgatgaataagaaagagtttgcttcactcaatccagttcggtctcttttttgggttgcttataattgcccatgatagtaaatggtgtttggctatgcacatctcatttttgggttggttcgttttggcttatttgctaattgctgtgtttagatctaaagtttggatttaaatttcagtctttttccatcgcatcaacctgtcatacacacataacttttcagttacatcatctataattttaattaaaatttaaactttgtgctgaactaaacacaacctaaaacggttggagtgaacactgatgagctcgcgagttacatcatctctaatttcaatcaaaatttaaactttgtgctaaactaaacacaacctaaaacggttggagtgaacactgatgagctcgctttgtactactccctctgtttcgaaatgtttgacgtcgttgactttttatcacatatttgaccattcgtctaagtaattattaattatttttatatcatttgattcattgttaaatatatttttatgtaggcatataattttatatatctcacaaaagtttttaaataagacgaacggttaaacatgtgctaaaaatcaagtgtcaaacatttcgaaacggagggagtatctccgtcca

SEQ ID NO: 78419 - DNA, 3246 bp, Oryza sativa
ttattttattatatctagagaaaatggagagagaaacatttattaaagataagtttgcccatgggcccactggtcaatctcacatctctagctttctttgttcatgttcttcttcctactgctaccttctctctcatgcgtgtgcacagcagcggcaatggagagcatgtgcagctgctggctagggcagagcatgcggcagctggttggaggaggtaggcctggagcttggccacccgtcagcggcgccatgagagagccgcacagctagggtgtcggtgcgggacatcgggttgcaaaggggaaatatgcgcagcttcaattcgaccaagcagtagtacgacggggtgtctaggaactttgggaagtcgatttccaatgattgcaggatagagcaacgtcggggtcgtgtgcccgtgatgagcttgatggcagcccaatggagtttggactggcaaggcatcttcgtctaattgttaaaattgattgggtgcagtgcctctatgggtagggaaaaatttaggatgtaatagattgccggaaattggcgtgatggtgaatgatggcaacgacatcgtgctcgccatcaacatgtctccaggcctacctactcggcagcttcaggtgcggcgtcgccgtcggcggtgaacctgggtgatgcactgccaccaccgccccaccgtgggctggccgcgcgcgtcgcgcctatgctcggctcagtagcaagcacgaggaagaagggaaaagaaaaggagagagcaggggcattttggtacttacacaactttctctctccattttaactggaaataataaaaaaatgggagtagtgtccaacagctaattactacttttttacagtgtccacgaaaagattcacgatcttcggatgtctcacagcaaaggccgcaatctttcggtgtcctgtagcaaattttgcctaaaatctacttcctccatcagttcatccctaaaacaaaggaaaaaagtacgaattaccctttgaacaattgtggtcgtccgatttaccaccctaaacttcaataccagttatttttaaccctaaactttacaaaccggatgaattaccccccctaaatcgatctaggccggttttggtcctacgtggacgcatacgtggcaatctagtcagccaaaacagataaaaaagatatgggaccctgttgacgtaaaacacgataactccagtgcaggtccaaaactcgccttcgggtgtgctagcgtgccagttgatttgatcctgcaatcaataagaaataaagacaaagaacccgcggttaaatctataaatgatagccgatcggctaagtgccgatgtcatatcatttatctctgagccgatgtcatatgtaaatcgatcggcggttgtaaatagataataaagaactaaatctattcgatcggctttagatattaacaatatataattcttatatcgatatatacttaaatcaagtgattgggatagatcggtcgtcatgccgagacagtataaatcacttagatcgaaatatatattaataacaggactatatatattcacagcttagccgatcagatagatctagcatgtatcggctaatactccgatacgactctatgttaagatgtaaaaacaagcagaatataccaaacaaaagcttaatatatttagatgcaataatatcttgatataaagggcagatttaacgtgtcaatgaagcatatagagcaaatatagttaaatcagataagattggctgaaaccccgatactaccctaatcggcaaccagaaggcaggctagagattgatattctaagcacaacttaatagaccaaactcagctgatgcagcattaagtatgaaaagaagaacaatatctagacaatcaagccgctggaagtttcatagagtggtagatatcttatataatctaaatcaacgtcaaaatctaacctaatcggctgccctcttccaataaatgttagccaattgtaggttagatagcgatatggccagagattatgtaagatatatgataactcgacgaattacataaacaagattagagtatcataaagatggaagcactaatcccgagaacgcaagccgtcataacaagttttacctcctgttgaagatcgaaaccgatgtagctcaacccgaaagcaagaactcgtcgaaataaaactaaagcaaaagggtggcgatgggccaaaattgtattgaacgtgtgtgttaattgattacatggggttcggggtctatttatacccgaaaattacaaactatgtccatgtcggacacgactcttatttctaacaaactctaagatatcataagtctttacggcagacttttgccctaaatatatctctaagaaaattacataaaacatcctaattaaaagatacaattgccttcccaagactctatccatgtgcagcaatcattttgaagcatatcaactcaacccgatgttgtacaccaagtcgtattgtcggaattggctgcatcggcttacccagtctgactcgaacccagccgatcctgatcgtagccgatccggactccagccgattcttgctctgttcttgaatcgatctccgcctttgaatccgcttcgatctaatcctcttttccgatgctgatattatcaaatttggccgttaatagacccacttgtcagcccaacccctcttcttctccccctcctcttcacatcttccccacctctctctctctctctctgtcgagtgcaatggcacaaggatggtgggcggcggcgcgcgggggtgcgccggcggccccggaggcggagctccccgagcggcaggtggctgagtaggagcgggcggccggcggcggagaaggagctccccgggcagtgggcggcagaggcggaagcagagcgggcgggcagcgggcggctgaggcgaaggccgagcaggcgggtggcggcggaggcggagctccccgggcggcgggaggcgggaggctgaggtagaggtggagctccccgtgcggcgggcggcaggcagctgaggctaaggcggagcttcccgggcggcgcggcgggcgaccgtggaggagggcatcggcggtggcgacgcgggagcagacgtgcgtggctagcggcagacggcagcgcgcgggggacggtggctcgtgggggcgagcggtccgcggcgccgcaatggtggggaaggaggatccttccccttcctccctcgtcttcctctct

SEQ ID NO: 78420 - DNA, 1801 bp, Oryza sativa
caaatgcagtcaccaccaacatatagatggacacaggtgcaaagagataacttaagtgagtgcaacaagaccatgatgagttcctcctccgagtcatcggttacaactcagttcttatatgcattgccttataaatctcatctggtgttgtcatgtcatatttcacagctataactggttgatgttttcttttctttgcacacaggatattctttgccctctgaagatcagggttgcagagtaggtgttatacctgatcccatcattgggcgtaggaccaaactaaatccagttcaggagaaggtggtgaacttcaagatccaacatattcattctgaaatcccaatatttgtagctgtcattaaaaggagcaacgtgtctggagtgttatccactctagtgagtgtcatatttcttttctcaaatgtgcatactttcaaatacgcactaatataaactggtgtttacactactgatgtccatactgctcaattacgcactatttaaactaccgataaacattattctcgatgttgttacttctgcggttgcttaagattatttaaactatccactgaatttacatgcgatacacttgctgcggttgcttaagatttatgatgcagtgccagattgttttacttataatttatttgcaataactccatcatctccatttccttttcatgtatgcaactagagtgtcgccaaacggtacgtggatgaataccttggaggcgagagattcatcagtctttcgcgacttgggggcaagtggggcatcaggcttttgctggtgggggtgggagtggcacaaggatggtaggtggatggcaaaagtttgtgaatgagaacgattttggagtgggggatatttgcctgttcgaactgttgaagaatcataagggcacaatggaagttcatatcatcaaggcaaaggatatcttttgatcgaaaagccattctgtttaaatctgctgattttactgaattctgatgaatgttgctggtgcttttgtgttgctgagaatggtagcctatctatccagtttatgcaactaattaatgacccaagtgattactgatacttttggtgcaatgctgttatagtaaacatcagctgttcaggggcgttaagcagactttcctctgttctttatttccttcggttctcagaattatatcacatttattgctctcaaatacaatccagtaaaaaaaaaatatctcgttttgatgcacctcctatcgaattcctagaacttgaaacatcaactgcatatttacgcatgctcatgggatgtatatttacagtaacagtgtgtgtgttcgcttacaatttcttgttacaaaaatgattggagagatgtctccctttaaatctcattctcaacacgctcgtaatctcttcttcaaaaaaaatatcatttccaacatgctcacaatttcttctttaaaaaatcgttcccaacacattcacaattttttaatactttctttgtttcaacatattataagtcgctttgattcttctataattaaacttatttaagttggaccaaatttatagaaaaatacaaaacaaacgtatcatcaaattatataaattgagatgtttctaaatttgtctataaatttaatcaaacttaataaagttattttttctataaatttaatcaaatttaatacagtttaattagaaaaagtcaaaacgacttataatataaaacgtgtggtggtattagatttacgtaccgaatttgaggattataccaaaagttcattttacaatgctacgctt

SEQ ID NO: 78421 - DNA, 6675 bp, Oryza sativa
atccaaaaagaaacttgagtttggtacacacaattttgttgaaatatgcaaaaattgttttgaaaaaaaaattctagtttccaagatgtaaaaaaggttttggttttcatgagggcacccactgttcattctgccataatacaagtctacaacttttcctttgtaccttcaccttgaaacctaggatgaattttaaagggagtttcttaggtttgtacaaccttatatgttctacagtcacaatgtttgaattctttaaatcattgcagcatgtcaaaaatttgagttttcagaaacgggtgacatgggagactggacccttgaagattaaataattatgatgctcatgacagcatatagtcattgatgagttgggctgttgcagtaggatgaatactagggacctagtaaagctttctgttgcaactgcattcgcttgttcccagttggctcatcccttgtctaactaggcctcgatggttgcagctgactatttagcacacacaaagcatgatgaaggagatgggttacgatgtttatgcttgctgaacttgtatggtaatgtaggatagtaggtgggctggttgatttgttttccctttgcccctttccttttattaatcacttctgcctgtttttctctctgcattttcagtttcaatgctttctatggtattaactcatcacatgcctgatgccatggcatgtgatgagtatgtgtcgtggtggtctggtaccattcctcgctacctttaggaaccatggcgtggatgctatagcaaattatcatgaatgcttaaacacatcatgcccaggcaaccaattctgtctttttccaaatccctaaagcatggtggtagttgctttagtaatatctcatacagtcatactttccatgcatcatgctgcaagtcttcatttgtttagtattcttgatgatactctgattcagggagcacctgtgagtagaagtataacagagttaaagtcactagggagtatggcgttccagagcaagaactatcttcatgctgcaggattctacagtaaggtattaacaccatatttttcctgtgtgtttgccttttccaacctttttctcaattgtgtaaattatagtaagggggtgtttagatccaggggtgtaaagttttagcatgtcacatcgaatatatggatacacatttgaagtattaaacgtagtctaatagcaaaacaaattacataatccgtatgtaaactgcgagatgaatttattaatcataattaatccatcattagcaaataatgtttactgtagcaccacattgtcaaatcatggagcaattaggcttaaaagattcgtctcgcaaattagtcgcaatctgtgcacttagttatttttttagcctatatttaatactttatgcagaagttcaaacgttcatggagagggatttaaacagggcctaacttgtgttgttcactagttcactagttgaacctggcaaggatcatcggagtatatgatttacaggggttctgatatggcttatttcgtattattcttgaacataaacacgtgggacttcaaacatttggaaaatgtggtttcagaatgttttaaaatgcaatggaatcaatttgaagcattttgcaaaagaaaacagcctttcatgcatgcagattttgatatggcattggctgatttctaagattctggtcaagggacagtgaattccctgagtgcatctgggcttcagttggcccagttatctctagcaactggataggatccaaataatagccagctgcattctttatgttatcgctttgttttgttttaaattatctggggcattcctgcatctgcaaaaaaaatatatgttgatgcagtcttacatttgccttattgaggatagtgtccattttgtgataatggaaacgtaaacgtgtattcaccaaattatgtagtgcacggcagtactgatttttttttaccacctttttatctcgtgtcataaaatagtgctgatttggagttctgtgctttgtcagaacatagaaaaactatgttagacaggaaaattatcttaaatatcatattttataagagagaagctagctgtggaacgaactatagcaaaatgtattttgaatccagggtcacccacgtcccccttcagggaaaatcaaatattacacatgttcctgtgattttaattttctgagaaaattcatgaatatagtgcatataaagatggcaaaaatttgctataggacactcataaaatgtgtaattggctgagagacaccgtaaaaacgtgacacagctgatggacactaaaaaaatggtgtaattagctataggacatcagagacaatattttataattccagggtcaaaagagatgaaaaaaatttcaaaatggcgagattgcccctggcgctatcttctttcacctgaaatcacaaaattagctgggagcagccgccgcgcaaggttgtcgacggcgagtcagcggcggcgcggagcgtgtgcaggaggcggccacgcgcgaggcctgtgacggcggctgccacggcggcgcggagtgtgggcaggaggcggctgcgcgcgatgcctgcgacagcggcggccgcggcggcgcggagcgcgtgcaggagctctgctgcttgcctgcttctgctgcgcagcagcaattgttgtcttcggtttggatatgattcgcaggatggcgaacttgtcattgccgtcgctgcgggaccagccgccgacgccgatgaggtcgcgcaggcgccagcgccgcgatgatgaggacgacgactctcagccggcggaggcgctcttgggaacctgtcgtggatgggcgagccgtgagatgaagatggcgccaggggcaatctcgccattttaaaaaatttctcacctcttttgacccataaattataaaatattgtctccggtgtcctatgctaattacacaatttttgcagtgtccatcagccgtatcacgtttttgcggtgtctctcagccaagaacatattttttgagtgtcctatagcaaattttgcctataaagatgtacaaatctgcaaaaaataaattcaaaatccatcctggttttcaaggtaaaaaaaggacatgttgcatcattaacaaacgagcaaatagtagacatctccatgaacagcgctgcttgtctccttttgtatcttgaaatctaggaaacaatgaattgattttttgctggtttgcacatcattatgagctttttctggaatttacaatacactgcaacatgctgaaaattcaaatttatttgtaaaggggtcgccagtgaccctagacgctagaattgcattccagaatatatctggtcaagtgtttcttttaaatatttgtatgaatctatgcacaggaatatgcagatattttcatatcttgttttggtagttctgaaaattgtgattttttttaaaataaaatcttgttaatgatgttgtttcttgttggatgcaggcaatggaccttgaccctgatgatgccaccttgttctcaaataggagtctttgctggcttcgcagaggtcatggaggcaaggctttgctggatgctcacgaatgcagaaaaaaacagcctgattggtcaaaggcctgctaccggctgggcgcatctctgatgtcactgaaggttagaacttgggagttatcctttttggctttgtgctgcaaattgttgttttgatcatgttcttttgtcatcaggactatggaagtgcgtgcgatgcactttttgatggactcaaattggacccagcagatgttcagattgagaatgcgttacggtatcccatctttccctttgtatacataactaatgtagtcagtaatgcagtaatgtttaccatgtgccagttgctagtctctatgaacaatgaactccatggcttagctcatcttttgtcgttgtcgttcatatatcaaaatctttgtgggttcaaggtcgattcacactcaactgcaaaagagttgtgaacgtgtttctttttattatggtgttttgggtttgttaggattttgcgaatccaatgtgcatttcgatgaaagtcaatgcattcatgccataacatcacacttacgtaccttccatctccacaactatatttctatgaattatttttactacatctgtcccagaatataaaaatttttagggttaaacatgggtattaaaaaagtaggtagaattaaatgggagaagattatgattgattgagaattgcaagtagttgagaaaattgaatggtggaaggtagtgattggttggtaggagcatgttggcgaagaagttgtattttgggacaaaccttaagtgttagaagttgttatattttgagacgaagggagtattttgaaggcatagtgtttctcattaccatgtgttgtcacgtaaggttacccttaccgctgttaactaggcttaccgcggggtacggtaatggttactggtggtaggatttggagaattttgaccaaattcaaaatttcaaaaaaaaatcatggatgtagttcttgttttttagtggcggatggtgaagaattttttttaaaaaggagtaagataaaatcaaattgagtgcaaagccgataatagtttagaaaatagaaaaaagaaaaaagttattgggccttaaagttgcactgtgcaaccggcccattaaggcccaatacaagagaaaatatctccataatataaaaaaaggccatgtctaatttatgcattttacattcaaaagttaggttagcaagtatcgtatatattcttctaattatttctaatttatacttttagtggtttttcaatttttttagcattattctgttcagctaaacaacttgcggttaccgcataaatatcacggttaccgcatcaaaccgtgtccaaacctccaaatttttgaattcaaatattcgccgacgaaattcacacggttttaggtggttaccacatggtaaccgccttactgcgggggctagggatgctatgtggtaaccgccttactgcgggggctagggatgcaagtgggtagtcctattatccgcataaaaacctgcttgctagtttatttcttatatggtagtacaaaatttagaagaaaaaaccagcttacccgccccacttgcatccctacgcgggggtgcaataattcccttctaaacggtaagagaaaccatggttgtcaagcattggcaactacaggccaccacgtccagcttaaagaaaatgtttttaggattgaatgtggtcaaaacttctgtaccaatatctctatagtattcatactgactttgttaaaacgatgtctagattgtcctgaaaataaatgttttcatggcagtaatttttaataggttataacatcatagtacaacagaaactagccttagaagttccatgttccaaaatgagactcattcaatacttgtggttcttggaatatgcagggaagcttttcagaacttgaagttatctcgaagcaccaaggccaagtgaacttgttcttccttgatggggattcactggtggagaaaccatctttcgtcggtcggccgatttccacaatagtcccggatgcaataaaaaccggggctaaaaatgatctttagtcccggttcaaaagggtagcgggcatatttgatctttagtcccggactaaagatgatctttagtcccggttcgaatgctgtcagggcctgtcaggccccaccgggatctttagtcccggttggtagagatcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttggctccaaaatttatttgtaagttgatgagagagaaaatgtgtgtggggaagaaagaatatatagaaatttagttcatttgctaaacagggttttataaaatagttgagaaggaaaactctagtgaaagttaatcttaaataatagaaaacaaactaaaatgaaaattaaaagaagtaaaacacattaaaattagtttaaaactttacgaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaag

SEQ ID NO: 78422 - DNA, 2034 bp, Oryza sativa
aagggaaatagcttaaaaaaacttatccagatatataaaatttattatgcttgtgacaagtacttcattcgtcccaaaaaaaaatggtggaggggatatgatttcttctaaaacaatgaatctgtactacccttttatccagattcatgtagctggggatgtgattttttctaagacaataaatctgtactaccttttatccagattcatgtagctggatgtgacttcttcctatgtagtagcagtacgtcagatttagcagcagtgcatagagatagggcaagatactgtacggagtatttatttgtgagaatcgtaaaaatggaagccacccgaatcggcacttatcccatagcttgaccctgacgatgcgactttacctacggtttgcagatctgatcgtgcagaagcgcagtgccgggcccattgcacacctgtgagctgtggcggctttcggccttagatgctcggtgggccataggccgagatgagaagctgcgaaggcccatcaaggaacatcccccgccccgcgtactaggccgttatcccaggctcccttgcgccgctgggctattctcgcacgcgggccgtcaggccgtgtggactgaacaagttgggccacccgcgtacacatcatttctgggccagtacaagaatcgaagatgatctctcgcgtttgtctgggatttttggggttctaattttgtacatctgttgaagatgctcttaagaaatcttctttttatctctctctctctctctctgaagaaatcaacagcagctgcaagattttatctaccttatcagggtaaactaacaaaagaaagagacaaagattcttctccattccagagtcaaagagagaaaatggaactattcaaagaggagaaatgggatgattttgacaatgtatcggttgaaaactctccaaataattgtcatctctcccagccttttgaccctagacttttgtgcgcagccgcccacactaaaacagccacaaaagctacatggatttttcagatcaaatgcagacaagccaagtaatcctcatcagagattttactttgaaagcgtgtgcttccattcatacgtttaagtatttccatcagagactgcttctccagatgagaaatggtcgctaatactttatccaacttgtcctgcatttaaatatttgaatcccaaacaacattccaagaagcatcttttccgcacgtatcggtctatttaaaactactaaatatctaactaatttataagatgcgttgagtgcgaccatggattggatggtagggtcacagctcaccaaatatgcaacgactcgatcgacacttcgacgatgccatatagtagtatattttttttgtctgaataattctatgctcaggttcaataattcgccagtatttttggcttatagtagcactaattcttcacctgcccagttctagattttttaatttacaggtgattcgcccatgttttcagcttcaatatgttttgtcggaataatgctcaggtccaataatagttcaccagtatttttggcctgtagtagcatttcttcacctgaccagttctatataaatatatttttattttttttgaagaagaacaattccattaagcaggtagtccagctgaatcactagctaccaaattgcaaacatcatccgggaatccttcaagccaaacaaattggcttcgtggacccagagaagcaccaattttagcaagctcatgcgcagcacgattacattctctaggacaatacatgacttgatggacattaaaattcattgcaagcaaaaatttggcctctctaatgataacagcgtttacacttctatcatgtgtttcatccaacaaagccgctttcagagcttgagcatcagtttcaacaataatgtggcccattcccatatcattagctaatttcaaagcttggatgcatgctaaagcttctgcatccaagctttcctcacatgttctatataaagattaaaaatatatttatatgggctgcaggaa

SEQ ID NO: 78423 - DNA, 28766 bp, Oryza sativa
ctttgtgctattaaattttcttcttgagctccgaaaattcacgaaaaattccggagagtattttagggcacaaagaatattgcaaaatattcccggccaatgatttttttaagggaaaattttaattctcccattacttcacttgattaaattgatttaacttttatttaatttctagaaaatgcattatttaatgatttttaatcccgaacgaaaatcggggcgttacagcgagcaacggaggctgaagcggcgtcccggcggcgcgaagaggcccttgaagcccgtgccatggcgctggaagatcatgccggcgccgtggagaccagcttggcggaccgcgaggccgcccccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcaccgcaatctggaatgcgtccgcgccgagagagccgcgctggagcagcgggctgcctacctcgaggcccgagaaaaggagctggacgcgagggagcgcaacggcggggcggctacgggcgaaagcgacttagtcgcccgcctcgcagctgccgaacacaccgttgcggacatgcagtgcgccctggactcatccaccggggaagccgaagccctccgcttgtcgggtgagatagggcccggcatgctttgggatgcagtcttccggctggatcgcgccggtcgggaagcgggcctctggaaaagccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgctagcgagttaccaggccagggaccccggcttctccccatggatggcgctggaggagttccctcccgggaccgaggacgatgcacgcgcgcgggtccgggatgccgccaaccacgtcgtccaaagcttcgaggggtcggcccctcggctcgcgttcgcccccagctccgacgaggagggcgacgccagcggcgaggacgacggtggcgacgaggccagcgacccgggcgcattggaatgagcccccaggcccccgccaatctccaattttttctttttctttcttctttttgtatagatcaacttaatctgcaatcaaaaatgatgaaaaatttctatgttaactttgttttgttatgcatatgagttgaggatgatttgtgccgtggtccttttgcattttagcttgatttaagggctcgtgttcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctctaggaaattgaaactgcttttactgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgagatcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaatggtatgatctgcagggcctgggccggttgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcagttcaggaggattccgttagccgcgcgccgatagagggtcccttctaccagcacatagcgtttggaaatgcgttgtacgcgttcactcccttcgcggtcttcaggtagagtcttatctgtgaggtatgtttggatctcagagatccaagcgatcaatctaagggagcttggagcgctcccttcgggtcccgaggcctggactccgacgggcctcgggggtcggtcaggcgcatccgtctcccctaaggggtcgggtcgcgccgacggccgggtaaggctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcacctaacaccaggagacggcggatccccagtccggctgccaccctgagtccggcaaggagtccctcgtactctgccatattattggtcgctcgaaagtcgaggcggaccagatatctaaggacgtctctggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccactgtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttcccttagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcgcagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagttcgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccagcctccagaagtctcgccacttcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccagggcccggcatcttcatcaggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggactcatcatcccctcgttgtactgcgtgcaagtccgcttcttcacctgggcgtggataggtgccttgaaagttcatggtgaactgctggcacagatcctcccaggagtggaccgacgcgggtggcaggttcattagccaaccccgcgcctgccccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacgccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagcggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcactccctggggcgtgctgccgtcgccgtagacgaggaggcgtcgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcgcactcggagagaggtcgtgcgcctttgcttgctcggccattaggctgaacaagggaaacttgacccacacggaagagtatgagagctcagaaaacacacgctgagccccctacctggcgcgccagatgacggagctcgtggctcctcaccgggagaccgcgcaggccccccttttgccagttcggccgggggcttagggtgagatctcaagctctctctgtgtgtggaaagatcacgtgcccagaagaaacgcgagacacggacgatgtatacaggttcgggccgctgggaagcgtaataccctactcctgtgtttttggtggatctgtgtaagagcaagttacaaaatatcaactagccctctcctcttcccggaaaaaatccagcccccttctctgtgggcatggtcctccttttatatcttaaggggataccacatgtacccttccctttccaaactggacttttcttctctttatggacggagattggtatggttgccgtccgaatgacacttcgataggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagacgcaataaatgcggttaggtgagccctatcgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacacatgtccccttgtaaccacccagttgcgcctcgatactcgtgcactctgtgcatgtatcgacggtcgccttcaaacttaaaatctgagtaacaacttgggtaaaactggagttttacaaaagacttggaaaacccgacacctgggtcggtgcttgcgaactaaatggattttccaaaaccgcggaccggggaacgtaccgggtgtacggtttcccgctcttgcacctaaggaccgtttccttggaatttcatccgaacataagacaagtacgaccacacgggtggaatgggacacccctggctgagtaactagcttatcaggggagccttgatgccgagagacatgtggattcgccggggtggtgttggggatgacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtcccatctgtgtcgtttgagaagcactcacctagtcgttttagaaaaagagttcaaataaaaccaattgaaaaaacaacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgatgaatggtccaagtcctggcttccgctttccttttgtaatgcagttgtgagctcgggatctgtccgcagcccaacatgactgtacatctactctataataaagagacctctgttgctgtgatattctgtctccctgtgatactagtactgtttcctgggactggtatcgattaacaggttaatttggagcgtcacgggctagttccggtcgggactagttcggggcgtgacaaaaactcacatatttttcgcgcacatatttcttaaactattaaatggtacttttttaaaaaagaattatagaaaagttgtttcaaaaatcatattaatttatttttcaagtttaaaataatcaatacttaattaatcatatactaatggctcacctcattttatgcacatcttctaaatttttactttccacctctcaaacacacccttagaaaagttcactgggtttaatctaacgtaacacttattggcatctaatcggcgaaacaacttaaaaaaaataattatggagcccaggtgagctgacatgccattctatctccttttcttcttcctcctgactttcccatatctttctccaccattctgttaactagtgctcagtgggtggtagccaccagcctcattgcgtgcaattggtgagctccatttctcctatcccatgtagtacgtcgtggagcttgagctggagtagcattggcaatgggtgcggagcttgaactcaatgacgtagcagagagccgacacaatggtgcaaccccatatatcacccaccgcctagctattggattgccgctagctcttctttactttgggacactagctatttttgagcaaaatctactcttatactcttgatcaataatagaaattattggtgggctaaattccctcctcatagacctttattctcaacccattacaatctactcttgatttaatcatgatcaatggtgcagattgcatcatccttttgtgttgggaagaaaagcctagccttcattaagaaggagagagagtgagtatcatcagccattggagagaataagcaacaggcgaaacataagagggagaggagagtggaaaataacagttgcagtttgttcagtttggtggctcttacccgattttcattaaattagtgattagaggtttaaacatggttggattggcatcaaaattggtgagttcattcctcgcttagagcacttcaatatggtcagtttgtgtgaggattggttgagtggagcaccggatttgagcagtggtttgtcagctcgagtgactacaatttcagcttgtgcaatatttggtagaatgttggtttgaggggtcacacaatgtctaattaggctgtttttttggacagcttgctcatagaccatcacttctgccaagttttgtgcaatttgcttctgtagtttgggatatctcagctgagaaccaaaggggacataatccgctatttgttatattgttgttgttataactcttgttagttgttacggttgataccgataatgccaagtatgtaacttgatgatatagctgttgtttgtaatgtgtctttaaatgttctagaaaagactccatttgtacccatttttattgtaatggaagtttggagtggaccgttcgttccagggttttttactcctcacaccgagaagttttttttacgtaaatcaccgtcttttgtgtgtatgcgtttattgttatttcattgctgatttgctagttaactatccttaaaaaatcactcgcttgtgcgagatatatttactagttggtgaattgttgcttgcacattgaagtagatttggtttagcccaaacaattatgttgcaagaacaagtttttccatcacttgttatgtcacaagaatatacactagctacttttctattaccggctctaaaatacgagatttggaggatgagatgtccctccaaaaggaaaaaattataagcgtgttggagattgaacacgagacatcccaattgaaaccacacaaccctttactactgcactaagtgcatccctctattactggctctgttgaaagaaagaaaataaatctatgtttcggaaaacatcggcatggtaaatatacaggagctccctataccaacattgataatgctgttctctcaactgcaatggttgggaacattctatttgtcatggtagactttactgtattgtaatgggcttcatacaggtaagacagactttttaatcttttcagcctacatgggccggcatgaagaaaatgtgttaaggggaagccggcatgaagaaaatgtgttaaggggaagctcgatcaagaagaggaatcatatcaacggcccaaataaagaactttcgggaagaaagcaaagtgatgataagagaaggtctgatcatccatcttttttctccttttgaaaacttcgaattgcaagaaagcaacgaggacgcgacgactttattggcccccgatttgctattgatggcagcacgaatgcaaagcacaggctagtagcaccaagaacgaccagagagattactgccaaaaaaaaagcgagagattacatgcgaaaattttaaaacaattttaaaacaactcccattaaagcgtcaaacaaaatagtaacaaatcaaagcagcagcagcagcatctatccctgctgcctagtgcagcatttacacgttacgatcatacgacgtcgtcggttcgatcgagctcgcgagctctgaatctcgcaggctcgaatcggatggccgtctactcgacgccctcggtggatttctgggccatgacgacgccgagggtgatgacggaggcgtagatggagttgggcaccttgcgcaccaccctgccgacgccgggcacgccctccgtcgccctcttggtcgccagcgccagcgccggcgccgccaccagcgtcaccagcagcttgaagctgatcgcgcacagcgactccgccgtcagcttccggatgaactccgcgaactcctcccggtccaggagcccgtccaggttgatgtcgtactcctgttgcatcactgtatcatcagccgtgacaaatccttgggacaatcggacaaaggctaccaacctaccactatcagaattagagtcccaaagaaacgaggaacgcaacgaggaaaaaagtctgatttgattgtactcctttacctcactgagcaggagaattatgttagtactacttttagagtgtaaccttcgtcttaaaataagttccagaaatacaaatgaaaaaaaatatcaaattatcataatactctcatttctcagatcctaatgtaattatttctttttatctatacctaatgtatttattctctaattttacaaactttgagataattattacttaaataaacttattttagaataaatgggaaaaagttaaaaatgaactaattctagtatatgctatctccaacttcagagtttatagacaaagtgattccactgtaaataaggtgaaatagaatcattcacacctaccgagaaacagagagcagaaaccgagattactttgcttttcgtacaaggaaaagctgcaatatggaagaacgccaaagggaactactcctatctaattgaccaaactgattaaaaaaattaaacgaatgggatgtgaggtactagtggtttacattcatcatggccttgagcttctccttggagggcggatcatagtgcggccctggtaagtacttgttgatgtcgctgccacaacagccaccaagaatcaatcagggaaaacagatacggataacaagaactcatcaggaatttggaatggatttggttgctcctacttgtagacgcagaggacggcgatgtagacctcctcgaaggtgagggcctcctgctcgcgcttcttggtgtcctcggtgaggcggtcgaacaccttgtccgtgatcttcctcacctgcttctccttccattgcctccctgcaccaaccaattcgatccatatttcattcaccgcacaaacccgctactttcggatcgagcgatgcaggacaggaggacgcgagtcgattggtgatgggaggcaaggttttaccttggagtttatcctggagagacgcccaggcttgccccatggcgacgtcggcggaggagacgccggagtgggatgagatgggggttttggaagggaagaagataggagatggaagtatctccctctgtggtttgtgattctgatttactttagcctaatctaatcatgtgaacaatctctctctctctctctctctctctctctctctctctctctctctctctctctccaccgttgattttgggggtttgttggaggcctatgctaggggtactcgtgaagtgtacccagagatattcctctcctcacaacacgggtagaaatgcaaaaagtcgatctataatgattttttttaaaaaataaatctatagtgatattcatttgtatgaaaagctagtgatgcacactaatttcttttccatcctctagttagctttcttcttctgatggaacttgccatccatatttaagttatacacttacacatatactcgtatttacatcgaattattgtttcggtagtagttaatgtattttaaaaatagtgactttgttaatcttaagaatgtgttggaagaatgtacgtgcatgcttttatatcagtaagtacatgcgcgtttgcataagcatatgcatcgggaacttaatctatatacacaagtcttcccgtgtacataccgtacataccaacttaaaaacatatcataaaatattctatacagaattgtacaggtacttttagtagtattatatctatgagcaaagtttcattttcaaattcattgtatatagggagcaacaaaatagataaaattcagggaatttatattcttaaattgtcaaaaaaaattatactttttaagactaaaatataatgaatttgatgttaagattttatacataagtataattgacggagctggtggctcctcaccgggagaccgcacaggcccccctttgccggttcggccgggggctcagggtgaaatccccagctctctctgtatgtaaaaagatcgcgacctatcgaaagagcaagagacacaggcgatgtatacaggttcgggccgctgggaagcgtaataccctactcctgtgttttggtggatctgtgtatgaacaagttacaaagtatgaaccaacccccaatcgttctgggatcggatccccccctccaaaaaatcctcctctctaagtgggcaaggtcctccttttatatctcaaggggataccacatgcccctctctccttccaaactggacttttcctctcttcataaatggacggaaatcggtatggttgctgtcctagtgcgccagatgacgggacggcccatacctaccccctcttccgccggaagcaggtgcgacgtgggattatggctgtccgttgctgacgcgaccagtgtcagaccggtcacagatcggtcattcttgtcctccacgcgtcagtttagcaatctgcatgttcgtccttcttcatgtaacatcttgcctgtaatggttgggatgaagcctggtatatatctgaccggggctaacgtgccatctctaagaggcaacacgctagctccggttagagacgagtgcctagaggctctcgtcttgacgggatggggcgaggtgtgcgtcagaccgccaatcgccacctaacccgtgatctgaccggtctgtgaccggtcacagaccggataaaggaacgcgctgcactgcgctgcatgcagcgtgacacgcttgaccagacctcaataaacgcggttaggtgagccctgccgtgttcacctaacccatacatgtgacgaaaaaacccacaaggggccggggcgcctcggccctcggggccggggcaggagtaacccgacccccctcggggaaatcaggaggagggcggacacctcaccctcgggcccgacgtccccgaaggtgccaggccacgtgggcgattgtgtctgcctcaagcctctggtcacgatactcccggtcccatatcaccgacaataatattattggaagtacttataccttttttttagatttttaaggtgaaatttgttatttggtgtacatagttaccttggagtttatcctggagagatatgttcccacaaaatatatgcaaaacatatactactattgtaaacatattacttagcggtcctccaagcatgcaagtccgacccagttgcatccttaaaaagtagcgtaggataggcagatcatggtgtatgctgttccttcttgttgtggcatcagaccaatttttttctctctcgtcagccgtgagtgaatttcttgtgtatcatgcaacgaaatatcctgagagcccaaagaaagtttttagtagagttaagttattgatcgccagttgccttggtaacgctactgattcaattttctcgctataatgccagcatttcaattgcagatcaggcctgcgaaactactctcttgcgttactttacaaatagttccttctgatttagcatttttcatgcctgaaattcaaaggcctctctaacttgataatacactgtcatatgtactacatcagttaacgtgagtattatagagcgttaactgatgcaagtctgcaacccaaatgatggattaagctggtgtgtgtttttactcagtcactgcttgcccgcccggatgtcctgcaggaacatgaggccgacggagaagacggtgaagagcagcggcgtgggcaccttctccacggcgggcccgaccctcggcacctgcctgccggcgctcttggtcgtgacggcgagcagcggcgccgccatgatcgccaccgccgccttgttcgccaggacgagccgcaggtccttgcggacccactccatgatcagcctccggaactcttccagtgttatcccctcgggagtttccttcttgtattgctacaacgtgttgcagagccaaaacgaaaagttatataagccgtaacatttattagtgataaaaaaatctgtatatataatttttatatgtatattcttagcgacttaaaaatcaaatgatgaaaaaacagtaaaatcaaattaagttctaaaattcaaattatggttacgtagcaagctagagagcaaataatgtagctgaaaagatgtcaccgttacaacattatttaaacagcaagaaattgaggttgctggtactttgaacattgaggagcctcttccatttttcttttcagaaaagaggaggtaaagtaagttcgatccgtacctccatctgcttggcgacaacattcatgcatggaggatccttatgtggaccagctaactgcttgttaatcgagctgtaagaaattttcgacgaaaatggagaacaattagagaacatttcaggaatgacagagtgatcgatacctacgagtgatttgatcgatctcacttgtaaaccatgagggtggcaacatggagggagctgatgtccaggagctgcgtgttcttgtcggacagctcggtgaacaccttgtcgcaaatcctcaccacatacagcttgcctataatcaaagacaagtaggtaacacgaaacaaaacattaacatttgttactagttgtaaccactgcatgcatggacaagaagaaaaagaagaacgagatcgattaccttgtgctctgtcccacatacggcagaagaactgagccatcatcctcctctcttcgtcggagatgaactcaagaactcgtaaagtggagtctacatctaggatggcatatttatgcgaggaaatctgtttttggttctggatagatgccccagagtcgcttgcagggaaggcacttctttccttgcccctacagcaatctgaaaagggaaaaaaagaagtaagaaaagtcttcgttgtgtgggcctccggattggcggcccaagtggcccagtgtccactctactcgtgtcggattagcaaaaactgacacatcaatttacagccgtaatgatgaatagacgccagttaactgcctggcaaccgctcatcaggggacaaatcctcattcatcacaccataaatcactatttaaccatctactgcatctcattatcgcattcgctcaatcctagttccaagtcacaactcatttctgtttccactttccaaacgccgccagttgctccgccgaggcaagcgcccagagcacgaaccggcgatgatgccgctgaagaagaagatggatccatcggcgtcgaattcgatctccggtatgttcctttttatggcacattttccaattttccttattgattcaattgtggaaaacagcatcttttcttcatggcaatctgataatctgaggatgactgtaacctctatcatctcttcttcagcacctccctctgaagaaatgggagagccagagaaaatggatgagatggagcaagtttcgtctgatctaaagtcgttgaagacgctatatgggctgcttcacaggggtccgacggatgaaactgtgagtttttctaagaaccagactgaacatgtcgtattattatctatcttaatcttaatcttaactcttaactaattaaaagattagtatttttcctttcatcacaatccgtttcttccgtccgttcgtccgtccgcgcgatttttcttcgcccaagcgttcgtccgtccgcgcgatttgagattaaaatcgaaaccgatacaaaatccaatcggataatcctacttagagaacccaaatagaaggggaaaaaaggaaaaaagaaaattttacgcttcacagagaatgaaacaaaaaaaggggcgaaaattcctaacctccccacagccggttgtcgcagacaccacgcgggagtccgccgccgccgccggccgtcgctgacgcgcgcgggaagatctaccgccgccgcaggcacccgccgacgcgcgcgggagtccaccgccgtcgccgacgagcgcgggagtccatcgccgccgccggccgtcgccgacgcacgcgggaatatctactgccgccgccgacgcgagcgggcagtactctgccgccgccggccgtagccgatgccgctgaggggagacaacgggggaggggcgccgaggcaagggcactcgacgggggcgcactccccctcgggcgagtgcgcgcaccggcaagggggcatgcgccggcgccgccgatgagcgccacagctccgccgtgagagagggaagggaggagaaaacctatgcaatgttcggctaattggaaatgaaaatgatttcccacccaacaaaagacatctttaaatcctaaccattcattctccctctttcatttaatcctaactcttcattcatttcccaatcccaatcacaatccccatttcccattatccaaacacccctagggttttcgtcagcggccggggtgggggggggggggggttgtccctccgatctcaatgtccggccgtccgatcgaagccctagagatcagacgaccggtgttggctgggccgaattcggcccaagagggtggcgcgcggcacccactttcccggcccaggcccaagttgaggcgtgggaaagggggaggtggtgcgcccgcgcgcacttagaggctgtgggccggccgaaggaagtccagtttagatccctcggggggggccgaagaaaataagtttatttctaacaaaatgtccgtgcttcgctacggtgtatcaaaactaaaaatatttgtttttaaccaagttattttcacactgttttgttacttttgctatcggagagagggtgtcgtcgttgccgccgtcgcagggacgccggtccgccgctggctcccctcccgctggatccggcggaggggaggccgtgccgccatcgcctccctcccctcccgctaggtcgccgccccctcccctcccactagatctggcagaggggagggcaccgccgccgctgggcggccaggccgccaccgcctcccctcctctcccactagatccggtggaggggagggcatcgcccctacatgccacctcccgccgctggtcgttgctgacaggcaggggtagtccaccgccgccgccgtctccgacgccatgcggaagacgaggtcacgagggggagacgatggggaggggcgccggggcaaggccacttgacggcgccacactcacccacggacgagtatgcacaccggcgagagggcatgcgtcggcgtcgtcggtttccgcttttccagcgatgtggcgagggggtgagaaggctagggtcccgatcgtccgatcgaaaccctaagatcggacggccggcattggctggactgaatccaacccaagtggaggcgcgcgtggggctgcttccccggcccaggcccaggttgcagcctggggaggtgggaagcgctcgcacgtgtacataaaaggccgtgggccgaccggctaggccgggaaaaagtttgttctaggtccctcagcaacacttttttggtactgtacacactccgtaatcatcaggtgcaacgtaagggcacttttccttgttatattattaaaggaatagaaaaaggagcctccgcgttcactctcatggcctagaaattctcacattaatcggagaaaaggaaaaaagcagagcccatatagaaatacaatttagaaatagttaaaattcggaattaaaaaaataaggaatattagaagaggagactagagtccatatagaaatacaatttagaaatagttgaaattcagaattaaaaaataaggaatattagaagaggagactagagtccatatagaaatacaattaggaaaaaactgaaatttggaattaaaaaataaggaatattagaagtagagtatagagtccgtatagaaatacaattaggaaataatagaaattcagaattaaaaataaggaatattagaagtagagtatagagtccatatagaaacataattaagaaaaaaaatagaaatccagaattagaaaataaggaatattagaagtagagtatagagtccatataggaatttaaaactaactaaaattcggaataaacataataaaattaaaagtagagtttagagtccgtataaagacacaatttacaaataactaaaattcaaaattaataaaaacatgggaagaagagtttaaagtcaatataggaatacaatttagaagtaactgaaatttgaaattaaaaattaaagaatattgaaagatgaatttagagtccatatagaaatacaattagaaataataaaaattcagaattaaaaaaaaagaaatattaaaagacgatactagagtccatataggaatatatataatttacaaataactaaaatttgatattaaaaataattaataactaacacgtatataaaatacaatatgaatattacacattagtagtttcgtaaagttattgcaaaatttaaaattatgttgtcattgtaatatattttaataatactagaaaaaatgccagtgcgttgcgacgggtaaagtctattttaatcttattattgttatatgctttagttaagatgaaattcactgtgggagtttgcttgcatatataatttttttagaaaatcatgagatgcagttaggagttcgatcgtttcaagttagcatgtaagtttttttaaatagatttcttatatgattccttctatattaccaaaagtgaacgatcttaaaaaccgactcaaatacagatatgtatttccaaaagcaaaggaacttaaaaaccgactcatgcatagatgacgtaccaaaatactagcaaaaacacggatgaccgaccgcggaaacatcttcaatttttataaccgactcaaacacggatgatcgaccacggaaacatctataatttttataatattagagaagagatatagattaaaatcaaatcataaaattaaaaccgacttaaacacggatgacggaccgtggaaacgttttcattttttataatagtagagataatgagaaaacatatatgctattatatgagagaaaatataatgatgctaaccgcgcaatatgcgcgggccaccatgctagtttttctgaagtgaacaagaataggagaaagcataaatatgtttccatttttctaaaccgttttggtcaggcgtttctgaatagcagagcagggatttatttttcagtacctgctagatgctcgtgtttagtgcatattcttattctccttggggaaaatctgaagaaagaaaatgcacgtttagagttgctagtatcaattcatgctcatattatctcgacgttttacagttggatgaaacatcaagagccttcatgacgaagatgttagatgacattactcgtcagacactcctcaggcaggcaaaggtgatacattttcggaccatctggtcatatttcatttagacattgtttgcaagattgcatcactccaccttcatctccgttttaaattttcccggcaaatgctgatccaaaagaaacaccgcacgtttgcagatgctgtctcctgtgctggagaggaagctatctatccagtccgatcatcgccggacgcgcgacgacgccgtgccggtgccggtgccggtgccggtcgtgaagccgatagcctcgttcagccccagcctccatgccagtgagaaatcaagccggctgaggacgcaaggcgcgacgagaaggcgagacggtcgccatggccaggacaactaccgtctccttgctcgcgtcgcctcgaaccgctcggcaagaaccacagtgccgccgccggcgccgcgccaccgtcagagtccggagcgacgccttgaccgcctcgcctcgcgccgttcgtccagagccgtgacgccgcggcgcggcacggtggacggtgggaatccgctctccgacatgaggtgtccgcgccgtggcgacgactcgtcgatggagcgcggcggcggcagcagcagcagcagccgctccctctcccgcgaaccgtcgtcagctgtgcaggagcggggacgggggctgcatcgcggcgcctcgccggcggcggcaccgcgcgtgggagcggagggcggctcctcgacgcgccgtctcgggaggctggactccggattgtccgtaaacttggtgccgccgccactggcgcggcgacatggctctcagcgaggcggacgcggcgcggcaacaacgacgaagctgtcctcgtcgacggacgtggctgccacgatacgcagcagcatcaggccgagctcccgagaattcatggagcgctccccgcgtcgagctggtgaagctgaaaacgataggaaggaaggtgccgatgctgccagcgtcagcaaagggcggccaagccgtggcgaactctcatcgatgaagcgcggaagcagcagtggccgatcactctcccgcgaaccgtcgtcagctgtgcaggagcgtggacgggggctgcatcgcggcgcctcgccgccggccgcagtgcgcgtgggagcggagggctcctcgacgcgccgcctcgagaggctggactccgggttgtctgcgagcatggtgtcgcgccgtggcactccgcgagccggacgcggcgcgtcaacgccgaagctatcctcgtcgaccgacgcggctgccatgacacgcagccgcatcaggccgaaccgtgacctcacggagcgctcgctacgccgagctggtgaagctgatgaagacgagagcctgcggcggtgccgggggaaggggaaggggaaggagaagggcgatgatgatgctgccagcgtcagcatgggccggccaagccggccgccgcggcgagctctgaaccggatcaactccagtagcacgtacagtagcagcagctgcccaccagagccgacttcgagcacttcaggttccacttcgtcgtgggtgccaccgcgagacaatgcatcgtcgtgggcgccaccgccaccgcgaggcaatccgccgtcttgggtgccactgccaccgccaccggggggcaatgcgccgtcgtgggtgccaccgccaccgcaaccgcggggcattgcgccgccggagtacgggtttcaagtgtcaggcgcgtcgagggtcagtcgccaccttcgccggcaggagcgcctggagaggagagtggagcggatgaggaggttcaaggagaagctcggcacggtgttccaccaccaccacttcggtccctcgggcagcaacgagggggcgcccccgctgttcagccgtgacgtccacgacaacggttatcaccgcccgtcgccgtggaaggttctcggcggtgtcctccaccgcacgacacgccgtggggagaagaacaacgagggggcgcccccgctgttcagccgtgacgtccacggcaacggacatcaccgcccgtcgccgtggaaggctctcggcggtgtcctccatcgtgcgacacgccgtggggagaagaagaccaggagcgtgccggcagatcatcgtggcggcgtcggcggcggcggtggcgtcgggcacgcgctgttacacatgtggaacaaacggcgggcgatggcgaagcaacgtggcggcgtcgggcgcgcgctgttccaaatgtggggcaagcggcgggcggcggcgaaacagcgtggcggcggcgtcaggcgcgcgcttttccaaatgtgggtccaacggcgggcgacgacggcgaagcggcgtggtggcggcggcgtcgcgcacgcgctgttccacatgtgggggaaacggcgggctaccgcaagcgctgggatgtgcggtacgggaagccggtggaaggccaagaagttgcactggtggcagcgggtgaggccgcggcaccgttctggacatggaaaggcatttcggtaactggtagcagcttatctgtgtctctattactactagtagcttctttgtgtggagatgtggctatactattttgaaacaaattttgaattgtagaagttgctataatttaagacgaatggagtagcttatttgtaatttgtttcacagcttattgctctaagtaacaatgcattatcttttcattagaagcaaatattcctctctcaatagagggtgcaaagttagtccattctcatcgtgtggaacctaaaagaaattcattatcatcactagacgaaggggtacagcataatcatcaaagctaaccatcctagtatggaaatttcagctgccgcataaataagaaaaaaaaattgccgatagtaaaggcaaaatttaaagacaagggagattttgagaataaacaaaaagaatctcccattattttattcaaatgatacatgaaaggataatatttaccagacaggaaccgaggttttcaaagtacgaaacatggctgctgatgaacagaagcagtttattccgttattcggaacacggaattacagctagaagagacgaagttattcttaccaccctctcaaaaaataaacagtacaagtttgccatcagatgtatggcaaatcgcctagcagcaagccatcaacccttagttcttcacagtggtgacatgcctcagaagcatctgaatcacttcaggggagatacttgcagcctgctgcttgagttgtgcgattttttccgctgtctcctgctcaagacgcttgacatttgcaccagagtcaccgctactctggaaataacaaataggaccattagatgaatatgggaattgggaatgtatcctatacacacaagccttctacacaaatatgttcccgatgaacatacctctgcaaccttcctctgaaattcagcctccatctgggcacggtattcagctatttccctctcagcctcctcttttgcttgcctaagccttgccgattttgctgccaaacaaataaaaaatctcttacatcgcaggttatattgaaagggagaaagtttactctttttttttagatcaagatagtatcaaaaatctatagaagctcaaggtcatatttctatggttttatatccaatttttgctatgggataaaacatgttttgctaactaaaaaaaaaagcactttcacccttatcattttgtggctaagcctgatatctgcaatttcatacgatattcaaaattaatattcaagtgcaaagagttcagagtagattaagattcttcctactaaaattgatgtgtatatgaaaaaaaattatcattgcattcaatagagcagacatgttcacctagtacatctacatactactctctctctaatgttatgcttattcataacatttacggagagggacagagagttaccagccctagcagcatttactatttgctgagcctcttgctctgcagccaacaattgctggattccactttggcgtctgtttgcgtccatctttgtgctgctgaaggaagaatcagaatcaattaaaaagaactcagaaaaaaagaacttgatcagaaggccaggtaaaaccatcaaaagtccaaaaatatatggcacatctcaatactaacagtaaacaaacaggaagcaaatatgatcatactacattcaacaagaaagatctgatgctactgttgtttacaacacaaaaatataatggtccacacataaagctggaaatctaccatggacctaacctttgttcatatatattctgtttcaacctgctgaactacaacagtaatagcgcgtattgcctgttcctcagttctaattactttggattaatgaattaactatggactctcgtgtatagtatgaatagacctacccagctatcttataaaaaacaataatatcatgtaaagatccaccaacagaagttagcaggggcgatcacaagctggggcatagaggtcaagttaaaccccaaaatacaaactgctattagcaccctactgcacattaaaaaaatgtacaacaagctggatagatcatactattacacgcatagagataaagatttggattatatcaaccaggggcggaactaacgtggggaattgctaccgatcttttcttggaatcaaattgctataagtactaaggttaaggttaagggaaagagaaaagcttccagatctagaagacaagctgaaggctaaggcgaagagataaggcgtcggtggagaagagaatgagaatgtcagtacgggtgctcaccggcgaggatgcggtggaagcagaaagacgccggcgccgctgctagccggaggcggcgggcgaactctctacgatgaggaaatcgaggccgatggaacagccagatcgactagggaacaaggaatcggaggccaattaagctatggccgggaacggtgaaatcgaccagggagcaaggatcgagcaagatccagcaacagaggctagcgaatcaacaaatttactcaatctgctactatcacccaatcggatcaaacgagcaggatcaaaatcgagaaaacgtattagggtcagcaccgaacgcagtcgattcctaccagatccggtcaaattgatagcaacacgaacacaaatcgagagagagagatcgcggggagagggatcgagttcaccatacctgcgagagagaagactcgaatcgaacccgggggaagcgacgagatttcgatggggaaaatctatcttccttcgtgctgctcgcccatgggttccaagcttatttattcatgacgatgattaattaatcccgtttcgtcatatcgttggcgggccgtaatgggaagcccaagtgtaatcggattaggaagcccgctagtatcaaagcccaagcccaacacgacagcaaatatctctctcatctcatctcttctccaaacccaatcaaaaccccatccgattcctctccatttcaccaccaccaccaccaccacctccgcctcctctcctccccttctcttcgccggcagccatggccaccgccgcagcagcagcgcgcgccgtcgcggccgccgggcgcccggcgcagggggttccgttgtcgcggcgcctcacgacggcgtcgtcctcctccgctcgcccgctgcggcctcgcggcggccgcgctgccgggtccgtccgctgcatggcgcggcggccggagtcgtcgtactcgccgctgcggtcggggcagggaggggaccgcgcgcccacggagatggcgccgctcttccccgggtgcgactacgagcactggctcatcgtcatggacaagcccggcggcgagggcgccaccaagcagcagatgatcgactgctacatccagaccctcgccaaggtcgtgggaaggtaattgcaacaccgtgtaactcaattgaaccacccaatgcatttgtgcatcatagaacgatgctaattttggatgactggtgggtggtggcatgtagtgaggaggaggcgaagaagaagatatacaacgtgtcatgcgaacggtactttgggttcggttgcgagattgacgaggaaacatccaacaagctggaaggtacaccgtgatg

SEQ ID NO: 78424 - DNA, 3414 bp, Oryza sativa
gatcatacgtctataatgcattgtatgtcctagaatagggcccttttggcgttccttcgtagatctacggatttcacccctacacacgaaattccactctcctctgtctcactcaagtgaattggtttcgagagcattccgccactttttggtgactttcactttcaacccgattcacccccaagacgatgttggcgcagaagcaataaaagtatgatctcgttgtcgctttcatcaacccggaacgatagtgtaggcgagcccggatgtagagatggatgatgtgtaaccaaagaagcagtgcccaaaatgcctctagaaagatcagacagaagtaagacgagctgtaattgtacgtacatgtaaaggagcttagtatggagttgcctggattagatcctcgttggtccttgaagaagaaggcggaagacttaaacccttcatttcctaatttttggttcggctctcctaaagaattgacttcctagagccacatgtttcgtcgtggtgctgatcgcgtggtttgcctcttcgtccaattttagaatactttttgattttttagtcccttatcaacatttcatcaatatctccatcttccttgtcaagttccctaaccccctttatagcttcacgctgtttgaatagttccaattaatggaatcaaagtcattacacgagtgagtttagcaagtggaatatctgactttgaaggagctgctgcgaggtgtatggtttgagtacaattaattcatttttttatgtatatgtatatatatgtatatatgtatatatatatatgtgtgtgtgtgtatatatatatagacatatatatatatatatagaagaagatcagagtcaatactagaaaaatcatttttctagacgatgacatttttttctaggcaggtagggctctcagagctaaatgaccacttgcgaaaattacaaccgtggggtgaaatcgttatccgcctgcaaaaatctattttcgcaggcgaaccacttaagcgatccgcctgcaaaaattccatttatttttgcaagtggacctcttaagtggtccgcctgcgaaaattggcgtggcatataaatagatgcgacatcaataatattttttctaagtcctatcctctcttctcccccagctctcctctctccctcagccctcagctctcctctccctaagctccctcagcgaccgtgggcgttctggggggcggcgacggcaaggcgcggggccggtgggcaacgcgagcgcgaggtcagcgatggcgaggcatgggtgggcgacggcgatgcaccggggctacggcatccaccctcggcgcggctccccttccctcccttctagatgtggcaaagagggaggggagggcggtggtggctgcggttccactacctcccagatccggccggagggaagggggagggcggcggcggcggttcccctccctccccaggtctggccagaagaaggggggagggcggcggcggttccccttcctcccaggtccggctggagggagggggagggcggtggcgagcggctccacttcctctccctctccctcccaaaaccctaacctagatcggccggaggtgggtaggggcttgggtgggattaggcccataagtttgtatacccaagcactatatatatttcactaattatccttgccaactcttatctaacttgtggctaaggattacatagtcagataaattgtgacatgtgacaccttagttgtaaaagtttggtaaattaaaacaagctttcgaacagcccattcttcaacaaaaatatttcgtagaggcatttaattattagccctgcagaatatcgaaaactacaatttcaatacaatggaaagtacatttgtagtttgctttgttttatatttttacattaatcttgatgtattgttattattttaaaaagaaaatcataatctcataacagtttacaacaagtaaaccttgtttttccacttctaggttagaacattattcgcttcaccataagaaaagaaacatacaagtgtgagttgtttgtattgattcggtgttaaataaatgattgatagataagaaaaatattagccacttgacaagtagactcccccttagaatatttaattaactagatatgttaaatattattttatatttaactgtccaagctcgaataattcgtagtaccataaagctatccctcattatggtagcaacgcaagagtgctgaggtcaccttgatgacgtttaagaaaaacagagagatcacccagcttgatgacgcagcgaaattatcctgtttctatattgaaatctaacaagaatcagaaaataaaaaaatattggagcggttaccatatgatcagcaatttgtcgagttggaatagcatttacctaaaccactaataaagcatatacatatgggttgtagaaattcaaagatatgttttaactctctctttttttatgtgggcatatatgccaaagatgatatgttggcaagagacattattgaaacctaattattaatgacctgtttaggacttcagttagcttccccaatgtttttttttttttttgaaatgcacatggcattctcttcatctggaagctagactggaacattttgagctgtgccttttggtttcaacatatgggcaacattcccatgccacacatccataaagaacatcaatctggttaaagagatttgataaacaagacagggatttgggatatttggtagtactagcattgtacgcagtggcgttttgggccaattggaagactaaaaaatacagtgcatggttttaaagtcatgcgtatgtgatttataatcatgtaaaaatattgtttatatgtgttgtttactattggattattttggttttaatttgtctttctacagaaattggagaggcagggaagttaaagacatgctgttggaagacaagtggcaggctgacagcagaagtttcaaagaatcggagaatattaaggacggcgggatgggcgctcgctcgctgcgtccacgtcggattttgctacagtagctacagtgcgcgcggggtggaaattatgcgaaaaagccctccgatttttcgtaataatgtataggtccctagcgtcctgtgtttgaagaggaataatcgcggacaggggcttttttgtgatatgtgaaagaagaggggcttttccgcaaaacagcatccactaacgcataccccccacagccctagctgccgcctctccctctcccaccacccctcccgcgccgccgccgcctgcgcctaccctcgcgccgccgccgccgcctcccactccccctcaccccgtccacgtcgccgagcgccaccgccgcctccactcccgccgcctgcgcctaccctcgcgccggcg

SEQ ID NO: 78425 - DNA, 2932 bp, Oryza sativa
tggcgacgacgacgacggtcgatggggtcatttcctccccacagaggtgggggtccaagctggctgcggcaaatttagtttgttcacgctgttcagaaacggtggttgcgtttcatgtgtacgggctgcgttgattggtgcatgtgaaggcacgtgtctttgagtgtgtccgtggcagcttgggcggtgcatccgtggtaaagaaggaaggggacggcatggcattttctggatgcactcgcatttcctcttcgtcgttggccgcgccattccgtgcgatttttgctccgatatcagcggctccattgttttgcccccctgatttggtattgaatcgatgctctttctatctcagtgccaaatctgtatgcctggtgtgatttcttcctccttatacattttctccctggtaatggatggccagttaattggtgttggatgtttgcttgctgttcttcctcgcttgtctctgcatatcatagcatggtacaaatcgttcagggtgcctgctcacaccactcaagatgctctgattgggccattgtggtgtatgccagtcgagtctcgtcgctgcgggagggtcccaccagtgcggccagtgtcaggtgcactcaccaccactcgtcgttcgagggcgggacagagaactcgagcatgcctagtcaatggcagccggtcatcggggctgcgaggtgattggtggcgtctgtgcgtgttctggcgagtagtcggtcccacggctttagccaatcatgctccactgttgttcgggccccacgtagtcgtggtccatgccaattgcagttggccgttgtagcaggctccgccgatgtgccctttttccggcgcagtgttactgctcggtgtgttacgtcggagagctcgaggatggcctccgtcagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcgccatttcctttgcattgccttttggtgcccgttcgctgttcttcttgtcgtctgttctagcccattctccgctgttgtgctttcttcgttcgatcatgaaccctggggggtgaacgcgtgggctggtgggttttctgtatctagcctagctgccttcctttgtgtctgtgccgtgtgtttcctttttatcctgtgattaggcttggtgcatctcaggtagccatgtactggcctgtttgttgcacgagacttactgtcacagagtttttaggttttaggcgattttccccgtgttcatatttcccttttcacagtggatcattgcttatctctgttgttcttcttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaacctttgaattcactt

SEQ ID NO: 78426 - DNA, 633 bp, Oryza sativa
aaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagttcttctcgcactgatgaccaagctgctgataagcaacatgctgtgcctcatgaggttgatgtttctcagattgcagctgcctctgctgaaccaaatactcaggttaagcataaatacaccactttccagctaattcagtggtcgaatttttttagtgacactggcaacctaattattcccgttctataggtcaaagatatcctgccaactgaagccaaaaagaaaaggtataaaactacatattccagctgagaacgaataagaaaatccctatttttgtactagcggtggaagcatgtcacattcattgttaaatagactgcaccatttcgctttcgctgctctctcatttttggttcttctagattaaccaggtgttcctctctgctttagtgttgatc

SEQ ID NO: 78427 - DNA, 2323 bp, Oryza sativa
cattcaactgctctatcatcatcagagtaataatcaatcagtccacttgtcgtcgatcgaggtcatcacctgcgtcgggatcgacccgtccgagcgtgacgacgcgctcgctggcgatccagaagtggtcgtgggggagaaggctgcacccctcaccgcccaggctctgcaaagacaaagggattctcctcagctttctcgtacgagagaagagatcgcagattcgaataccgggggaaagggaatctcccggagaccttggaaaagggcgcgcggtagaggagcgccgccgcgagcgccgccgccaccgccagcagcggcaggaccctgcccttcgccgccgccatcgccatcgtcgtcctcctcctcctcctcctcgcgctcgtgacgagacctcctgtccttttctgcgtctgcttccttccttcctcgcgtgcgcgtgggctgcgcctccactggctctgggctgacgtggattcgggtatctgagtcgggtgggagtggatctgtacacctggtccagtggactggtgggtacgaggattcctgtggggcccacctgtctgtggcgtggtctagtggaccgcgacctggatgatccgattctggttttgttgcgttgtgtgagggcatccaagtggctggaacctttggagggatctcttgccttttagtctttcttttcgtttttttataagaaaatcgagattcttttttatttttttattaataaattagagaatctcgtgtgttgttttaaggaattagagaatctcgttgtagcggtgagggggtgggtgtgacgcggccgcggagatggacggcgtggattgcctgctcggggtttgaaacgtcactggataggaactgaaattaagatttaaataaaacaaatcaaattattcaattattagagcaagtttataatagtatagctcactactggctccaattcatctatagccgatctaatagacaatttatacaatagttgcttactatactattaatatatggtctcacatgtcatacacacattacatcttggaatccgtgctgcagctggctatagatctgtagcccgttgctcatctctttcatcttttatcttattaaaatatgtttacagctggcttatagcctgctattgtacctgctcttatagcggcctgcgctataggtggaaaattctacgtggggtaggacataaaattctttccagctgtataagaggaaaccagcggctaatttgacaagtagtcaacatttggtactccctccttccctaaatgtttgacaccgttgactttttaaaacatgtttgaccgttcgttttattcaaaaacttttgtgatatgtgtaaaactatatgtatatataaaagtatatttaacaataaatcaaatgatagaaaaagatttaacaattacttaaattttttgaataagacgaacggtcaaacattttttaaaaagccaacagcgtcaaacattttgggatggaggtagtatttgttagtggcttatcatacattttctttttataatttggtgggataccgttttattttgtaatttactctcatctttatatagcgcatacagacgtgtgtacatagagctgaaaatcattttatatttccatgcctccagtaaactccagctttgaatattgtgatgggactgtagtattatggtgcttatccgagtctcgtatgtactatctccatcacaaaatatgttgattttttatataacgttcgattatttgttttattcaaaattttagtaataactcctcggttgattaaaaattacaacaaaataaatgatatgcatataacatttttcaactaagatatatgatcaaacattatgcgaagagtcaatgatgtcatatatttcaaaacggagagagtagcaatttattattagtatcaccatggctttaagaaatgacatcagccaccagtagataaatttaagccacgttgaaagcacaattgcacataatagtagcaacgtgactagcatgaactctcaaactatgttagaagtgggataccagaaccatggaaatttatttttttctgaaatggaatggctttgagctttccaatagtatacagtaccatttccttatttaccctgaaaaattaccaaattctgcaagggcctttgcgagaaattaccatagcatttccgtccccgttcccgttcccgttcccgtttgggtccccccgttggaaaagaagaaacggagcgcaagccgaagaaaacgccgccgccgccgctccacctcctcttccctcccctctcctccc

SEQ ID NO: 78428 - DNA, 2078 bp, Oryza sativa
atatatccaaaaagaagaaaagaaagtaaaaaagatggttcaaaaaaaaaagaaacaagtgagaaagatcgaacatacggtcgaatccggaggccagcagggagatcagatggcagctcatggtggctgatggcactaatgcactagcatactcaaccaagccaaaaatgccaaaatattcgtcatttgatttcattgtaaccgaaaaagaaaatgccttgccaaattatgggtgagtttgaggagaaggagattgagaagattgaaaagatacgcaaaacgaggtgagtcattagcgcatgattaattgagtattaactattttaaactttaaaaatggattaatatgattttttaaagcaacttttctatagaaattttttacaaaaaacacaccgtttagtagtttaagaagcgtgcacgcggaatagaggtactttctcacctaaactcaccggaacgaacgcaccctatgtcaagatgcaactttggtacaaaaccccccaaaaaaatgactagccaatttctgccaaaaaaaaatcaacattgcagtttttttttttttggagaactgcatatgaatatcagtcaattagctagttagtgttagtgtaagagtaggcccgtgcgtgctacttgtgctaaatttgtggtctgcaagagatggtcataacgaacgcgaggaagcaaaaacctcttcaaatcaacatgcatgatcaaacgtactaatccaagcaaaatagaggctaggttattaaacccgcgtgcatcgatcatcacaccaagaaatgcatcaccacataggagtaacatatatccccagatcagcatatcacatatatatctttgttcaaatacgacgatcgagtgcaaaaccatacgtacacacagatatccatcgatcggcgatcgctactgatcctatcacagacaacatgcaagctacgtagtccaaactaaaatgcaacgaaaggtaatccagttctcaacgtaggccaacccgaccgcatgcagatagtatacctcagctcagacggcggcggtctcggtctcggtcgcctcgcctccggtggtggcagcagcacgtaggtcggtagttgccggcgccggctccacctcctcctcctcgtcccaaggaccaccagcagcagcaggagcgacgacggggtcggccgcggcggcggcggcggcggcgatgtcggggttggcgacgtcgatggggtcgccgtcgcaacgacccgtcacagtagcgacgacgaaggggtcgcgaggcgtggcgcgcatgaccgtcatgttgttgatggactgcagcattccgcgcgtgaaggagcggcggtcggagttgctgccgcggccgcgcgcctgaggagccgacgacttcttgttcttcttgttcttgttcttcttcttcttccccatgcccggcggccggcttttgctctgctcgtctactctcgtcggaggagtgggtggggtggggtgagaggcgtgagactccttatgtaacccgcgtttatatactcgagctggttacttgcgtggtttagccgtctcctctctctctctgacacctcttgtaacaagaaatgattcctcctagttatctctctctagctctctctctctctctctctctctctctgacaccttgtaacaagaaatgattcctcctagttaatgataacccgtctcctctctcacacggattgacacaggtgaaaacctgacacctgacacacaccctccccctcctctctgatcgctcgtctctccctctaatcgctcctctcttgcacggagtaatcatctagaataagtaaagaaaaatatctagaataaaatgtgatctatcctaaaacaactaatttggactggacggatggagcactccgtaataataaacagggtaacagcagttaactcaaaagttcagcgagttccaactccttaacatgatgcagccagtggatatattcatgtgtgacaatgggccaaattggtgcacaacagtcattgataaagttcttactgtgcaggaatataggagtacatagattgaataaattatgcaaactata

SEQ ID NO: 78429 - DNA, 779 bp, Oryza sativa
aaattttgagatttttcagacaaaagttttcatatttgagttgaaattttctaaatttgtgaaggaatttctagattttgaattaaaagtcttcttttgaattcgagacaaaagttttaggattcttgtggtcatgtgatactggggaatgggaagctctcgcttaggtggagacatgcgcactgcaatgggctctcgttcacctgcaacgctcttgcaccaaagctctaaactctaatcggggtgcgcaacttaccgttgtcgcacgtattcgctagctagcatctgttgttagtacgttaaccatatttttaataccttttcatttgtatcttatcttacatcgttagattacaagtgatcacaatggctctcctacattcaatcaccctacaaagtctcagtcagtctctctctctctctctctctctctatatatatatatatatatatatatatatatatatatatatatatatatatatatatatatatgataacttttctctaaatattttagtgcgtatctattttataacgttatatattgttcgagaagtagaggagaatccacccaaaaaagcaacacactaccatgagagcataagactgttcttttgggaagttgggaacttattctctatgcatggaaaacgtagcggtgaattaacacatgattaattaagtattagctaaaataactcgaaaatgaattgtttaatatgatatgattctttaaagctactttcctatagaaatttacaataaaacataacatt

SEQ ID NO: 78430 - DNA, 7196 bp, Oryza sativa
ggagaccttgcgaccgtgtactgcttgtatttcgatatatcagtcacacggtccatcttgggaaaaacgtcctcgatcttcatctcctttttttccctatcttcctatccaaactagtgtgtaccccttgacaatttttctcaatctcattcatgccctatgtggagattatgggtaccccatacccacacggcatggttatccgactagttataggggataacttatatatataaaatatgtaacagatcatgacttgggtattacgtttccctgtatattatggaacagcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggctgcgtcgaattacccatcgaaaagtgtgatggaatcaactacagaagaaacggcgagattaatctcgatggctcaaatcttcagtcgggttcggtgttttgatctaactgttattagattaatttctaattgtgatttgctcttctggtgttttccttgctttctatgggctggtcggctgaggttaaaacggagctgttgacggcgatcgccaggagcagcgccgacggatgcgttgcggccaccacgccaccacgggcacatgggagcagccgcctatagcttgctcggagaaatttcacgcatgcatgagttgatttagcagattaacatacatgcacgatctacctaatcatgcatgcatatacttctaattaatcttctagtgtgtactaactagattagattagattaattttctaatctcagtttgatctgtgattccttattttgcatgcgccatggtcacctgagtctgattcccatcacgtaaagcctccaagttggatttgatccggactcggaccgtgatctgtacgcacggatggcagcctgcaatctgtctggtgacgtgcatgtgtggatgtgtgtactgttcatgctacaggagatcaatcggccaatcaaaaaatatatgcatgcttcatatatgcagacttacgtacacaagattaattttcttgatgctaattagagattgcttttctctttacatgtactgctggagccaccgtcaccgcccggtttgccttcgccgccgccgactggtgtctccgtctacacggctggcatatcaagccaccgttgttgggcgtctacgtcttcaccgaccggcttgccttcgtcgccgccaactggtgtcctcgcctgcacggctggcctattatgccgctattgttgggcgcctacgtcttcaccgaccggcctgcctccgtcgccgccgactggtgtcctcgcctgcacggctggcctattatgccgccgttgttgggtgtctacgtcttcaccaccggctcgcctttgtcgccgccgactggtgtcctcgcctgcacggctggcctattatgccgccgttgttaggcgtctacgtcttcaccgaccggccgcctcgtccgctgctgactggtgtccttgcctgcacggttggcctattatgccgccgctgttgggcgactacgacttcaccggcagcctgcctccgtcgccgccgaccggtgtcctcgcctatatacggttggtcacaccaccgttcataggcgtccatgtcttcaccgaccggctggccttcgccgactggtgtttccgcctgcacggctggcctattatgccgccgttgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactgatgtcctcgcctatacggtcggttggtcacaccaccgttgatgggcatcgtcatctacaccgccggcctgcctccgtcgccgccgactggcgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcattgccgtcgactggtgtttccgcttacacggttggcctattgtgccgccattagtgggcatcttcactttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattacttgcgacataatctgagtacaaaagtacctatcgagttatggagttctatcttcctatgctttccgtttggtttgccaatggatggttgcctttgggctgattcctagcacccgggggctcgttggatggaccgagtaacgcaaggtgctaagtattattcggaataaatcaaaagcatagagatgagataaatttattttctgctcttaataatggcaaaagtacccgagtagtaaattctgatccgtgaaactttgttccattaatgacgaactcatgtcactcatatgcatgtttgggaagtgcctaggccgactcccgatgcttggggactatgactagtcgggcagagtgtttaaacgtaaggagtcatctgctcggggaaatcacaattgacaagaggagaaatacatatttataaacattttaaaatgcttgaatttttctcgagtattatatttacatcaggtactactcatcctatctgtttgttctgtaggatccagatccagatatgcataaaagggattcatggctttaagcttatctcctacgctttaggaatggatcaatcagaacatcaccaccggctcgccttcgtcgccgccgactggtgtcctcgcctgcacggctggcctattatgccgccgttgttgggtgtctacgtcttcaccaccggctcgccttcgtcgccgccgactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccgaccggcttgccttcgtcgccgccaactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccaaccggcttgccttcgtcgccgccaactggtgtcctcgcctgcacggctggcctgttatgacgccaactgatgctatcttcttcacggctggctacatcaccgtcaccgctaatagctaccactactgatggacatcatcgtcttccgtcgccgactggttatgccgccgccgactggtgcttttatcttcacaactgcgcgtcttcaccaccggtttgcttctgttaccgccgactcgtgttcacttcattacagctatgcaactttgtcaccatggtggagcgacttcatctttattatcttcggcaccggcaaactttattgcttctacttcgcaagctttgctacttcaccaaccacgacgactacaagagtttcgacacctcggcatatgtcactaaatatgatgccgtattattttattacaacaagtggtgttccaatcttcaatatttctactcggacatcctcaacacatatcttcactcaagttatgactattcgatgacaagaagctacagttctcgactctatgttcagttgtttcccaactgatcaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggttagacgagttgggcaacaacatcaactctcctccaagtgaagcatctacaacagctgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaactgaatacttgtgccagtcggaattcaattgttatatctattttggagtatcccataaaggataatcactcagatcagaagctattcatatgagctacacttggtctatatcacccgaaaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgcgtgatcaattgcccaataccttaaaatccttttatatcgcagttactcaactttttaggagttggtataatgcatcttaaaaggtgtcaaacagtaaagctttatatagctgccccgctgacttttttatatagtcatggtgttgtttgggtttttaagcaattgattggatacaatatcattgctttttgccacgtaagtgtgcatttttattgaccaatattatggcttaggctgattatatattgtggtcattttccaggcggttggtaaatcctttatgagtttatttactcagattttatacctcatatgccatatatttccaggtgtggtggaaccatgtgtcttctagggacttaagcacatctgttaaagcagtgtgcgcatggcgtatgcccaatactatggaaatttctttattcacaacatacaagcttctttatagctattttgctatgtgaattttcaatgatgtagccaactttaggttacactcatcatattttacaaagcagtcggtatatcacttggatcatattattcagggattcataccacatatgctacatattaagtcgcttggttgactacaattatcgaaaccactcggtgcatctagtcgatgcacctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatataaaatatgtaacagatcatgacttgggtattacgtttccctgtatattatggaacagcctaaagtcctagtttgataagattgtaaagtagatttagaaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcattgagagggcctgaacctgtctaaatcctttgtctccgcatccatccattttaggtctcgtgcgctacccccttttattattgccgaattcatgtttcgacaccctaaaatttgccttatctcctttgagtttttcccgatccattagttaaaccttgagttgaccattagatttttttgaaataactatatcaccccttctcatactcacatgctacatgactcattaatatctatgtgaaaaattataatttataatcaaatcaaatcgaacagaaatatgcaacatttaaaatacaaaacttaatttgaataaattattatttttactaaatccatacgagaatttaagctagaaattcagaacaaaaattatttattacttgggtttaaattttggtcaaaatgctgtacggatttcatcaaagttcatttgaaatttatttaaaattttaatttcattattaaatttgtggtcaattaattctatcccttcatttttacaattgaatcttactcctgttgagagttgtcttttttatcactaggctagcagacaattaactgattaagtatgacgggggcaatatagtcctttgaaaaaattaacggtcaactaacataatcaaaaggagaactcaggtgcatataatacattagataaaaattcatggacatataaggatcgggcaaattctcaagagcacgtagagaattttctccatggatgctagctagtgacaatcttacatgaatctgattctctggagccctctgttacctttaactagaggttggggcgcgcccttggcgcaccgcctgtacgcacgtgtgccgcccaataagctgatagccagggaagaacggttaaaaagtgttggtgggggaaaagtaatgaaagcagacggcaatagataaatagattgcagcgctaacacacatatgtctgatatttgtaaggtgctgcagtacctatgataataatcttaaggtgcaacactaattaac

SEQ ID NO: 78431 - DNA, 3638 bp, Oryza sativa
taataatagggaggcagcaacatgaaagcgtaagaagaatacgtcaagtccacacgaaagcggtattcgatggggacaaaccaggataaggcgaactttccggcgggaagccaagccgagctctcccgcctctcccacggccacagccatggcggccgccgccgccgccgccgccgcgaaacccaaccttcttcttccagtctccgtggctatcccctcttctagggtttctcttcccaccggcctcgtatgcagcgcacggtccccgccgccacgcctcagggccgccgccgccgccgccgccgcctcccaggccctaacgtcgcctgtcgcggcggagactccggaggcgaagcagatgcgggtagagacggaggccgccctggaatggggcggcgtgtgcgcgcggctggccgggttcgcctccaccgccgcggggcgcgccgcctgcggagaggggcgggtgcccgtcgggcggagccgggaggagagcgagcggctgctcgaacagacggcggcggccgcgctgctgcctgctccgctggatttcggcggcgtggaggacgtgtccgccgccatcgccgcggcggctggggcccggctgcttgcggtgagggagatatgtggagtcgggcgcagcatccgtgccgcacgcagggtgttcgaccaattgaagacgctctcagaggagacaccagatggaaggaggtgaggaagttgcttcctcgaactgaatttcgtagcactgagctaaactgaatgcataatttcgagttaatgattgtaactgtaagtgtaactttgattagcactcctgtcctgcagctacactcctcttctggatataatgcaagactgtgacttcttgacagaacttgtgcaacggatagagttttgccttgattatactctttctgtggtccttgatcgggccagcgataaactagcaacaatccgcaaggagaggaggaagaacattgatatgttagaatctctgttgagagatacatccacaaagatcttccagggtggtgggattgatagccctgttgtcactaagcgccgttctaggatgtgtgtcggtgttaaagcttcacacaagcatctggttcctggtggaattgttttgagttccagtggctctggcgcaacatattttatggagccaagggacgccatcaggctgaacaacatggaagtaaagctctcaggtgatgaaagagctgaagaattagcaatattgggtctacttacttcaagcatagctgactccgaaatgaagatcaggcatttgatggggaaaatattggaacttgacctggcttgtgccagaggttcatacgctttatggataaatgctgtgaggccagcctttactgacagggatagtgatactcaactgaatccaaatagtgaatgctcagtttttatcgagggcattcagcatcctttacttcttgaacagtctcttagtatggtaaaagaatcaaccagagtagggaaaggacagctttctgatgaacatcttgtctctccaatgcctattcctctggacatgcaggtgagaaacgatactaggataattgtgatctctggacccaacactggaggcaaaactgccaccatgaagacgttggggttggcctctctgatgtcaaaggctggaatgttcttcccagccaaaggaacccctaggcttccatggttcgatcaagttcttgcagatatcggagatcaccaggtagtctctgtcttttgaagagaatttctctaatcaattggggatgcttattgatgcaaactcttttctggattgaagtcgctggagcatagcctctctaccttcagtgggcacatatcacgtcttcgcaagattgtacaagttgtgtcaaaagattctctggttcttattgatgagatcggcagtggtacggatccgtcagacggtgtagccctttcaacaagcatcttgaagtatcttgctagtaggcttaatctggccattgtgacaactcattatgctgatctaagtcgtctgaaagctgttgacgatcgatttgagaatgctgcaatggaattttgtttggaaactctgcaaccaacatatcagatcttatggggcagtactggtaattcaaatgcattgagtattgccaagtccattggttttgatcagaaagtgcttgctcgtgcacaagaatgggttgagaaacttttgcctgacaaacagaaggaacgccaaggtttactctatggttctttgctagatgaaagaaaactactggagtctcaggcaaatgaagcagcatctgttctttcagacgttgagagactgtacaatgaggttcatctcttttactctattgatctgcttttgacttgtccacagtatttatgtagaaggatcctctttgatgattttacttgaaatcttacttaataatattttgatatgaagattcgctctgaagctgatgacctggatagtcgagtagcagctttaagggcaacagagtctgaaacggtgcaacaagagttaaagtttgtgaagtctcagatggaccaaataatcaagaactttgaatctcaactcaagaattcagaacttgaacagtacaattcactaatgagaaaagcagaagctgccactgcttcattggctgctactcaccagccaactgattttaccttcggtgatgaagaaaatgagagctcatatgttcctgaaatcggagataaagtgtacgttgaggggctgggaggaggaagtatggctagtgttgtcgagacacttggggaggatggtagctgtatggttcagtatggaaaaataaaggtccgtgtcaaaggaaacaagataaagctggtccaaagaggcacgaaggacacgtcagcctcctctcctgtaaaaggaaaggtgtgctttgcatcatccctgtattagtgataattatatatattagcattcaccataatctgttttgaatgttagaggtcaattagaggtgatattgttcgcaaattgaaatttatttcatgagataaatgtgataaaaagaactaaattgcaacaaatggtgtctcataacagttgtcatgattatcatagaatacattaggtcctcagaacttatcaagtaaatgtatgtattaaattatgtctcataacagttgtcatgattatcatagaatacaatggtcctcaaaacttatcaagtaaatgtatgtctaaaattgaacaatggatgcttgtttagcactcaccagttacacagcgtgcacgtgcagcatagacaaagattttgttcttaactcggtaaatctggtctacagattgctggcaagtgtagtgtatccagtttgtatgacatagtaggtagactctgggctggcatatgagtcttaactcttaattgagttgggcttcgtgtcacaatagattgatgtgttatttttctgaaatacttttgcgtgtattcgttctgtcggtcacgttgcatattaatatgtcaattcaaggaaaccaagttagcttgcggcctacagtgtgcattgaatctgacttgctagtattgatggtctccactttagtctgggcagatgcaacagatcgatagtaagctagctggacagtcaat

SEQ ID NO: 78432 - DNA, 4188 bp, Oryza sativa
cgaataagcacattatacggcttcatcgaaaacttatggcaaagatcgtcttatgcacacttgcacgatactagctggattatacaggattgtatgccacgtgagatgaaattttgaagccgtatggttgccatgtgacaactgatttggacaaggtggcccaggaactaatggagcttggagctgatctgtgcgctgatacaatgcacaatggtggcattcaagattagcctgtgagtacgaattcttgcatgtgttacctttgacttcttaatccatggcagatatatgcatagttttgtacaggtgaaagtcacacggtacttgagacagatctccgtacatataaactacacatgcgtgcagttcgttctgcagttgaaaaagattgtccggtttgttcagatcacgcatatcatattacaacttccatcctaaaatataataatttttagcatttaaaatttatactaacatatgacaatttcttcacctacaatttgttatcaaccagttaaaatcttccatcttttaatttctatatctaccttctcttcctaatcaattataacactctttatttaattttatctagtttttttaatactcatgtctagtcttaaaacttcttttatattttaagatggatattgtatcatggaatggatcagctagctatttggtgaggctctcttaaatgatgctgctgggtggcagctgattgctgggttggtgcgttgggatcggataaatggccttggcaaatgtgatcaacactgtgtcctacaaaatcgcaaaggaagagcctggatgcatgcatatgcatatgcacatgcgctagctctcttttcagcaatgggcaccgggattttgtacggtgagttcttcctcctaccaattgctcacaagccatagccatagttgtgcaatgctttctgtttggcaacctaattgactaaggagtagtacacataacctttgggtgtttcaaaatggatcctgtttcccaacccaagttgtgtgcacggaaaacggaacggtctattagcgcatgattaattaagtttttactactttttttaaaaaatagatcaatatgatttttaagcaactttcatatagaaacttttttgcaaaaaacacaccgtttagtagtttgaaaagcgtgctcgcggaaaataaaatgggaaagttgggaacaaagagttccgaacacaagccgcttacaggtcagatgctatgccattgaaactgattgagacccataacaatgcttaagatcagtactagtacatgcaaagctgaacatgaaatgtactagatctggtgccactaggaaaaaataaaaatgattagtgttcaagaataacttagccgcatcaaatcccggccggattccagggcacatccggtgccgaggcacgcaagcgaaacacacgaattggaatttcaggaaaaaaaacacacgaattctacccaaatcaagttcatttttctaaacaatacatacaaacttcaaacagagctttaattgcgcgcaacgcatcactcttgccaactgccacgccggacagttgaagcacacatgcacatatcgccgcacatgcatcgacgccgacctgctggtcccgcctccgctgggccccgctgggccccacctgccagccaaaggggggccgtgacgtcagcgtctacctagctcatggcccctcgtgctggtgtcagagaccccccctgtacttgccaagcagataggaggagcgaggagaggagcccccctcgaatcttcttcttgccttgtgctgttatcatagtacagtgctgtagtatttgtttagtttagcgggcgccatcagcaacagcgaatcatgggatggaaaataacaaaatgacagttctaagcagcagcagcagtagcagttatactagtctattcaagatccccttttggctggcaatttggacagttctttccagtggcattttccttcttcttctcgctctctgctcgcagctggagctggtgaagcactagctcagctgatcgttgctgctgcttctgcagcaaaacgtccttttcttgcctcctcttgagtcttgatctcctatgccacaagctcccaaagaggaacccacaagtttgggagcttcttctcctttcagttttttgctcttcctctcaaggagttttgttcttgcattttgtctcttcactcttcatctcctagctagctagctagctagctctgctcatcttgccagttgcaaggcttaatagtaagttctttgatgtaacgaggaaggagtgttgttgttgttggcgacaaggtgttgccttcaccattccctcctctccccacaaggtccaaaagcctaaacttagcaaaggcgccataaagtaatcaaagctgaagaaaaatattggtgctcctttctcctcctcctcctccaagatccctagtttttctttcccatggtccaggttttgctctgcctgatgctaatggcaatgtaatgtagcggacagctgcatcccatgccaagaaactggggaaagaacgggtctttttaatccaacccctgcacattgctgcggtttcttggtctgttcttgatccttgagctcctctcgtggcggcaattgcaatgtggtgcctgcattagaggcagaggcggttagtggagaagaataggaggagttgctcatcaggaggaagaagaagaaaaggagcaaaaggtgtctccttggtgtgcgtcttgaggggaaaaaaaacaagatggccggaggcgagggcggcggggctgccgccgtccctgaggaggggcggtcattggcgctgacgccgacgtggtcggtgcatcgtgctcactctcctcgtcgccggctcgctgctcatcgagcgctccattcatcgcctcagctatgtgagtaccctgaatattacactgataaatgtagtatctctttctgttaatccgttcgtcacttgcttagtgaggctcaatattatctgtgtgtgttcttttttctgtttggagaaaataaaaagtgtgttgatggtttaatagtagcttggccctgtctgggactctcctttatttttttcttttgttcatctttcagagttttggaacaataagcaatgaaggataagcttttcttttctgtggaagttattctacattatatgaaagcctctcttccttttcttttaatcgattattcagtcacgcgttatgttgaaatagaactcatagtaatcttgtacatgttcagtggttgaagaaaacccaccgaaatccactccacaaagcaatggagaagatgaaagaaggtaggccatccgttatttatttctctttgctagcttgttttcttggactgctgtgcaacgtggactaatgatttgctctgactttgctgtagaaatgatgttgcttggtttcatatctctgcttctggcagctacatcaagaatcatctcaggtatatgcattgattcaaagtactacaacagcaatttctccccatgcaccagagaagaggttgaagaatctataaagattaagcatgccgtatctagtgcacgcaagcacctaattgaagtcattctgcaccatgcggccaggaggaaccttaaagctcgttaccatcataatcaaagttgcgctgaggtgtgtttgttaactttctgactgctggacttattgggttggatgacaaatgttgtagtaaatgtcatgtgcagggatatgagtcatttgtttcacatgaaggtctggagcagctgcaccgctttatatttgtcatggcagtaacccatgtgacatacagttgcttgacgatgctgcttgctatactcaaggttttttctagttgttataaatttccatttcagttacaagttacacctcttataaacttttctaaacatttgcaactttcaatgttattaagatgtactgttgattttcattggtatattttttaacttgggatctttggatgtcatcaaaacacttataaaaaatacagtaactatatgtaggttacgcaacatatcgatgtatgaattcaatggatggctaaaaagctaatggcattgcctgctaggcttccatgaagcttttgttgctggttaacatttttcaagcttactaatttgtgcatgtctttactactaaagc

SEQ ID NO: 78433 - DNA, 612 bp, Oryza sativa
ccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaatgctgaccacttacatcaatattgatgcatgcatggagatgaaggtgagctaccatgcatgacatagacgtatggcacacatttttgctgctagctagcggccggggtcatatccagcttattacaaatatgtatagttatactcacatacatcactcatatctgtaggtataaaacaggg

SEQ ID NO: 78434 - DNA, 2754 bp, Oryza sativa
ttactaagctttctataatgcataggaatgccgagatatctaataggaaaatcacctagctatcacatatgaaacaacaagtattaacagattgaaatatatgtttcctttcatcaaaatataatcatgcgatatcttgttctaaagatttaattacaacgaatacaatagtgtgatcggattgttgattggataagtaatttaggagaaaaataatcattttgaagcttgctaaaatacatgcacgtatgtatggatgaggtggagaaagtggagagagagagtagtagcaagtagtttaaggaattttgtggaacacaatgaagacacacattgaaacatatcactaccacgtataaaaaatttagttttaacggtttaaaacacatgtttttattttgacataatataatcatatgatatattgttgtgaagatttaattgcaatgaatacaacggtgtgatcggatcgtagattgaataagtaatttaggagaaagaatatttaaagagagtaggaaagaaggagaagaaacagctagacatgcatgtgacagtaacagggttcgtccgattcattgggctgctgatttgcatcatttttccaaatttcgtgttagagtactgatcgtatcagggaaagcaaaaatttatgtattagagtaaaactcaaattaatatacatttgtcctatccagatgtaataattactataacctactacattctaaatttgtaatacttaacatgcaaaaataacacatcatcatgcaatagtaatttattatattttaatcctcatgtaaacattgctatatcatctatatgtattatattctaaagcttatacatacaaatatattaaatcatcatcccacataatctagtccattaaattttctacaaacgtttctagggcagtcctaaacgttcctgcttcctagttgtagctcccattcatgttttgtagctatattatatctatgaattggatttataagtaaggaaaataaaaacaattaaatccacaaccctcttcccacctcacctcctccccatcccctcgcatgtgcatgcagctgcgcatacccgtttcctgcttcccctcctgcttcccattttgaagctcctattcctattttgtagctatatatcaaattaaaagagaaaaaaaatcaaatgtttttaatctaactaaaatgttgttgcattcataattaaatccatagtgcccctatttttgctatatatgtcattcggccaaaaagcagtgcactttgcatgccatataaatagcaataaattactttaaaaattagcatatattgcatcaccatataccattctataggcatatgtatggctaaattaaatttccagtatccaaacaaagattagaaaataaactattcagcgatattttatcgagggacaacaccctacccttctaaacttcatctcaactgacataaaaacattacaaaattattcaacaacaaaggttgcaccattatacattattttgcaaatgtgaatagataaaatataaactatgtaagaaaaaagaactaacccaaaatgaataactaaaaccattacataaacaatctgatgccttcagtgagagaaaaataatccaagcaagccaaataatgtttcacataagtgctttaaaatatattctatattaccatctaatcgaatttagacaatgtttaatgtatttttaatacatcatagatgaacataatttgttctagtgtacaaaccgttgaaaaagtggatcatccttacatataattcataatatttaattgttgattttttagaaaaagtatttaaatcatagaagcaatcataaaaaatcatataaataacaatgatgcacacatagtatatttagccattgtgttctcactggattgcgtggactctttactcacactctgctcgaaaagttatttgatgggttgtcttccacactgtgcaattgaattggactttacgagcctgtgcattaagcataggatcatgtccaacccaaatccacccattaataaacaacaagaatataataataataataataataataataataataataataataataataataataataaggaatagtactatacatgacatttaactatgtacaatctgttttaactcttgaattattttggagaggaagacagacaaatatatctgtgtattgatgaaatggataggatcaaccactcttgaggtgaggacgagagagggggaaacctatctacctatccagctcatcatgaatctgggacatatgttctcctttaggctgaaggaaactgccctatataaagcctatacttaccctatactatacttacaccatcagtataactctttctactcttgctgtgacaaggggcatgggagatggagagcagtagagctagtagaagccttcggtgatgcatagaaccttgtcctttggttttttacgagcatatggctagttctatggatagtacgaacttctgatgtctagctacggagtagatggataagtgatttatgtttggggtaatgggttagtctttatgtaaatgaactgtgagatactttctcgatagaaatagggtacttttagatacttccgggcggccgccgctcctcccgctgcacgttgacgacgccgacgccgccgcacgcctcttctccctgcagttgctgacaatgccaataccgatgtcgccgctc

SEQ ID NO: 78435 - DNA, 629 bp, Oryza sativa
cgcacagtcttattgaagaatttggaatgaaaagaagagtaatgcttccgagggtcttggcttatacctttgcttctcttctctagggatctatacttggatatgcaactttaggtagtcagacagtcaccctcgtatcggctggatatatatagatcagtggtcgtaactggttatgcttaaggaactgtaacaacaacaaaaggttcttcgtttttcaactggctctaatgcaaatttaaaaaataaagaagagttccgtcaggcgtactgaatctcaagacgttcctcaaaccaatcatatactttattgagataggtaactaacccgaaccccagaagtcatgggtgataattggtctgatgctcgggcgaaaccaattccccaggtgtgacgggcggtgtgtgatcatacgtctataatgcattgtatgtcctaaaatagggcccttttggcgttccttcgtagatctacggatttcacccctacacaccaaattccactctcctctgtctcactcaagtgaattggtttcgaaagcattccgccactttttggtgactttcactttacacccgatttacccccaagacgatgttcgcgcaaaaaccataaaagtattgatctc

SEQ ID NO: 78436 - DNA, 3583 bp, Oryza sativa
tcccaaacacccccttaatcatctctaactaaatttgcttacttgcattatatattgagatggtgatgctaacaataaatattattaaagaataacagattgatgattttatctatgagaataataatgtcataatcatagaacatgattgtgatacttagcctgagatggccgatatctgaaacaacaatatagggtcagccgatatctggaatacctcacacaagtagggaattcagtgacgtgattctcagttaaaggtatcactggttgggaaaatagactaaaggaataagattataacaattattttaatacctctgaagagtgtatttgaaccactatatttagtatcttttattaatggatggctattaatatctacagtaataatgtttcatctaagaaaaagagtaaatatactaatcttgcttagtatgtgtaacatactcatattatttcttgctatttgatgtgcatagaaactagtcatgatgacatgtcaaagggggatggcgacagacaggcctaatggggagtgttgtcttctttagtcttcagtttaaattaagaggatatatagctgcttgccaggtgtagggaatagacctgatgacaacatggtggtcagtggaccagtggatgtatttaagccatgtagctggtgcaaaataaatgaagccattgctctagttttgcaaactctagttgggatagttagacattacatcttacctttgtatccttatggaacatatgtatatatataatccctttgtattcttatggaacatatgtatatatataatcagtatatatgcttataaggatacgacagactccaaaaaaaaatgagaaattttgggtcatgacaagctgcttatacaaaaggtgattggtttttattaaaaattacaaatggtgcaactctatgtcactatttaccatctcacagaagttgaacatgaaacaataattttatgtaggaaatgccaataagaagtaaaatgatcaattcgagaaaatcttataaaaatctcagttccttttcaccaaatttggaacacccgttatcgtagcattacataatttttaattgcttagatcctaatagccttctcacagtcctatacggtgttattagttcctccatatcttacatatataagggcactaaggtagcaatacataattgactatgttttttttccttaagatatactccctccgtttcacaatgtaatcattttaatattttccatatttatattggtgctaattaatctagacatattcattcaatatgaacgtgagaaatactagaatgacttacattgtaaaacggaggaagtactatggatctcacacatccgaaggaagcatggtctagatatgtctcttctctatctttatttgtatgatccaattagagggatgtcacgccccgaactagtcccgagcggaactagcccgtgacgctccaaattaacctgttaaccgataccagtcccaggaaacagtgctggtatcacaggaagacggaatatcacagcaacagatgtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggaattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaatgacacggatgaacagtgcgtctcgtccggtcggagtatgtgcaatgattcagtcttttgaattgatcaagattggcacccggccaaaagctttcaaacggccacccgggcctggctgatcccatcagccgcagattttccaaacatcaacccattccacacagcaaatttcacaaggcagtagtcaaacaaaaactacgctaggaatcacctcacatccgcccatgaccgtgggcacggctattcgaacagttttaataacctctgcagagggggtacactttacccacacgacattactaacccggatcatccagcccatgcagaacggccacgactagagaccttaaggctttcataacaaggcatttcgaaagccgacacagtttcaccatatgccaacgagaggggtcccagaccaacaccagattaggtcccagaccatactatgccaggaagcccaggggtcctccccgacaccaccccggcgaattcacatgtctcttggcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttagttcgcaagcaccgacccagctgtcgggttttccaagtcttttgtaaaacccaagttttacccaagaagtttctcagattttaagtttgaaggcgaccgtcgatacctgtgcagagtgcacgattaccgaggcgcaactaggtgtatacaagggaacatggtataacaattacaatggaagggtcaaatgcaacaaattaggtaggtccgccaatctgccttgcagacgggacaagcagattaagtgcgatcctatcaatgcataatatttttcaagcaatataattaagttcaaatataggctcaagatgttcaaaggtggcttgcctcgctcgagatcttgagcttgatcctcgaaatcctcgcactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttactgttgggaagatattgaatttctaagattattggatttttagtctaaaggaaaaggatttatttaaatcctttttgaaaaataaaagaaaagaaaagaaggagggacggaaattagacttccctcgggcggctagggcgcgacccgagagaatggggcggctcggccgaccttaatgggccggctggcccaagaaggcggcccaaggcgcgcgcgcgggcggggaggggagagagagagccggtgggccgggtccatcccgcgtggtcccgggtgggacccgcttgtcggcgactcggctcaccgtgagcgaggtgcacgcggggcgtgctagggtttggggagggaggcgcggcgcatgcgcgcggttcgcggaggacgcggtgcggcgggcccacgcgcagcctcacggctcgcgcgtggaccgcacgcgcgagggggcggagggaa

SEQ ID NO: 78437 - DNA, 6254 bp, Oryza sativa
tggctttgttttgttagtgttcagtgtatgcctgttgaataaagatccaagattaccttacattcctaatctggctatgcagatgctcaggattattgttccacttcagattaatcaagaatggttatccaatacatgtagaattagtttcacatctgtaggaaatgcagttccagggttttgttcttcagcagtcagttcggaacctctgaagtgaaatcctgttacttcagtggtccaagtctacagatagctcaattgaatgattcaaaaaatggctagacatttcaattttgaaacttggattcagagtttcaggttacctgaaacatacatactgtacatcccaagtccaaagcatgatcctgcgcggagtgcgggcggacaataattgaaagaattaacagctgaaattttcaacacataactaaattttgacagcaaattcgaaaagtcataactgattatgagggcctttcatgacaactcttttgccccagactcaagcctccatccctattgaccactggttggtgtaacatgtaccagtaaatattaagacctactccaggattcaacagagcaattatttttgagactctgacaattatgaaaactcagttgaaccatactgtataccctagtgaaaaaagttaccatgactggcctgctgctgttcattttcgtcagttaccctcatattgggcaatggtcataggctgggtttagtcagcgcaaagtttggattttggtttatattggagatgatgtgactgaaaagttgggtgtgtatgacaggttgatgcgatggaaaatgactgaagtttggatccaaactttggatataaacacagccataaactaatttccaagttaaccttacccatgaaacttggattatgagtttgaggttacctgaaacataaacttggactcagagtttcaagttagcaccagtcttgattctgggcaaaaaagatgtcatgacttattcttaatgaaaaatcgtgtggacggtcacccccccccacccaaccccaatcgagctcacgactaatgaaaaataaatttatcatgacctgctgctgtttattttcactagttaattaaccctcttacgttatactaagtgctactcgttttcaatttgataattcaattcaatagagagcaatcgacaatatataggtggaagaaaagaggaaaacaatgtcaagtaagtaactaccctttcaattcaaaaaaattagattacggttttcttagacatttttttaataccaaaagacatatgggcaatggccaaaaatatacaagataatcagtatcgagatactattagattttagaaaatacatatttttatataaaatatataatatgttgtataaattaaagcatataatattgattttgataaatttaattggtttttaatgtaaacttgagcatatttattcatattattttcaatccacctatttttaaataatattttgtaggatcgtagggatagtagaattaggatactacctaagatttcgtaggaacgtgcgaaaacaattagtaagattgagatactatgaaaattaggataatagatgagataatatcattttgatttggtggatcgtagtgtctagtatactggtatacgtatcgggatactgacaaccttggaaatagaccatggacttgaaggtcatgataagtgcctcaacggctcaaccaaggaggtagctgcagaagaaatccttttctaatgtatcattgtgtcaatacgtgcagcaatatactactataacataagcctgaaaattttaaaagtcccctgaatcagttcctggaacttgtacttcgtctaacttcatgaaattttctgagccaatacaaaatcaagaaaatcccagtcaactgtaggataattcatgaaaaatcccacaaattcgatgtatgatcctaaatgacctttctcaacccctaaagttcaccaatgaggtgacaagctatactaggtcttttaccctttcataactaatatgaaactattcaacaattgaaaacttaaaacccaatttaataattcagaacaatctcaaatgtaacattccagtttttctcttgtttagttgctgaattaggttctatttgttggacctctaaatgttcactcttttttcggagaagccagctccccgaggaagattacacagggtcctaataatttgatttatacgtgtaatcaccattagcgcctttgaatatatgcccacaagtaaataaaatttaaaacgaccttttcaaagcatccaataggtacatgctgttagtggtttaggtaaatattcttctaacttgagtaactgtttttatacggggactagttaacctatggataaccacgggtaatctcatattacgtgatttgcatatatctgaaacagctctaaatttaaattattaatgaaacaacatacacaaaaccattcaaataattttgttgttgcttctatttagtaaatttactaattcaaaatttgtatttacaaagttgtacatattgtggagttgaactttatatgttttcttattatataatactaaaatttagaataaataaaaaaaaagcaacatggtttgaaatcgcacttatagtttttctggatttactaagtactccctccattttatattataagtcgcattgactattttctagttaaacttttttaagtttggtcaagtttatagaaaaatatagcaatattttaatcagaaaacaaacatattatcaaaatatattcaatgttatatttaataaaactaatttagtgtcgtagaaattgctaaatgttgcaataaacttggttaaacctaaaaaaacgtttgcctagaaaaaatcgaagctagagtataaaatttgaaactagcaagtaatcttggagtctcgatgatttcataatttattaattcttgcaattaaacttaataattaacatcgtatgactaacatggacctttaattaggaaatgcatcttcgcacttggtgcgtactattaattttatttttcctcataaaatttttctcaatccaatattgatataaatgcaaagttttaatcttcttttgaatctcaattaaattttttactgaatcaataattatgtaattataaattattaaatattaagtgactttcaattttaatatgtatcgatttttttcgcgaacgcgtaaaaggattgcacgtcaatattagcaggaaaagagtttttgttacacaacggaatcagccagattggcttaataaaaaacctgaagctaggaactactacgatggttaaaacgaaactccaaacaacaggagggggcagagccacactacactcccaagaaatccccaaaaacagcaatgccagctaaagaccacagctggccctccgagcggatggactccaaaatcactgggaccgaagcgagcgcagagtcaaaaaccctggagtttcattccttccacagctgccaagagattaggagtaccaagtagtcaaagccgatacggaggtgctcaggtaaatgggccctggaggatgaccaccaatcctggagccagctgccacgagggggagagagggcaacccagccaggaggggacatcacacggagccagacctaccgagcgaacatgcaattaatgaggatgtggttcaccctctcaagctcctaagcgcaaaaggggtaagcagagtggctatcgataccacgcttctggagaagatcggtagtccagcagcgctgctgaaatgcaaaccataggaagaacttgcatttagcagggcccttcgcgtgctagagcaggtcggcacaggcaaaagagtgctagccaaggaagaacgcctggtacgccaatcgcactgagtagcactggtcacccgtccaacaccagacgaggcgatcctcaacacccggcgagagctgggtaggaagcaccgcgtcccaaactaacaggaactgagagatgaccgggacagtgagggcaccgcgtatatcaccaacccaggagttgttcgctaacccagtagcaaccgtgcgcgatccccggaaacgtggaggcacgacatggaggaggtcaggagctatagaagctagcgaccgaccatcaatccatcgtcagtccagaagagcgtggactgaccatctcccaaggtagtgaaggtagatgctgcgaacatgtcggagacgctccgctcaacagaggccttcagatcagaccagttggggtgtcctgagcgctgaagccagagccagcgaactctcaaggcaaagccagctatcctgaggtccggaatgcccataccactgagatacctaggatggcaaaccttcgtccaggacactcggcattgtcccccattggccgagtccgtacctgtccacaagaaggggtgacgcttcttgtcaatggctttgataacccagcctggcaagccgatcgccatagaaagatgtaccagaatagaagagacaaccgattggaccagaaccgagcgacccgccagagtggtgagacgacccttcgagggggggggagccgatgggaggctttatccacaagtggttgcagggccgcttttggcagcttgcgaactgatagtggaatgccgaggtaggtgcagggaaactcagagatcgagcaaggaaaagaggactgaaccagctctaggtcaagaaccgagcagtggatcggagtaatcaagcatttggtgaagttggtctgaagcccggaagcggcactgaagatagagaggatgccttggatgaactcaaggtcctaccgaacgggggaaaggaagagaactagatcatcggcgtagagggatgcacgatgtcgaatagcacaatcattgaggggaagaaaactactcgagtcagaggctttgcggagcatcgcattgagcacatccatgactagaatgaaaagcatgggggaaagaggatctccttggcgaagacctctccgatacctggcaccccattgaccagcacccgggaagaggaggcactgagaatgagggagacccaatcacgccaacgttgactgaagccaagctgggctagcacctcaagcaagaaaggccagctgaccatgtcaaaggccttcgcgatatccaccttgagaagaagtcggggaacgcatttggcgtggagcgcccttgccgcaagctggacatagcggaagttgtcatgaagggagcggcccttgatgaaagcactctggttaggccaccgacgccgtcgcacctcctgccgacggccccacctccacaccggctgtcttcgccgagccgcaccttcagatttggcgcgggccacctctgtccgactgcctcccgctgccgagggactcggctgcgcaggttgccttcctcccgccgctgcacgccgcctcctgccgccgaggggagcgggccacctccctcccaccgtagcgccacctcacgccaccgagtgtcgccgcacgtcccctcccaccatggcgccgcccgggataaggagagagagaagaaagagaagaggagaagatggagccgagtggaggagaagaggagaagaaagagacaaggagagagagatgtagccgagtggatggataagaacgacgacttgcggtcttgtgcggactcggctcggctcggtttttgtggggcccaccaatgatcactagtacagatccttctatctgtagggagctctaacaggcctagaaatagcgcccggtcctaaggaagttcttttgtggcgggccacaactgtaggaccgtttgcgagtccattccatatctcaaacgggcctcaagttgtggcccgtcacaaatgaccatcatctgtgacgtgcaccaacttgaggcccgtttgagataacaactaggcccgtcatagatgactcatcagtgacgggctatatacttaatctctatcgggcattaactaaaacccgtcaccgatgactattttttcatttttcatatgaaatgtttatatttgtaagttgattatagcaaaataattttacgggtagtaaatgatttcaaatggaaaaaatgtcaacaacaaagttgtataacttatcaatatttacaacttttagtttggtcattttttaatataacatttttttgaacaatttgaatttgaatttaaaaatatgacaacttcaaaaaacattttcaaatactaaatgatttcaattga

SEQ ID NO: 78438 - DNA, 4507 bp, Oryza sativa
gaatcgcatcgagggaggccggcgacgagaggcgcttccgagctcgggcggcgacggcggcgagcacacggcgagcgacggcagcagtcggggcggcgccggctagctagggggggctacacatgctactaccgaaaactaaggggaagagatggattgaggagggagaacggggagatgcactaccgagatgaggcggggcgctgtgacaagaggccgacggcacgggagtgatctctccggcctcgggccggggaagaggaagaaggcgagcgcccggagtccccttccgcgtccacgaacgcaccggctctcccggtgcttggcgatgaacggcggaggcgagacagaggggcgacaatgcgcggtggcggcgagcgaaacgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgtcggcggggaggggaaaaggaaaaaggaagggagaaagggggcttgcccattgccactttgggaaaaggaggaggggatgggggcgaccggcagagggaggaggagctctgccttcgtcccttggaggctagcgcggggagaggcggggccgagtcgatgacgacggcgatgacggcggggcggtttggagcggagcgacaacacgggcggctggcgtgggcaggcgctgacggcggtggcgaccaggcggtcggccaccatggcgcgcgcgcgcgcgggaagcaacgggcggcgcggcgagaagcggcagcgagggcggagagcgctcggctcggcgcggctcacgcgcacgcgtgcgcagcgcacgggtagagcgggggagagggagagggagagagagagagagagccggggagggagggggagatgggccgagaggagttcggcccatcgaacccgagggaggcaaaatagacttttgcggagagatttgatttgggaaggatttggattcgggattgaactcgacgatagattggggatttgagatctgagatggcatggacactagacaacaagcaaagaaacggatttcgtaaatagggtttttaagagatagttttcccgctaggcgccacgatggaacgggcgctacaagggaggactaatttgattgtacaattaaacataattattagcaacaatagtgcttttatatttgtgaaaaaaaaagagagagcccctaaactttccataaagaaaaggaatttacacctacttgtttttaaaacaaactaagtctaatttcttttagatgatgaaatggatcataagtattttcttattgaatgcattgtatattataaattggccctcttcttttctccaacaaaaactggataaacttttggataaaaatggcacgcttttcaaactgctaaacggtacatttcgtgcgaaaactttctatataaaagttgctataaagataagattaatctatttttcaagtttgtaataattaaaactcaattaatcacatgttattaccgcctcgtttcgtgtgaaacacctaatctttatcttcattttcatcttcggctccagtggtagcggcggcggaggcaagggcggcgggacgtggagtgaggcggcgacggcgacctccttccctaccgtcgcggcggcgcagagctcggacacaccggcactgcggcggccgcccccttcctcctgcgccgccgtccgccgctctcgcctccgcccgtccttgccctctgcctacccccgcccgtcctcgcccactgcctgcccccgcccgccgcacttcctcgcgcgccgccgtctgttgcccaagcgagccaccgccctccgcccccgcccgccactatcttccaatcccgtctctggtgcagggcggcggggcctcgaagacggcgagggggaagtgccatcgtgcgccgcagcctctgccgtcgttgccgccgacgtcgatgtcgtgcgccgcctctaccgacgttgccaccgtcgccgcagcctcttcccgccctgacgagcgcgtgcccgactcggccatccctgccgcgctcgcctcgcctcgcctctaccgccgttgccgttgccaccgccgcaacagcctcgtccctccccgacgagtgcgacagggccgccatccaccgcccgccttcacgcccagaaatttagcccaaatttccagactattttgtgtattaaatctctgtccagaaccagccagggtacacaaaacgacaagtaatataccgttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttctaacttcgtcttcagctcagaagcacaatacttctgaaaatggggaataatagcaaggctgagtacaaccaccgtactcagcaagccacatcaatgatgcagacgtgcaaggggaacacaaggacggtttgtggctatttgcataaaggcggttgtaaaacattttattgagcaaaacagtaaaactgttgagtaattaaagtaacattaaatctccactcatcaacgctacaccacgttgaacaggcccaaccaacccacctgaactacagtgcattgagtcgatttattaaggtgggactaatcacggtgaatctggtcgaccgcccgtaactgcgggcacggctattcgaatagttttactctggccagaggtgtacaactgtacccacaagactcagccccacgacacgtttccgtgcgccgacatgccaccacgacatactggaaagaggccgtgacaggacccttcgcataaccccctctaaccgatcgcaccacaccttagggttcgcccccgcccccagcagacaatgggcagccctcctctcgtgccgcgatgaatccagaagccgatcaaccggacaccccggccgacccaactccatcatgcccaccctcgcctgggtacgtcggctagaggaaagctacactacaagcccagccgttaccacgctggcttgtggtaagtacgataagttcttctagggcatcccacgaaccggtctttaattgccatgggtgcgactagcataaccatgcacccacagcccaccattcagtcgcattctagttggataattacgacaatgaagcatggccagatgtctcgagcacgcagctcattctgatactaaaaaggtctaatattgtaattatcccatcaactgagctagtggtaattaagcatggctaagcatatagttctagctaggtcacataagtaacatgagctagccaatttattacccaatgttgacaaaggacggatatcaagtaaacatggcacaagcgagcagataggtaaaactctgatcccatgtaattagcaaaacatgcatatttatttgcaaatggtaaaacatttgtaaattgggatcaacatgctcaaggggaatgtgtgacttgccttgcttctttactttgatcttccgaactcttttcctcgcgaccgcgaacttccgaaacgacggatcctacatgctagcacgcaaaacgaggaaaaactctaataaacaccaagaaaacagtacatgaaaagtaaacaaacatgtagagcttaattttagatgaattttgcaagttgaatggctcaattcggagttcgaatgaattagatatgaattttagaagttttgagccatttaaatgaatttctagaattaatatcgatttattgcacaattattaattgttttctcaagggaaaaggcacggctgacgtcatcaaagaggaagggcgcgccgacaggcgggccccatacgtcagcgggactaggggagggcccagagcacgggcatggcttagagccggcccaaccgagacacgatgcgcggcggtgaacggccaccgacggcgagcggtggcgcgagagggcgcgcgaagggtggcggaaaggagaggaggaaggggatgctcaccaagcggcacgacaccggacggaggcgagatagcggcggcactccaacggcggccaacgggcgacgaggctgcggacggcgaccgggacgacatggggagcacgatggaagggttaggaaaagggaggaggcgcgaggcggcgggaaaactcggccgaaagccggcgacatggggagtagctcacctcgacgggaaggagaggactccggcggtggaaggcgagggcgatggggcggccgaggtgcggcaccagcggagaagccgacgaggcgacagcacaccgtgaggaggtcggaaacgacggcaagaggtggccggaggcgacagtcacggcggcgacctcgggttcacggtggggtggtagatgcggtggcgatttgggaaaaccaagcaaaggccagtgtgcggca

SEQ ID NO: 78439 - DNA, 1263 bp, Oryza sativa
tatagtttataaactagataagagatatgtcaattttgtgaacaatgttactatcactttgtcgtatgaagaaatgaccacaataaaagttttagatcttgatgagttattcaactttgttgttgatgactttttcagttgatatcatttagtatttgaaaatgttgtttgaagttgtcatattttcaaattcaaattcaaacggttcaaaaaatgttatatagaaaaatgaccaaaataaaagttatagattttgatgagttatacaactttgttgttgatgactttttcagttgaagtcgttcactgatctaaaattctttttgaacttttcaaactttgaatttcaaatttcaaattgtttaaatagagtcagatggagaaatgaccaaataaaaattttgcacctcgatgagttctacaactttggttttggtgacttttccatttgaaatcatttaataaccccaatttaacatcctggcctagggcataataggattaatagaatactcgtatcttccggaagccaatctctaaagaactttgacattaagtgtgcttggtctggagtaattttgggatgggtgaccgaccgggaagtttgaacttccgcgtgggtgcacaagaccgacgccgagcgcaaagacccagacgacctatctttcgaatgcccctctctgatgaccgctctcactcgggcctcagctaatgcccgtcacagatgactcatctgtgacgggttatagttgtggcccgattgagataggtcatctgtgaggggctatagtttgattggtcgtctgggtcaaagctatcggtgacgggctttacttagggcccgattgagatagaatcatctgtgacgaccgtttgcccgattgagatagctcatcacatcagtgacttctagcctgtgatggacgccatgcccgattgagatggggcttaccgcccgattgagatgagggtatccattctagtggattaaaggtgccgttttttgacatattaaaggtttcggttttttaataaaaaccagcacctatagaataagtgttggtttttatttagaaccggcacctataattgtttaaagatgtcgttttttttgcaatttcaacccacatgtgcgaaaaggcctatatgtgtcagatttagcacttctggcacctatagtgtcgagaccaatttgatgttttgtagtaatgtgagtaagaagctattgatggttaaagttttacagtttcactaaatctgatc

SEQ ID NO: 78440 - DNA, 1808 bp, Oryza sativa
ggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcacttttattttcttttcttttttaaaagtataatatttgcatgtggtggattccttgacgcaccaaagaccacaagcagtgatggccacagcacaagtattgtttcatcgtttttactgcaagaaatcatttgttcggttagcgttaaggtaagcaatcttttgtctcagttactctgatcaaaccagtctttgattttatgagttgaaccaatgaatatctctgtttatgcttgcagagagttgctgcaagctgtgtttggctggcagggaagttggaggagagtccaaggagatcaaagcatataatcattgtcttccatagaatggaatgtaggagagagaacgtaccaatagaacacttagatgtgttttcaaaggtttatctgtttctttactctctgtttattttaaatattttttgaacctttgtgcacttcaaatcttgatgtctctagttcttgctctcttgctgctagagctgtaatacctatgcttttttttagaaaatatgtaacttttataaagaattatgctaattgaaagctgtaactatttgttgcagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgataggtacttcatttgaactaaacttaccttattgtagttagatattcttattgaattttatgcagttcaattatatcttactcttaagtcttaactagttttttatagtccttgggaggtatttctagttgtagactattaaggctgtgttcggcagcttgtgttcccaacccctctccctcgttttctgcgcacacgcttttcaaactactaaatggtgtgtttttttgcaaaaaaaattctataggaaagttgcttaaaaaaatccatttattaagttaattttagctaatacttttttaattatgcgataataagctgttacgttttccatgccggagggatagactcccaactggcacaaacgaacacagcctaattgtacctgttatcttataatacctcccaaggaccaaaaataataatatattctaccttattggtgaaattttgttttagtttagaattattggttctcttaaaagatttttccagcattgctcttgactttctcttatag

SEQ ID NO: 78441 - DNA, 1600 bp, Oryza sativa
tagtgcatgtctcataatctattatacgtatatttgtcatttctatagatagatcactctacataaatatatcaagtctgattgatctcggttaattcattatatttggtgatcaattattatttgatatatttatctagattaacctgtttatataagtttttattggagtaatagccagtacattatctattctacctctaaatattggattatcagctatttcctaatactgtcaaaaggtgattgttaaaaacaaaagaggtattgtagtcgatagtacatatttagggttttgtttcacttgctcatcataaagccacatcccatttggtttaactgcatcggctaggtcctgacgatacgttatcagttctatcggccgatcggctatcgttcatctaattacgttttgttgcaggatcaaaccagctcgtatgctcttgacactcgaggcaagcctttgaccagcactggagtgaagcaaaatctcccagggcaccatgtttcgcatcaacacttacgtcagagtttttttttttatattaattgatctctaagcctaataaaatgtaaaaaaaaagacctatgggggtaaggccacctatttataagggctatggccaattttaatatatcatagccccgaccttgacacctacacaatcgaatcattttatacctttaccttttcaccatattttctaatttaccttagttccatccaacttggaacatttccatcgtaaaccacccgtctttgttgtgagagtgtgatatccttcgtagctttgtcccgtaaaccttcgattcacccacgagatgggtcattatttccgtattgatctaaatcagcttttagactggtttaatctctaaattggctctcctagccaattttgatcttttgtgaactcatctgggttgagaggttttcaagttggaacgttcggtgactcaattaaaactataaatctttagccgagtctatgttggtaaaaaaacgtcaatgcaaatcaaccatagagactagttccattgtttcacattataggacgtcttgggtttttaatagatttatgtatagatccatatatgtgcttcatatttatatctatattcatatgaatattagtgaatctagaaaagggatgagaaaggctaaaacgtcttaataatatggaatggaattctgattaccgtgtctattgatattgctcatccattccataacagagttggttagaaagacaggctgatagagttctctgagtctcaaacggcatgtcctatacagagtagttttttctttaaaagtaaactactgctagcttctgccaacagttaacaagtgtttctctagctagttaaatttctgttgctacgatgaaccgacaacagtatactccactgtcactttcagagttggacaaagtcattaataaagttggtagaattaaatgggagagtattgtgattggagaaaaagtggggataggtaggaaaattaaatggtacatgattatgtttggttgggaagagaacgttggtgaagaacttgttttattttaggaaaaaatttgaaggctagaagttatta

SEQ ID NO: 78442 - DNA, 2886 bp, Oryza sativa
agctgtggacactataaatcagcggttttgtttatgttagccacgtggaaatgacttgagttgtaatcaatgccatggaaaccattcgttttcatttactaagatatactgatcattaccatcgcttattaatgctcattggatcaactttttttttgaataaccatgtttctgtaggcgaatggcgaagcgacggttgtgagtaattagcccaaatattcctctgggttaagttaataaaagttttggatgccagcccaattttgtgctaggtggagattagttgttgtaatgttcgattccgccgacttaacctgtcagagatgtaaacagaaagtgttcaatctcatcatacttgcaataaagaatttgcatgcataactgcgcagttgcttgatgatcatgatgagttttaaggaaacaatacacatcaagctatgatcaggtggtttcatgttcatcattcgtaatggaaccaatatctgtgattggcaatgatacatcattgtaatattcagctgcttatgctctactcctttccattgtacttcatgtcagtctggagaagaaaggtgtacgtgattgctggacgtttgacctatgaatgttcaagtccattcagagaattattatataaagctctggtttatgcctaagtttgcagcttaaaatggaactttatcaggcaaggatgctctgttcaggatctgtactctatgagtatgatcttttgataacgtggcagtttgaatcactcgatgtttttctcttttgggttgggcaaggatgtaacctaagatttcttagttgactacggttgttatcggatcactaagcttctctaatacttccttcattccaaaataaattattttttcacctatctcacacatcaacacaaaacttaaaagataagaatacttttactttatcaaatctcaatatagatattcttcactttatttatttttaatataattatttcttattttcacaaactctgatacatttacttaaaaaatgagtttattttaagataaatgaggagtcaaaaataaatttattataagatggggggagtaggttctagctggttgaaaactgtatcgatcagttgattccaaaggattagactgcctctattaaccctctggacggtctatgaaaactgtaatgaccagttgatgcaacaaatcatgtggtatttgagcttttatatgctggactagcagcagaaactgacaaaagtagttaaatgctaaaagtaaccggtggtgttcgaaactggtgagatgaagattaagtagatgcaaataaaataagaaagttattagtacatgattaattaaattaaattatcataaatttgataaatggatatatttgatattttaaagcaacttctgtataaaaaattttcgcacggaaaacaccatttagtagtttgaaaaacgtgctaattgaaattggggtaaaatccgaatcttaataagaaaagaatattgtttaaatatagataaaataattgaaaccatcaatgatgaccagtattgcatactgacgtaatcacatgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttccctcctttttgtttctcgcttttggctaggaaagacgatcacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaagaaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacatgccaaattgcttaatttcccttgcccggccggctgctcccacactcccacactcc

SEQ ID NO: 78443 - DNA, 2756 bp, Oryza sativa
aaaaataattcattattgcgtcataattcaattaaaatccttataagtgttttaatccgatttaatctttaaaaattcataactaattcatttgaactcagtttaatgtggttcaagttgcaaaagttgtataaaataaagatctacatattaaaattatccataaattggattaaatttatttaattccttttaaatgggctttaaatagatttaatcttgtaaaattcataataaattcatatgaagtcagaatgaggccgttcaagtctcataattcatctaaaattttgatctacatgtttgtttactttttatgtattgtttatttggtttttattagtctttttcttcgttttgcaggttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgatacattgggatattataatttgactagttgagctttatatatattggttcaactagatgttagatataattgcttagccatgcttagaaacattagctcactaatgggatgaatcatatatactacattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggcgttaccttttgtatagcatgattcattgtggagcaccagactgagaagtggcggagataagcccacgggggtcgctggggagtccatgccttgttttataagggtgtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggaatggataattcctggtttggagattagatctgtacagccgggtatggttgttcaggatggtcgggcttgtgcagcatgggtgtgctgttcagtgttgattaaaatttctgattaactactctactgttttatttcacttaaatatttggctaaacgttgcttttgcaaatgagcctatattatgccattctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttaatgcctcttaagtaagtatttatcgttttagtaaatttgatgaatctgtatattaaattgtcaatttgtgtacctcgactgattcctggacgaggatttcatgcacaaataagttcggaaattactagtgaatttccgggcgtgacataccagctctgtagacccccgtttttataacaggaatcaatcgtgtaaacattaccatttccctggatcaagtagtctggtacacacgaattcatagctgaaataccaagtgcacatacacgagtgtctggtatgaattattacatcacaagctcgcaggcatagttttaaatcatcggaccgggcggtccggaattcatatcaaaaacagaagtaagtaagacagcggagtcaaggcagcggcacgccattgccacaggcaacgacggtaagtaagacctactgagcgccatcgtcttcatcaccctcctggtagtaagcgtagggatcctccgaagcttcatctccgacctctgattaagtttatatattgtaagggtgagtaccaaccgtactcagcaagccaccacagcaacaatgcacatgacaggggtattcaaagggtggctatagttcttttgcgcaaagcaagttttgtaattcttttcacgagccctaagacctagcacggactgatcaaattttagtaccagtgttcatatttaaacaatgacggttctgtccaccatccattatgatcccaaggatggcttcccgccattgagtcgtcatggtttactgaggacgtccaccttcccgcctctcgggaagtggctccatcagcatagaaatcattatgcaatatcccatcccatacaatttaagaatttagagtctagccaagtgtaatacatgtcccggtgctcaataaccacgagcacgactattcgaatagatttggtttactcacactgcagtggatgtacactttacccgcactccgcgactgcccaacacatgagcctcgtcccaactcatgagatatgtcacggcaaa

SEQ ID NO: 78444 - DNA, 1207 bp, Oryza sativa
cgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaaggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacctagatatatgcgtgtcaggttgtatatagggttttatcttcttttagaacagactagtaggcacaaataatctaagcgaacaactagcatgtattttatttacagtacgtgacacttctgctctatccgctattagtagtacttttttttttagaactggtattagtactatttctactttttttttttcgcattgcatgtttcacatgtgcacaggcagttgtggcagtcagagtgtgttgggacttgggagagttgtactgggagggaggcagtgtcaagtgaggctatgcgatctgcgatactataagcttgtatatgttcggttgttcactttatcatcattttaactttgctaaattttgataggggtaataatctaaaacaaaatcttagcaatatcattctaccaaaaattagtatact

SEQ ID NO: 78445 - DNA, 1141 bp, Oryza sativa
aagcttgaaatcttaaagcactttgattagtaaagatgataattgtagattggtcctgaaaaatacttctatataattatatttttaatgatctctatgaccaggcatgtgaataaaaatgtaatgataagacatcatacacattggagacaatgcaatggaaacggcaaacaaaaaaaaagatctggtatatatgtgattagggggatcatcaatatcaatcaattttttaaactgcacgattgcatccaaaggtcacaggttaatttttttacgatcatcaaaagtaaagaatccccaccagtataaaaaaatattatcttcaaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagccgtgagcaatgcacgcctcccagaagagcctgtcactctcggcgtcgctgccgccggcggcggcgacatcatcctccgtcgccggcgcggcgcacttgccgtcgtccgcagccaccaccagctggtagcccgcgcagtactcccgcatccagcgctcccacgacaaagcctccacggagccagccgccgccgccccgccgcctccatcctgatcacccccgcagcacgactcggcgtcgccatcgtccgcagggcagctgccgcggtccaccgccgccgcgtccgactccgagtcgcccgtcgcctccatcaacgacgacgccatgctcggcggctgctcggagttcataccgacggggcgacacaggaggccgagagggagatcgttgtgtcgtggcgtggcgtggtgaggagaggcgttttgtatcgggcggggaggtaaaaacgtgaagaatgtgggcaaaggtcgcaaggaaatgagcgagcgacgggtcaaagattactgatgcgaagccgaagcagcagcggcagcaagaaaaaaatgggtttt

SEQ ID NO: 78446 - DNA, 11178 bp, Oryza sativa
cagtatgaagaatcaaaaaattgcaaatttgctggttcaaagaaagttcaaactgacctgtcccatctcaacaagtttctatttgacagaccccaaccaaaaggaacctggattagctttttttaaaccttgaaaagaaattcaacaagattggacgtggcttaggcttttcgtgcactaacacatgtcaagactggtacagctttttcttttcctgtattaactcgtgtcactcatgcacatgtactaatcagttaatacattcaaacacatgaaaaatgaaacagattcaatagaagaactcacagccaatacaagcgaaagaggaagggcggaacatggattgcctttttttcctaactatcagaaggtcgttgctgtctttttcgcattggatttctttcacgagactcggaaatcaagaggatgggaacgactactgctcaaacgcataggactgaaaaggagggagactctcaaccagagccgttagcagaggaaatctttctgcctggatctggaaaggtccgtgccgacgacttctgtcacaatccagatcttaaaacgacaatatgcatttctcaagactgaatgatattctcgtctttgagagaaatcttcgtgcttatcgatttccttacttggatgatttggcagttacactatcagtttcatccatagctgatcgatatacatctcgggcagtacgaacgaacgacttccaatagagcgtcgatctatccaaatttagatagaacggaaatagacttgtaaggaacagccgtcgaggcagtacgaccagtagcctatggcaccaataaaagacaggaagggactagatagactttgaatagctcaaacccgaaagaacacacgttttgcgaatcgaccgaaccagatgaaatgccattgaaggaacgttgaatgcgataggggcggtagtatctacatcccatctgatgatgaaatttatcccaacggaagcaggagtgggagtagagtccggtcaccataaaatggcgaggttatgttatttgatgtctctgaaggggaagaaggggcttgtggcagcagttgagaaggaagaggtgatataagaggatccatgggacgaaccgagagaaggcgaaaaggtaaaccgttagacccccgaagccaagcagaaggaaaagaaaatgagtgagccgactgaagaagtggaaaagtgggaggtgcttccgggaaaattcgtaaacattgattgcgggtagaagaagggaaagggagatgagtgtgagggagcccttttcaccattattaatgaatttttccattagacctagctcttgaaaaagtaatggaacatgcagatgggcagcaactcttcttttacgctaggtatgccggtgatctagtgtttaaggttttggatttaggacctagatgtcatcgaatgaatgctcggtatacttgctttcggaaggaagctaatctgaacactgaatctagaagaaagaagcttttctattttgagagatgaattcaaagagagaaggttgtagaaggtaagtaatccgatgcgcgttcaaatccaacaagaacgtctaatgaaatgacggaagatgcatattattctctcgtagctggggctaagaacgatcctcttatccaactttctgtctgtcccaaaaccgaaccttgcttctgcttctacttgaccggtgcttgcttattactggcattagttagtagcctagctagcgcccttctgtgctattaagcatatcttgcaaacctactgaatgttgaatctcgattgatgtcagaaaccaaccgtagaaagagaggtcgaagcacctgatcactcgttcagctcgtttttcgctcgtgcctgtatggaatgcataagtcattgtgttttggcggtggagaagtacagaagtaaacagtgtgttagtatttagttgtgcgaagcgttgttgccaagacttactcaactcacgactttcacctgcttccggtgacaactaccactctcttatgaatgggagggtagagtaccaagacatagggattagccagcgaaggcggtttatttagtacctttacttggtaaagcatgagaggtgtgccatcttttgccgaaagtgaagaactcgagcgcttgcgagcccaatttgatagcgccagggccgatttaaacgcatccttagcggaacaaggcttcactcctaaaatgaaatcgttagggacccacgctcaatcgtctctgcgcagtcagtccctcgtgcagcttcgaattaaatatatgatgtggtctcgctcattttttaagggctgtgtctttcggagttatgggctcttccctgtgtccgcaaagagttctgcttaaaactatcgtgtctgcttgatcctaagctgcaaatgagtgaaatttggggttgaatttcgatcataaacatggcttcgcttcgtgttattggttcctttatctccgtcttattgggaaaatggcagctcgaggagggcccgactatatccaatcttactggccctatgtgcaaaagttttcaagtcaattttccctcgagtcagtgtcacaaactgagaaacaagtatgatctccctatcgacaaaagtcctactttttcactttttagtgtattttatatgtgctatcatatatatagtgagtgtattttcttgtcgtctggttgatagaaagaacccggaatcaaaccggtgaagggagtcccgagcgcacccttccatcccaagcgtccttcctttttttttcccggttcaccacccactcattaaagtggctacgtccggggggcttacttatcgaccacatacccactattctttcccgacgcctcctttctcttgcttgatggaatagttcaatgcccgagctcctgctttgcttgcgttcttcaccggcgctcgccagatgtatcactcatcccgaaaataaggcaaggagtctgcagtttgttataatcattacgggaatgaatcgcatatgttggtttagaattgctcgggaattcattgatagtgacttttttcagttctaggggggctagtctactcctcttttttctcgatcgagcccctcattctaatcgtccagccctcttcacgaacttgtacaatcaatgccacaaagatagcaaactcgattatcgaatatataaggaaaggggcgacgatttggcaccagatatccggaggtgtggaaagagcagctgtgataagcggaaaaaccatcaaaaaacgacgattgctcgtgaaggtttccacagaaagaccccttggttctggcaaacagatcacaattacaggtacctgagagcataccgatggaatgaacaaaatacgaacagttaacataatatagtcatagatcttaggttgtaacttgatcatgagcgaatttgttgatgttgcacccacgaagtatggaaagtgccaaacattgggaactacccggggaggagttaggaacaggaacaaggagaagcgagaaccacttaaatggaggaatctattgtatttctgcctttgttccccatagcaactggggatcgaaaagcaccaaatttgatgacttattaagggaaagacgaagtaagagcatgctattgaagacgttgcaacatatgtcgggggggcctccgttgattgtgtacgaacaaaatacgagtccaaaggtagggtaagaaagggtttagctaatggagaaattgactcttccgagaaccagtaacgcgtaaaccatgtcaaaccaagaccgatcaatatccgaacggaacggattcgaacttttcctagaaaagtttccggtgcgaaattccattcaatgagtaattcaaaggataaatgcattttcggcatgcggtcggtagggtctacttcccccttcctcgcttccgtccgctatccgttgtgtcatggcacagtgggacatctgtcagccttgcatttctcaacagggctatcttcccttttccgaacatagatatcaaaaaatgatgaccaaggaaaaatgagtgagttgattcattctgtctaaaaactctatttctatatgatatgataatatgtcaaaacaagttcgatagcccattcataacacaagcaatccccttctctcggcacgtgtaactattcccctccttgtctaggatttctgtcttcaggaaggccctaatgagatctaccagtgcttcgttttcattcccccagttccccagagcaccgaaaaagcccatgatagaagtattaggattaagactaaaaagaataccattcataccgaactatcctgaataaggtggattggctaaggagtaggaagtttccagagaataggtcccggtcaatcccaatccctcattctgagaatagtgagaaaagcagttactttatcgtctaaatgtcggaaaaatgggtcccctatcctccggtaataaaattccataagataaagcctgccatttaatggcataataaaagacaatggatttatgcctaatccgtatataggtaaactccaggtccgaacagcattattatctatggatcccccttatgtacatatctctgtggagaatcgttctttaatttttcattgcattaaatatcttgaaaaaaaaaataaaattgactttgatatgtagaggtccagaactagattggtatgtacttaaaaaaagtacttactttattttaggattctacaacgaaatcttatattttctagcaattctactactacgaaacaaaaaagaactcgattttccagggaaggacagctttctcttttggcacgagagactgataaggcaaggttttcttattcccatagggcaagctaggcttggcagagaagaaggatagagaagttctcaagtcaagtagactgggctagggcctattactatagtaaaagcaagcttatagtcgtaccacttttcgaggtagtcacgctaatggctggagtcatgctttataagcttatagccagagggaggatagcgtaagcagactagtgaagagaaagctgagcagaattcctcctcacgagatcgacttgtctacttacgagaatatgcatttcgaaatgaaaagctatccccagaaaacaaagaaaacgaataggggcgtagcgaaggcgcgtagcgatgataatgttaacaatcttctggatgagctcattgctcggactcgcatatacttgttctatgctctacaggctaatctgagtaaagaggaggcgcgaagcgtgagatggacgagagaacacacacgatcggcacatagccttcaaagtcgtttttttattggtagacaccgagaagggagcccttgatcctagatcagtaagagaaagacgtaatgaaccggacagagactcccttgctttattcagtcatgacatggagcttcggccaatcaagcctaggtgcggaaataaagtaaatgaattctattcaagcaagacttgatccaaatggatcccctcaatgctgagcttgttgatgaagaaaaagagagctgaaatagagattgtcttcggtccacgcccaggccgaaaccgagctattaatctctaaatacgctaattgaatgtgctttaagcaaggaagtagccgttcaagaaatgtagaggttgctcgaccaaagccggtcaataaggcagatctgaatgccacaataccggctgttcaattttagaaaggcccatctcctgattgtctcaaatcgaataaaactctttagcaattggtctgacagaacggatggtaaggtgggggacccatacctttattctattcccgtgcttagagcgagtgaatgtttggatcatatgctgccttgcctgatcttactagagtgagtttccttcgctaacgagatgatgcatattctcagtctggactattcccagatttacaaccaacaactagtcttatcttagtccatggagaggaaaaagcaaacgaagcacgttgagttatctttcaattgaattattaaatacgaccgtgaaatgcgtaacttatggcttcggtctctctctttcaattctttgaattgctttgctttcgcgcagccggtgcttgtttggccaaagataaccaaatcgtctgcatacattgagtgagtaatgcacggtgctgtcggtgccagctttataccactgatttgaccattttgctgtgctaggctgaacatttggggaagatactccattaaaattctgaacaagtaagggaacagctctggatcccaagacaagacttcctcttaactagcgaggaggtttaagggaagtttccttcaccgggcctgggaaggatagaaagaagtggaatattcaaagcatcctagtaagaaacaaaacatgtcaaaaaatcctttttctgggtccctgagactcttgtttttccattttgatgttgttataggcttttcacccacccgccttattcccttatgaagagaaagttgactaaataactagattctcaagctctcattaacttaaacctcttctttcgcctacttgttttcctgcttgctaagcggcttgtcttgttcgcctcggcccagcttcctttccgtagtgagagaagtgattacactcgaccatcttcgaggctgctttctgctagccatattcctaatctgggtatccttccttgttcaggaattcctggccatgggcggtattcacttgatatcgcgttcacaagcttcttctggcgtacgtaatgtgaggtctttccttcgctccgctactagttctcctgggccaagattgatttggggcatcatgttcaattgtgagttggacagttcgttccggatctgcatagtcagaaaatctcgttccaaccggtcatgaaagttagtggaagtgtatgactgctttctttgttaggtgattgatagagtttcgttttccataactctcgagctcattcatcgtagaaagcgtgcattgtgctcttcctatcgtcgtataaagaaaggtgtctgttttttcagaaagagagcaaagctgccagaaaagtagaatgccgtgaacaagggtggtttaaaatcgtgcgtgaaccccaatttccactcaatgcgataaaagcggaggcctctctctccgggctagaaacaaaaacgaaagtgcttgcattccattagctagaacccgacagtcgaaggcgtctaaaagaactctttatttcttattggctttcatttcacttcgaggtaagaccttattgtctagtgagtggagtatcatttcctctcttatctttgttcttttccgaactgaatagaaaagagaatagctctcgaaattgctttttccttttcttattcttcctttcctttcgaccatcttactttgaatccgggctcgcctacactctgttccgggctggatgaaagggaatagagctttgactggcgcgaggtctttcgcgaattacgattccaaggagggggttacattccctgatgatggattccttggttttatcccaacaatactaccctatcctacctataccggttcatagcttttgagaattctcttaccgaggaaggcacaaaccttttgaagtagtggaattgccaaccctatcttacttttgttttgggaatgctgattcattttccccttttctatactactcattccattctctttgtctttctccaacaggttaatcctagcatctgatcccttaccaattagggaattctgtattcgggtttgtcttaaagtatttatccgggtaaataagggaaatgaactgtttcattcctcacggctttccctccttgctattcttacctttcacctgtaataggtgtgatgctataccggattatctatccgtggatagtgttttccttcagatctgagtatctcacatactttttttccaaagggttctgtttctggtaccgccaaggggttgttcacgtattaactttccaatgatgctcttttgtacctccatatgtatcttttaggcctgtattcaacttactgaataagtaagaatcccaacttactctctagcttgaagcactcttcaggaatttctaagagggggaaagaagtcaaactcaagcctatccgtcccctcctctgggaaagaggagcaggctgttaggcagcccgggtttaatacaacctctagggtaggccgtgaatcacactgtcaaaaacagagtagtttatacactccaacaaggaagaaatgggaaggcttaagaaaagatatcgtctttgatttacttatccttagtaacctacttactcctcaacctatactatcggatcataacgttcgtgatacgtgtttaaaccctcgctctcttttgttcaaagagtgtgtatcaacctatacttggattaaaccaatccctataagtgagtttagttagctatctcttgcggcgttctctaccgggagagctcgatcttccgcatacgttgagtatcgtttagtgtaaactttttcctatgtttaataacattctcccctctaattacctaccccttatcgaaggataggtataaagatacaattgaatagaagaggaggttgtagcagcactcgtatatgctaaatatcatatattaggcccgtggaactgacagcacgccgaactaataatggggggcgactcgccggagtcgaaccgacataggttaaccctatcttccaataaggggaatcgctttggttacgcagttcagttggcgctaacaaccaacttacgtttgcggcccatcacaggcaaggaaatcgttccaattctatatatgaaaaaaaaaagaaagaggaaagcgtaaatcaatttagttatcttagctctttcagggaatcttctctagagccctacctggagtactaggatctttccttagtcctcccagagactgcatgcaagaaaaccgtagggaagaggacaagctggaagaacactcccaagataaactaaaaatccacgttgacgcaatctctccactttttgaccagcagaggaaaggcacacagagggtgcaattacatcaagaacgaggtggaaggagcataagctcttgtaataagtccggttttttggcatcatctatctatggggccgtacacgttagatagcgggaaggtataacatctgccggtaggaagcccatctggagcggtttggtttactagcatttcaggcattattgaatatagttgcaagttttgtttggctgtaggcagaagtctttggttccgctttgttaacaaacgtgcctctctttgctttctcactttcccagaactgctactttcctgcttttagtacattgcttttcgtatcatctatgagaattctcgtttcagaaactcctcaatatagtcgttatggcaattctaaccatgtagattttattaccaaattgtagttttttcttttgccaattccacgcctctgtaaaaaaatgcctaaaagggagggcgagagttgaagtggatggcccttctatcacctgaaaggctgaaactcaggcatggctttacatggcacacttgctttctttcaggctgttttggctcgcaataaagctagggtcctgatcgagcaagactacgtcctatctatctacctctccaaacacaatatcttgagtacctatgatggtgactacatctgctggcatgtgatgtttggacatagaatcgagtccttgtgaatgggcaaagccaggtgctcttattttacaacggtagggacgattactcccattactgacaagaaagacaccaaattcacctttaggtgcttcaactgcggtataggtagaaggagctggtacggaaaaaccttctgtataaagttcgaaatggtgaattgaggtagagtagaccgatgatccggtagtcatttggccggctatggaaagaaaaagcttgcatctgctccccttaaactataacaggtcccatctctctccaaacctaacgtggtagtttcccatcataaggctttccatctatagattgattgagccattacccaccaaggatcccattcgttcagaactcagttgactgcttctatagataaggcggaacgtccttagttcagcattatagcacatagtctccgacgctactacagcgcttcgctaactcgaagcgcctcgctatgagaatgacgcttcgctaacgctcggctaagtcgtcgaaccctcgcgctgaccattcactttctcagtagcaaaagcgcttctctttgccccttaacttaataaagtatttggaaaagaaagagattcttggttttattgctcctcatctgcgctcgtcaagccaacttagctttttgggaggtgaaagaggggttgaagcggacatttcgaaatgacagcatcgaagatatctatatacacaggaacgcttattccggactgcgttccggaaaaagtagcctacttgacagaaagggcgggcactctcggctcggaggtaggcactctcgtctttcaaccccaccgtcactttgaatttagtggggcactgtttacttacagcctctacgagttgcaagtaatggggcccgggcgggtgaacccaagggtcaacaagccttttttgccttaaccctaaacaaaaatggaaaaggggcctcgctaatagggggcaattggtttcaacccgactgggaaggcccccttggaaccttatgtcaactttcaaccaggtaacccggttcccttttcggacccccctgggcggggccccccaccaggaaaggggttaggcgttttccaagggggccaaaaaaactaataccccctttttttgccccggaaaagaataaaaaagaggcaaacctctctctttgggttccccacccgtgtggtttataaggggggcccctcctctggcgggaattggggcccacacccttatacagagaaaccccttcccggccacaaagggttttctccttccggggttccgcgggttcctattgccccgggttttacgcggcctcttttttttagtttttcccccacaagcgagaattttccccctttttcgggcacaaaataggagccgccctcccttacaataaaaggagggcggcgggggccccccccccaaatctttttat

SEQ ID NO: 78447 - DNA, 2552 bp, Oryza sativa
aaggtgttaataaaaaaggcccgatataaaatacctctcgcaacgcgggaaagtggtgaccccgcggtacacatatcttttaaagagaaaaaggttcttttgccccttatataaaaatgtttgaaaaaaaaaagtttggtgttatatgccccatagggcgcggaaaacaaatttatttttgggaggtaaaaagggtttaggcgacctttcaaaatccagcctgaaaattttttaaacccaggacccttttccggatgggtttcggaaaaagtagcctacttgcaaaaaaggcggccattctgggtcggagtaagaatttttgtcttttaaccccaccgtcactttgaatttagtgggcactggtttactaacagcctcaacaaagttcaaattaaatgggcccggtgcgtggtaaacgaaaggttccatcaagccatttctggccgtaaacccggtaaacaaaaataggaaagagggggactttactataaggggccaattgccatccgcacctgcctgtaagggacctcttgatacctattgttcacttcataactagtagcgggtttcctgtcgcgaacccagttgcgcggagccccaacgaggaaggtgttagtgctttctcatggggtcaataatactaatccctctttttgtgccgggaagaagataagaaaaggcgaagccttctcttggtttccccacctgttgcttctaaaggctgccctctctcggctggattttggtccagcctactacgaggatcccgtatcccgtacatcgtctttctccctcctgggttcccgtggttcctatgccgccgcgtttcccggtccttttcttttagtgcttcgacccgaagcgatagcttgacgcgttttccgtgcataagatggcagcgctccagctcactaaagaatgggacggcagtggtccgccggcaagctcgttctgatcttggacgcagtacattggaatcctgaagcaccaccacgaacgctaccgcgcgtgcgcctgcggtgcggtaaggcaccaccctgttgtgccagcagccaactccggcgtgtcagcttagttatcctcatcaagccacaaccttgatgtctagcttcccaactggtagacggttccctttcccccggagcaatgaagaagggagaagtcagttgattcttccgaagaaccggaagcgaagcgctatgccggggcgaggggacgggaaaagaaactgctccgaagaaagatattggggttcccaatgcttctccacgcccaacgagatgcgccaacctcgggatgctttactcctaaccccacgacggttccgagacggagcttaacctgagtctcggttaagaacggcgatgatctacgtttcacacggcgcacgattccatggatagtttcattcgagatcgtgatggaggacatagcttacgatcatcggctttgatcatgccactaggcatttgattaggacattgcacaatgatccgtacactttgtcgcatctcttcgatacggatacagtaacgatcatagcgatctcctctggtacctactggtacgtcaagatccgattggtcatgaacatcgtaaggtgctgctcttcgcgaatcccagcataccccaggttgggatgggtaggcccaccacttcactttttcactttcacttaggcccgggccaagtcagtggggggaccctatcgggctccttcccccccaaaacaaactgtacgtgggagtttcccttcatacggctcgaatcattctcagatgccacgagaggcatctttccttatgatctggtggttcacacgcgcgcaaacgagcaccggccgcaacagcaaggaactatgaccaatagagtcagacacagagcgtcatacttctttatcttgtaatggttgaggagtttctttctcagagggtgcgggacgcttgcggagtccgtgccttccgtaccaccacaggtcgttcttgggcagatcccgctcctaaacataagggagggatagggggaaaggggccgggcctatcatataaatagggttgtagaaagaccacgtattttcattcgacgttccggggattcgatcgacgaatttggcgagctgatctgctttgatccaggagaaagcccagtcagccaccttttcggtgcaggtcacgtgacctacagctcggctttcgctttttgagacttcctctacccacatctctatgtgcccgcagcactttcatatggggaaagatgggcttaccatgttccatcaatagcacctaacctatgccgattttggcggaccgtgctccaccccggtgaactcatgcggttccgacgtgcccagaggccagaggcgaatccgttcacggtccgtaggaccaacaccattcgaaggttgatggcccgccccgcctagaataggaatctttgactgggcttacgcacattcgctcacttacgctgtcccccctaagctcaccccagccccgggtacgttgtctccaaggcttcacacaaaatcttcagtgacaaaatagcatcat

SEQ ID NO: 78448 - DNA, 3546 bp, Oryza sativa
agtatagaagagaccgaagcttggcatagtacacttgctcgaagacgattcatcccatgaagacgtgtcgcagatgggcgcttgattgggtgatcaggccaaccacgcacagtacgacactggagtgagagatgccgcgtagaccgtagtcgatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagcacagtaaccagcccatagtgctccatggtctatagaccaagtccatgtcctgtcgaaacccagtcagccgaccccatatggccatatcagccttagggcatctccaatgtttatgatcatgagtagcattaaggtgtgtctcactatttttatggttattaccacaatgtttgaagcaagagtaaactttaagatgggtcccacaatgtactattctagtacttcttttatcagccatgcaaatttttcatcatcacattcattttaccctattattttattgcttggggtcaagccataagcttaaagctttcttttgcatttaatgccttatggctttgtttcacaatgtttatggtcactataaaatcttatggcctcttcttatggccacatggtggctgcccttatcctcccacgacttactccatgtctccatccatgtgtgaacactgaacaccgtggctgctggcggcttggcgcagcacgtcagcaacggcgggaggcggtggaggccatgggcgctcgtcgtcgtggagccgttcttcagatccggacaggggcggctgaggcgtgtggagaggcagttgttccccagcggcgacgtgggagagacggccggcggggaggtcgtgaggcgggatctggctggaggagggagccacggtggcggaggcggcgctccctcccctccctcccagatctggccggaggggggagggcggcggcagcggtggtcccagcgatggcggcgcgcgttgtctactgttgctcgggcgcacgcgctgcgtcaagctcgtgccgccaccacatcgcgtctgtcagtccaaggtgcatctcgcctcatgttcatgccggtaccggagttctcatgtttcatgttgcaatgcaattttattggggtggattggagttctctcatggatccctctgctgattttatttgggtggattagagtccaatttgacaattcaaagttctctttatcatattcgcgtacgaattggaaatttggaaacgggctagctgccgaacgacttggttttttttttttggaacagacggtatatgcgattttttttttaatttaggcctatgggcttaatctcaaactggagtaggaatcggtgtgggtttcttttttgcgtgacaattgggcgcgctttttttatgcgatctaaccaaatctgatccgaaacaaatttttttgctatatatttgttgacaaattttatcccaaaaaattgacagatgtaattacagtacaatcgtagtttaattacactgtaacttgcatgtaattacactgcagttatcgtagtgttattacactgtaacttgcatgtaattacgctgcagttatcgtagtgttattacactgtaacttgcatgtaattacactgtaactacagtgtaacttgtatgtaactttcaaaaatctttctgtaatattttatttcggtaaaatggaggctgtgggaacaaatccttacacatatgtgtgtgctgtgattttttatttaacgattcaaaattacgtgaaacttatatacaagttatacggtagttacatgcaagttacagcgtaattacatataagttacactgtaattacatataagttacagtataattacactacgattgtactataattacacctatcaaatttttagaagaaaatttgtcgacaaatgtataggtggtcccgatccgaaatcggatgcggtggaaaaaatagcgccagattagaaatcggaaaaacgcggtgatggacgaaaaaatgcggatcagaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccgctcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttatgtggcaacaggcggcctgtcgcacgcctcaccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaagcatgtttcttttcttaggcagagagaggcccatgtggtgatccctaaccagataaaaaaaggaggctcaggcctaaggagagaaaaaagggggggaggtgagaggctggcgacttgatcggagagcctgaactctctctcgctctcgagctctctggctctggagctctcggttttccttcacacacagatccaccagaacacaggagtagggtattacgcttctcagcggcccgaacctgtctacgtggcccgtgtcttgtgcgctttttctcgctgacattcctcatatcgagggcgaagaacctcacttagcgcccccggccgaaccggcaaaggggggcctgcgcggtctcccggtgaggagccccacgctccgtcaatc

SEQ ID NO: 78449 - DNA, 507 bp, Oryza sativa
taatattcatatgaatatagatataaatatgaagcacatatatggatctatacataaatctattaaaaacccaagacgtcctataatgtgaaacaatggaactagtctctatggttgatttgcattgacgtttttttaccaacatagactcggctaaagatttatagttttaattgagtcaccgaacgttccaacttgaaaacctctcaacccagatgagttcacaaaagatcaaaattggctaggagagccaatttagagattaaaccagtctaaaagctgatttagatcaatacggaaataatgacccatctcgtgggtgaatcgaaaggtttacgggacaaagctacgaaggatatcacactctcacaacaaagacgggtggtttacgatggaaatgttccaagttggatggaactaaggtaaattagaaaatatggtgaaaaggtaaaggtataaaatgattcgattgtgtaggtgtcaaggtcggggctatgatatattaaa

SEQ ID NO: 78450 - DNA, 9482 bp, Oryza sativa
  unsure (1)..(9482): unsure at all n locations
cattaaaacacactcttncantgtctattaacgtcgtntttaattatattaaanataanttnnccctctttcactttnggccgctttnatanaaaggngcncncatttannagcctgtctaaccaatcctcccccccccncncccccatgttttgtagacctctcntnnncncncgnnnnnnnngnctncatgtcgcacgacctcttaacattacaccactgaatccccaatcctttgcttgctgtgcagtgacagtaccaatatccactaatcgttgtttccagatacggttgccggttgacatctcttctaattcgtcgatacgagaagcaaattgttgtgtggaggaatcaatatctcgacataagccaagaggcagatcttgtgccactccaccaggtcgtatgaaactggcatgcatcctggctcccgggactctttcatagaattccaacaatttctcccgctcctcaaaagcccaaaggaacggagttgatgctcccacatccatagcatgagtagttgaagcaagtgaatgatttgaaattcgagttatttcacagaataacactcgtatatattgagctcgtaatggtacctcacaattcaaaagtctctctacggctgaagaatgagcgtgttcttgggccatcgtagaaacatagatagggtcaactacggaacgaacaacgaaactttacgacagctttttcgtacacgttcacttgcatcacatacacaagtgctctctgaaccgtgcaataaggtcacccataacacggctctcccactggagttaccttagccccgggccatgctattccatgatattggaaaaatggcagcctaactacttattatcatcgtctttaaagctgggcgccttttgaatatgagtggggctcctagtctaggcggcgccttcgtggagccaaaccgaaggaagagcaaaagggcgaggccacacccggcttcgaataggagggggcttagctctggatcccgcctgcttgcagaaatgaatggatcagaaaggggttctatttccgggccgggcaggaggtgaaggccagaagaagaagagaagtgcgccttcccggtaaggaagaggataaaaaggtgctgtcatctatctcgacctgtttcccgaggcgttggaaatgaagaccggctcggagaatcactggcgtgctttctcccccccatcgtttcgccaacaaagaagtcatccttgacttgacgattgaccattccatccctaccgagccgcctcttcgaagtatttacctctgcctttctttttttagaacatacccttcaaatcaaaaagcaaaaatcaagaaaagttcctcgtctgtgatttaatcggccctaagggagtttactcgacccattctccagtctcccgcactgctcaagtgtgcgactccgtatgaggacctccttcccttttgctctacccactctccattcacacggttatcaaagcggaggaagggtgggcagcaggtaccacgagccctctgtcccacacatctatcaagaagcaagtgtagttcaccggttccaccgaatgctcctatctctcggcaaagatcgtgtgagtgtgcagttatgcttcggatgcttcgccatggaatagatcgactcagttccccttcttttccggtgcactcgctttgtatctccgacacacaaggaaggacgcggtgggaagaaagctgccctagcctctgtccggtcgatcattccgctggcatcttgcattcacgcctccgtttgactgccgctcgggaatgtagttgtagatacgtgagtcttagtgggtcgttggctccacctcttatctccttctacgacatgctgtagtcgtcgccatattcaatatgtcacttagtcatatctgccttgcagcgggtcagcacctccgaaagaaagggagggaggacttcattcagtgactccgcgatcgccctctgaacgatcaaaataaggtaaagcttgaagataagttttgtactcgattaatttctcagtccctctagtcgggtgggcgccggccggccggatccccctgaaaaccgtacgtgcgggtctccccgcatgcggctcacgccatttgaggtggcccagcctagcattcattcgcaaatcctgtagtgaaattgagactgctcgacctcggaagctaattcgcgtgtaggtggcgctgtctgtctaccgttgactgtatctattcattgatacattggctcacccccccccctctttttccaagaatgaatgagccgctcggaccttccatttccgtcaaatgacccggcttcccctggctcttccaccgtccgggctccctttcctccctatgctcccccggcgcaggcccaccacgcttcgcgcctgcggcgttttcgccagacggtctttgccagtagtgccatcctccccgcaggctgtctgtatgggtgggttgtcccttgctgctacgttctgttaggcgctatgaattacaggaaattaagtggttgacttggacagcaggcgggttacacgttccactgtgccgagatgtgaggtgcaggtggtgatgatcaccccggggtatgcgctagcgcccttgacgggcactccaggatccgcctacgctcgtgaaaacccaggttggtcctccgaccagatgtgtggataacgaggccaccttcacaaccttctcccttctatctttatccaaagtcaggtagggcggttcgcttgagtcgctcaaccgtccctttgcccggtgctcatgacgcgctacggaacctccaccgtgctagcggcataggagcctactcagcgtcagcggcttcgtgccgcactggagtgatccaatatgtggttccgcacgttccaccacttctccgttcatttccaatactgatcgtgaaacaccatgagcagcaggatgttgaggtccggaattcgaagtgaaattcttgatttgcccgttcctagtcgtcatgggaaagaaataagaaagaaataagaaagagattattcccctagagcttgtccagtaccaccagtactcaaaatgcatctccgcgcgtctacctggcgcttttattagccgccttgcatgcaagcgaagcgctattggcggcaattaatagctcactgagcgatgattgatgcagtcagtcagtgccctcgattattcctgatagaaggatcatggcgccccggaacggaagcattccatccagcagcagcatctccttcaaccacgcgaggacaaaactgatgttagctacattcgagcgttcaccgcacagaggcgatctcgaacactacctatgataataaatccaaaggaaaggaacaagcaacggattgagcgcactagcgcgaaagaacaagctgcttcttgtttagggtcttgactcttgagtctgagagggagaaggcttcccgcgtgggcggattagcaatccctagtcttccataacgcgtattggacttatgtttcctcctcctcgaagatgatggatctatctggtccggttacgaccattctttatggctctgtaccaatagtacagattcgatttaggctctttaaagaatcacccaactggtttttttgctttttagcagtaatcagaaagttagctctttttccagaccagtggccttggagttcatccccgtcctctgccaggtgagaaggaagatgagagatacgttccttagaagtcgtcttcaactttcttccaggaaagcctttcaccgagcgagcagctaagcgagttcatccgcatctgttgtcgttcaagtagttcaaggttattctagtgcgtacggctgggacttctcttaaaaccaccaatccaaaagatctgtcgaccatctatgactgggaaggaagtcactaacctgagaaccgagaaaactatgtaaaagatctgctctcttgaaatagaaatcctttacggaaaaatcttctgtagcttccatgctcttgaattcgctcgcattctctcgaagattggaatgaaacaatccgctattggaatagaagctcttcgggaagagtagcgggtgccatcaaaccctgcttgtgacatagacttgcttcttttctggtcaatcaagatctccgcccgcccaggaaatgtttctcatacagaagttccttgccttcgctgttgggaacacagcttgctttctttatctttctcaataagaatggctaccacctcctgctggatcttcaccttctggagttctttcaggaacaggatatgtaactaatgaagcaagtccggctctatcaatctagagctactagtttcacaactgctattggtggtcaactagtggtggatgctttagctaacatactggaaacagctaaatcaaatggggtgattcatgggcttgtgccacacctagtgcctgtttccttacctgctctgattctccttggccccgctccgggttgatgacagctacaaccatcctccctgttttttctaaccagctcactatccgaattccgttgcttgttctttcgaatgggagttgactttccttttcttcttaactcctaacaatcatcctagccctagtccatctatctctgaatccgagctcgccttcactcggtcaagggatttacctcgttccgggttgatgaacccaaacctacaacccttgcttttctagatccgggtatctccattttcgtaaccagcttgccttctatctccacccacgaatcgaattaacccgataatccgtagttggcaacccctgtcaatgtatgtttgatttgggaggctaccaattctggaatttcttctcgagacatccccgtcagtcaacttctcttcgggatgggtcgttggtttttgtggagataatgtgtcagccatggtagaagtagctccctgagtaggcatgagcgcccgcctagatgaagggattttctcatcttgaggtgtcgggaggagtaaaggagattgactcttctcagtcattagcctttttattgacactagctctttatatagtaatttattttttgagtatcgtatcggtaggcacagatcattggtattggatatatcgttaggttgtgctgagtcaaatcagctccgctgatttttttccgttgcagaaaagagaccccttaccctttttttagaaaatgatgaatatgaagtccgggaggctgcgggtactatggatcctctgactcccaatcgggttaccttcccgggtctcgccggtgttgcctgtaggtcgtgatgtgcctcgagatggccgtctcctgtctccctgctcgtggggaatccgctcctggggcgtcgctctgctgcgtctggcccgtcctctaggcacctttggggggcagggagtgtgacaacgtacacgcttccctttactccatagggccttttcctcagttgcagggtttggtggcccgaaattgacttggcttcgccaaaaggccccatctccaaagcccggctcgcgaggcgtccctctcgctgtagggcggagccccctcgcctcgctcttgtgacatgctatgtttcccttcttccattctcaagtcaagggtgagtcccatgcgtcagtttgtggatcgcggtctcacgcactaatctctacaggtgcccatagtaggccggccgccctacctaaaccaatcatcatatcggtccctaggccccattgctggaaaggctcggcttcaaaaccgtacgtggagcttccgcctcatacggctcctctagggatgggggtaggcccagcccaggcttgtgcggttaaggttgttgtacacgccctcagttgagcattcagttagagacggcgatcgtaggttcgccggaggagagggtgttgcgagcaagattgcacaaacaaagccctcctgcccgcagccctattctagaaatttggctggctacgttacttataaccgcagaacgagcaatgaatccccaacgacaaacgaacaaggggcggggcattttcggggagtagcccccttcagaagaaacttcctggcacatacattaagggagccatcgaaaggtgactgaaacacctgaaacggggactacccgagctaatgatagaggcaagaacactttccggccaagtcccattaattgatcataacgatatcgtggaaatgctgcacggacccatatatatagaaacagaaaaagaagaaccttgatactaaaccagatcgaacaagggatcttcttggaaatgggaagatctaggataggcggccaacctcctggaaagagcgatgtgcatagaccgggtgagtagggatgcagctccgtggaccgctcgtcgggcctgataggtggtggtatcacacccttctcaaaggaaccgtacgtgagactctcgcctcatacggctccgtcctggaatctgggcccccccctttcctttgaccaacgggtcctcgaacccatgggggttatgaatcattcattcattgattgattcaaggtagctttagccattgtgggtagaagctagtcgccagaagcgaagcgatcttccgggccggaaaggaggcctttttttgacgcgtaagctaccgcaaaatgaatgaaggaaaaaggcctcaggattagaaagactaaagaggcatggagggccgactacaagactacgactacaatacaagccatgagcgatagcgaagcctgaaggctttttttcgaaagccccacaactagctatcttatagcagacaactaaggcaagcctactcaactaatctcatgtaaacgcctgttcgcaaaaatccaaatagaaaaagacaactacttattaaacatgtagttgagtgctccgtcgttgttcggatcttgaccgagcccaagcttcccaagctctatgctgtttgggaactccgcaagggtcttaccaccttcttgattgactatatttgagtctttggggtactttgggattatattccgcgccgaagatttgtgcttgtgggctagggtgaatatagcggaccagcggatctagtagttgacaatcgttcggacttggtaaaggttgtcgcagcacctgtagtaggacagaggacttatcgcgatgcccgcggaccaatttactatgtctctgtcgctgacgttggtcaaagaggccacgtggattggcctgggtcttcttcggctaatgagacctcgatcccgaagccttcggagtatctttttgataggcgcctctatctgtatggggaattcgctgctgaaagatcccgcccagtgcccccttccttcccccgccgccttccgaccaaagggagtatacaattttgtcttcaggacactcatgcccgatcgtgagactgcctgttgaacgcctgatggcaccttgctctgacctgagctatgcaacaacgggatcccccttgatctttgccggatgtgcttgacggtcccccataatacgctaacttggggactttttagtccattttttccaagagtctccgctagttgaaccgcgtccagtagacgacctcttccgctcatccccttcgtcagctctttgatagggatactataacctaggtccctaaacttggaatggatggcggagcgtaggtggcaggcagttatatggatacggtgctttacccgtagacgcttctccagctctcgcaagaattgtatgggagtcgtcctcggggggacttcccgaatgaccgtaccgaggaattctaccgtactccgtgcagctatggttgttgattctgcggagcccacccaaaggttcaggccggattgtaggaagtgggtgatacgtttttgtatttctatgagaagaaatacggcacccacgattcccagtagtaagtcgtcggcatatcgcgcgtaacaaatccttattaataaggaatggcttttaaagggggccagcttacgggccaggcctctctctgacctgataactagtatcgcctccccgcccagctctatcagcaggccccttcttttgcaatacttaagaaggtctctcatggccaaattcttattaaagccttctctaccattgaattcggccctcggggtcaacccagcggcttctatgaggaaggcggcgcaaaggaggctcgagggcttgttaaggaaggcggctagggccgctgaaggggggaaaacaaaaggcgttttctggtctccccttcgcctgggggtgcttgtggggggggtgtgccacgacgaaacaagggaatgaaaggttgctttgcgttggatgctctttaccctccccactatgagggctctgttgtcttggggagcgttgaagcctgcttcttttccatacttttcttggtcatcaatacgacgacctattcttaatagaaccgatctgattttctgtcacgtcctgataaattcatcccaaaattaaaattcattcgctaaaaggaataatagaattaattaaaattcgaaaagaaattggcaaacactaaaatacgtacaagaaaaattccaatgtggcccggagaatttttgttaaattctccttggtctaaaatgagccctcaaattttacttgaattttcagagcaccggaaatatttattaaacaacaacaacaattaacaaagtttattaaaaagaaaatctaaaaataatcctccttttcctttgggccaagtttggcccaaagtctcccctctctctctttcggcccgcggccgaagtctccctctcctccctctctttccctcctctcccgggcctcccctaacccttcccggctactaactcaccgctcctcctctttccccaaactgacttctcctcctcccccgtacctgtttctaatctgaccgtctcaccctccttcctgtcattctctcgcccacccgccctctcctctcttctaaccctctccctcccctcttggtgcttccccctaatagctcggtgagccccatcttccttcctgttcttttaccttaccgtttcctccccccccctcaaaccacataaccttccccccctctaaagtccggtttccctcaccctgtgaacatccctcatacccctcatcgcngtatctcctctcttcaactactcccccctccactgccggacatacctcctccctttcataagcgcatcacgaatctctagtggagtggtgcccctgtaaatcaatcattacacacccatctccggagggccataccatctcccgtgacatactctccgtatcactctntggcgctgaactaataattcgtcttccctagtgacatgaacttctcacgcacgctagctatcatcatctagattcttgcgctcncggtgactccaaatcgtatgactcttcttcgccacaacatcgatcctgtctatccactgctcacgcatgtcttatgtctcaccttatcacatgantcgttaggttccacctctcccactcc

SEQ ID NO: 78451 - DNA, 2386 bp, Oryza sativa
ggcctaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattaaatcttctcttctaggctttttaaaataaattctaataattcaaattaaacaacaatttatatatttagaatttttagggtgtgacaatcatctattcgagcgacattttaacatatattgaatgttcacgcctagctagccttccatatccacgtggtttggtggtcacttcttctgcacgatcaagcatacacacacaagaaacaattacaaataagcctacaagaaaaatactggagaaataaacggtaaaaataattaaatggtgaggattggagccagaagggaagaaaaagatagactagatgttttatggattcggatagcaaaagataactatacatgagggtttaattgcggcgtatgcaaggacaggcatgacatagcggtttgtgtactctataatagcacagtgaaaaccggaacaaaattaaaatgtttacaagtagctgaactggaggccaacacaggaacccccatatagcaagagatgcttccacagccagtcttccaagaatccctcggccctggccccggacgccctggaccgccgtcgcctgcttcgactcttctacgtcatcctggttctatatatgcgttaattaatcacatagaagaccctgcaggttctatgcgttaatcacagttcaccaggtcattcaattccttatgagaaaactgatagcctaatgcaatggtgcattcgtacttaaattggtgttggtattagcagaggcaactaatcagctggtctagactctagacgatccaaattatacatgttgtctgaagaactttggctgcagaggcctgataccagctgttccttttgttagactgaatgatcagacgctacagtcacttgtgatgctgcttttggatatatattgctttatcttgaggatctaaacccttctacaagcaggccggtattcttgctacaataaatattctgcttttcttattttcaaatttccctttgtttcagttttatgaatctgttaagcagagagagattctcaaaccactggttccaatgatgcttggcagaacaaccataggtgaaaagacattttgatctaaatacagtagctctacttgctgaatgactaattgggatctaatgagaatccgtttgttttagtcactctctgaatatcaaatgttatatattcatgtatgtttagtacttgttcaggtattctggacatggctggatttttttggtttctgaaaacctcatcctcctcacctttaagatgtacttcctccgttttaggttataagactttctagcattgctcatattcatatatatgttaatgaatctagatatatatatgtatcaagattcattaacatatatatgaatataggcaatgctgaggtaggtaacaaaagtcttataacctaaaacggtggtagtactaaggaaataagatcagtcataaaatactgagtactttctctgaagcatcgacactttaactgttaaaactacatgcttatgttcaatgcgatttaggaaatgaattcctgacttatttgaaggattggtgatatttgacacttgatgttctcaatgtacactgaaatctgctgctagaattaaaaaaaaatcatctgcccacgacaggatttgacaattacctggcaccttaattgtgagttgtccgttttgtaaaaataaaactgctccctttcttagtttgtcctctgctttcatggttttactacttatgaattgtgataatttctgtatatgttcccagttacagtattaattgataatcctgctaattcgatatttgtttttccttacactggtggagaagtggtttttactcctatatagtcctggtttttcaaccgggactacgaatccgggactaaagatcgctatctttagtcccgggtgaaataaccgggagtaaaaatcgatttttagtcccggttataaagagacagatccggttgcttctttattcttttcttctcttcataatttttcattatttttaatatattgatttcaccctaaccctatcccatccctaaattcccaaaacaatcatcctcaaattgccttcaaatccacaaatcgatcatctcaaatacatcacaaaatctaaaaaaaattacatcacaacttctacaaaattcaatcacatattcacatctcacacaaatca

SEQ ID NO: 78452 - DNA, 2506 bp, Oryza sativa
acggtggtacccatatgtattaggcctggtacaattggtatcaagagatggtagataccaaaccttgttcttgctagatataaatcatgataccaacatgataccacctagtttaatggaagataccttctgacatagtaagatatcttggtgataccttgaggtttcatctcacgatatcttctcggtagcatgaaaatacgcgggtactaaatctgataactatgggtattagcaatgtctggtgcctataaagtttgatacctatgagtaacatgtatgatacccggtacaaggttcaatacctacgagtattgcactaggtatgtatctggtttggtacctgatatcttggtaccttgatgtgtttctatgaaacctcgaagtatcatggtaccactatatagtatacaaccgagatgtcaaatatacaatataaaactgaggttcataggtggtactaatatgcaggtgtcacttagattgcatggtagtattatatatgaagttatatctacaattttactacgtctaaagaagtagtagtactagtgtattgcttttttctaattgcttccagtggcctactgtagtcaatacttagactgctagcagctaaccggcacccatgcatggtgtagttagcaacaagaggtgcacaaactaaggccataaatccatggcatgttatgtggggcacggctggctcatccctttccatgcataggacatgtgggagcacgttatactttctagaggacgagtgggcccacaagtagatgacggtaatacccacatggtcagatggacatgtgccatgtgaatgagctacctgctggcgacttaatgtttcgctcataacttgtaccgttcctacgacaggatgttgccccctagttttcctctttatatacagagcctaaatcatgggtggttcactaaacgcctatacaagtcggtcatcacccgcctcttgaaacactttcagtactagcatttctgaccttttatgttgtttaatatgtctatgtttttttatatagcatgcgttgatatagtcttctctgccagtgatattctgttttttttaagtatggtagcataacatttttttaattcttacctcttcaatttttatataccccctaatatcaattgtattaatgcatcgttagcatgtccattttagtccttttttggatttatatattcaatagcatgccattttgtttcaacttatttctcctgtcaaattctgctgttttgttctctcctctgtgtgaaaaaagacacaccattatgcaccattgtgaaaatatgccacattacatgttaaacataccaataagtgtttacatccttttttaacgaactgtttgcatcttttgataattctgtaactaagatccctttagtctctcaagcacaatgtagaaaattaaagtgcctttctatgagcacaattaccaatatatgatgctcttaagatcgacattgcgctttactactatacaaaaccggatcacaaccggctaaagaaaaaaccgatgacgggcttccgaggctatcaccaccggttgccaaaccagcagtacacactacctaatatgaatatcactgtcggttcacccgggaggacaaatataaccaacacgacaaggctgcatggctgccatagctcgaacatatgatattgttaacagtgaaatttagtaatcccttaagagaattatcacatcgccaatagtcagattctttggacctgcactagagttaagcggatctctcaggccagtgtatgttttttcatcaacagatatttatgaaatatcagacgctggtcctctgcctgctgccttctgcatgctgaaaaaaaatactgattccctcccctgacagctgcaccttgcttctgcatgcgatatgcgttgatctaatagcgctgcatgcaagccctctctctttcttaaatacaaaaatattttaaagaaaacattaaactattttttcttctctacgatttgattttaccattatatttattacaattaaatctatacaacatgttctttctttcttatatttaaaataaagtactccctctatcccagtttagagggcgtgaaatatttttttgctaataccaaggaatagatgcatgcaagaagtttgttctattaaactgtagttaatcgtattcatgagtatttaatcacattgtttgaagcaaaactgacggtctgactacctcgccacccaacgaaattgcatgtataccccgttccccgtgcaaccgcccatgcagatgaagcaatttatgcatgcatgcaacaattagttgggttgatgggctagaattaaagatgcgccctgtgttatcagacaacggtgaaaaaaattacaccctctaaactgggacagagggagtatataaataagattatattccttgttgaaacaatgtttatattatacatgaaataacgagttgtaattcttgaaacat

SEQ ID NO: 78453 - DNA, 670 bp, Oryza sativa
tctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcttgaatcggcgcggcagcccggcctgcctctcgctcacgatgcgggaaagcggcagcacgctaccctcgagcggtgcggagccccgtgccatgacgccggcggaggaggagcttgagagcgagcgagtatggcaaggttagggcgcaggaaacggagagtcagagcacaagtggcgaaggcaagggggagagtggcgagaggaaggaaacaaatcccttccttggcgtctttgtacccttgccaacgctatgcccggctcctcgcttcccgcacccactacctcgccccctcgtttctcgcgcccgcgcctccactaaccccactcgcccgtttgcggcgcacgcgatagatgtgcggccgtggcgtttgagatggggcagatcgtgcgcgcattaaccgcgctcgccaaccgcgaaaaacgccatcatcatgtccccaggcgaaacaaaccggctcgtcccgattcgcgcgctgctcgagtaatgtagcggtcttgaagaggccg

SEQ ID NO: 78454 - DNA, 4138 bp, Oryza sativa
ctgcagcccacagaaaaaagaccatgggatagacattatcactatctctttcccactgaccatacgagtgacctctgctttagggctatgtgcatcaaatgatgcaaacattaagtaatttgattctagcatcttaaaaataacataatcgtgtggtcttcttttctgcaggctacccaatcaatttcgaatttgactttggccctgtaatagaattcctaaacatgcgcctaaataatgctggtgacccttttatggagtgcaactatggtatccattcaaaaaagtttgaaattgcagtgttagattggttcgctcggttgtgggaactccccaaagaccaatactggggctatgtcactagcggtggaacggaagggaacatgcacggacttcttgttgggttagttcttaattatttcatgtacatatattttaatatattttaatgcttgtaattttatgaatgttttacgaacaaatccctttggacttgaattttttggataattatctccaaaagatttcaacgaaaacaaaaacaggtcattgttttgtaaaatttcaggcataacattttatttgattcccaacttatgatggtgtgtactctaaaagaaatgcatgactttttttgttttgtggggaaaaagaaatgcatgacttcaatacaaagttaacaatgcagtccaaaactcaaaagttacgatttaatttatagtattacaatgaaactgattggagcaatgcatgctatatcatatatacttgcagccacaaaaaaaaagtattacacagggctggcttggaacctaccaccagatcgacatagttccatcaccctcaacttcctttttgaaagaggaaacataaattaacactgaaaagtttggtaacttctgatagctgtaaaataaccgtaaactcttctagcaattatagaagggtaagattgcaatataaatgtttgacctactgtaccttttgtaattattggctctccagtgttgaggaacggaaaggacaaaaaaaaaaataaacgaaaatgctgccgctcggtcgctcgggggagggggagaaaatcgggcgctcccccctccacaacgtgtcgacgtgcttctactggggccccaccatgtgtccctactacttgccacatatcttcaccatatactctattacaacaaaaaaaaatcacatattttagaaaccccctattaagggaattcggtttattttttgtttcacaaaaaatgtttcacccagtgtactcacgatatttcactatgtataaatctaatgttgccgtgaactgaaatactccattgcaaccaaaaaacccacatattttggaaaccccctattaagggaattcgttttattttttgttccaccgaaaaatgtttcacctagtgtacttataatgtttcactatgtatggatcaaatgttgcagtgaactgaaacattgtttcgctatttgctgaaacattgtttttatataaggtgaaacaacacccgatttaaacgagtgaaacattttcgatctacttagtgaaacaattccgatatacccggtggaacattgtgcaacattttaaaataattcaataataagctaaaaaaaattttcgtcggaatatatccatgtgtggtcttgttttgaagatttaattgcaacgaatttaatggtgcaatcggatcatgatttggataagtaatttaagtaaaaaatcagtttaaagtagtttctgcccgtaaatcaggcgctgacgtccctatgccgccagcgcccgatttttcctccaaagcatcgggcgcccgacgcatagggccttccaaaaataaatactagaaagtatgcacctcgtcgaggagtggaaaatcatttcctatcatatttctagatgggtagcctgtaaattacataattaactagattatttgttgccctctttataattacattggctacacttgtacaggagagaactttttccggaggggattatctatacatcatgtgattcacattattctattttcaaggctgctaaaatgtatagagtccagtgcatcaaaattgacactttgttttctggtgagatggattatgctgatttcagacgaaaactactacagaacactaggagccctgccattgtgaatgtcaatattggtacttactccatctccagatgtaaccatttcatcaattgtactccactatttttctctgtttgcatgtgacagatcatgtttgctgtgttgttttaggtactactatgaaaggcgcagttgatgatcttgatgaggttgtaatgattcttgaaaactgtggttttgcaaacagattttatatccattgtgacagtgctctagtaggccttatgatgccatttatcaaacaagtaagttttatttttcaaatagtgaggtaatgcatatggaatatttagcaccagctgattggtttgaaacatttgcatttggaaattctcctaaacagtctagcatttgaacaatagtagattgtatttcttttgcactgtcgaaagcaaacgatctgaatataggttgaagaaatagcacaggcaattcatatatatggattgaacttgcttgatctttttctttaatttccatacataaataatttgtagtaaaaaagaaaatagaccagcataaataaatatgtcatgtcatatagaatgattttggttactttttggatggacaagattgcattaagagtcgtgcgtgaacagtaaccttgttgtttcctctttcttcttctcctcgtctttcccacgtgaatgtgaccgcatagagaagaccgagcttgttcggcgagcgtcctcctgtaacaccatataggtatatatatccgcatattagagtgccacacacaaaagcactaactcctaaaattattaaaaatttgacatattctaactaataaatacaaacattcatgatagacagttacaagacaattcaataatgataacgtccacaaattcgaaaccaccagtagctttaaaaaaaccataaaactacacataaccaaacctttaaaacaacatttacaagttctatacaaaatttattctaagcagaactaagaactaaagctaaagttgagtagtgtgcagtaaagtgtgtatactagggccatgtagatccattgttattttgtacctaaaaactaagtagaacacaatagtaagtacaaatactcaggaggtgcaatatggaactaggaaaaatgtatatatatgaatttgcattaagtagtcaacaagtagttgttctcctccagggcaaatgtgaatatctttaagcattacctgtacggtgagtaagcagggcaaacgcttaattactactagcatcgtcaattaagaaccatatgatacattcggtatgtatgcatggtattttaatggaacagcataataagttgatacatgaattatagcataaaaagatcaaagaattaatgaatcacatgaataataatggcacaatgaaagtaaggcaaattatgcctatatcattcccaaatactgaaaatgaattgctatctagttttggacccggtcaggaatattgtttccatttttgtgtaacaccccagccactaatttcgccttagtctactctacacactaaatgagcccacattcatatagcaacttacttacacttttgtcctccttcatgtaaaaggttaacccaaaggtaatttggttagagtaacctgggtatataagctggctcaaatctatcaagattctcgtaaattgagcacttgggcctaacagggctaaactggaacaacaaaacacatgccaaaacaaacgaaacgagctggggtattataatttcttctaacctatttattgaaattgagtgaattaaccctattaattagaaagataacaacgatgactacaacctttaatttatttaggacacctaaccttaatactacctccgtccgataatataagggatattcactaatttctttgtgattttgttctctctggtcgctcaagtagcaacagcagcagaacatgcattagccgcagcaaaggcaagcaggtctgcactctggagcagatcttaattat

SEQ ID NO: 78455 - DNA, 2177 bp, Oryza sativa
ctgccttttgcctctcaaggcacttctctttgcgctctgttttccctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcagggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagcaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggaataaaattattaacgagataaaaaaaatgatgtagcttgatttataaaaaatacagatttaaatttcattcataataaataaagataaaaagttatatacatatttaacaaaatttacctgtatagctagagaaattatattgcaactatgtaattacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccgcccgcaccccctactgctctcccctcccctggagatcggcgtcccactcactcccatcccccacctcatcggtggattggattggataccagtaggggggcgatcgctcatcgctgcttgtgtgcatttcttctggtagga

SEQ ID NO: 78456 - DNA, 1740 bp, Oryza sativa
  unsure (1)..(1740): unsure at all n locations
gccgccggccgccattcccgtcgacgttcccgctcctcccgtggccggctcccttccccatcctataaaatgggatcctcatcccccgttctctcgttttagccccatcccgagcctccccgtggtccctagctccctccccaccgtcgccctctctctcccacgttgccggccggtctccagccgcctctcccgcctcgccggagcgtcttccggccgcgccgtcgcctcctccagcatcgcagctgccccctctccctcggcctaccctccgtttcgcgcggtgaccgccggaggcgcgttcccgccgtcgccctcctctttccttcgcgccggccgcctccagccgcctctatctccctgcctgagcgccggtcgacgtcgccaccaccttcctcggctccacgacgccgctctcatccccggcatcacctcctcctcgcccgaacttcgccggaacgccgtcgtctccgcgccggcctctccttcctcctcgtcggctcgtcgccccgctgcaccaccaccttcaccaacgtcgtagcggcgtgttccacgctgtcccctcctcctctcagccgctgctgcctgccttcatcgtcatctccgaccgttctcgtcgtcgacgtcccgtcggtcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgccctcgtcctctcgtcgttcccgatcgtcgtggcgttcgtccctccgtcaagccgttctcgtccgtcgtccgcgttcgtcaagcgagtcgctgcagccccgtcctcgtgttcgtcctcggctccgcgtcgtcaagcctcgtgccggccgcagctcgctttcgtccaaggatcgccgccgaagccgtcccctcgccgttcgtctccgttgtgcccgtctgtctccgccgcgcccgttcgtcgttgtcgctcccacgcctcgtcgcgtggtggtaaggttccctctccctcgctgccctgtcctcgtcctttcggtgtcgcccgtgccattgtgcggttgtcggccccggtacccgtgtatcggcgtcggcagacgttcgcttgtgcgcgtggtgaccgtgttagtgtgcccgctcggtagccgcgtggtttccacgtgtgcaggccgtgtggtgtctagtggagtccgtttgttggccactcgcctcggttgacacacggggtccgcttccgtcgacccgtggaccgtctctgtgtatccggtctaccgcggtcctttaggttgacatgtggggtccgcatgtcaacggcgcagccttcctgtcttttccaggctagcgcttacacatgttttataaatgcaaagcttaattataaaaacaggtgtaagcgctagcgcttacacctgttttataattgcaaagcttaattataataattcgcaaatctccatataacagcattaaacttcggatgatcataaactggtcatacgagctctgaatcgacccgttcaagtctcgtaatgtttgttataacttnnananncnnnnngngggnnttncagatggttacctctctttgggggnnggaaaaagatacaggatgctaataccaantncagtgttcacaataccaatcgcggattccgagacacaggatttacgtattcnccacgatggaacgtttgggc

SEQ ID NO: 78457 - DNA, 1514 bp, Oryza sativa
ataggtcgggttgccagttcggtccgaatcatcgtaagccttgggttaaggcaggttcgtgagggttcacggccttgtttaataatactgggtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatcttttcccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtccctagttctggtctcttctttccttgtatgcttcctctctcaacccctaccttgtgacagatggataacactggtaacaaaggctatgggaatgatggatccgatgactcaagaacccaaaccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgaaaggaagctagggttgattcagtgcaccgaccaggagcgggtaggcttcgcaactcatcagttggttggaccggcttcagagtggtgggataactacgaagcatcacagcc

SEQ ID NO: 78458 - DNA, 757 bp, Oryza sativa
ccatagaatcctttttccatgcccgtgctttgacctctttctacgcataagttaatgtcgatccaaaggaagccatttagatctgagttcaggaaggaagtgaatttaagcaagagagcgataggatagatataaagcttagaccaataggcatcttaggaaagccggtttttaggaaaaaaagtatattagtatactacctcttggagtttcagttgctatccattctgtttgagtgccatatagcttttcctattcagttctagaactagtggttacagcgaatgagcaatcttgtgtatatccaaggtaaagggcaagagactctgtcaattcatccaatgagtaagcaggacagtgaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtattccacgggtctcaatggaggagaactttcctgttcatcctactgcataggcaagatctcatccttctttgaatctacgggctcaaaagagagctccccactaccggaaattggggtccaaagactatctattcgaccacctggacacggcgaggcgaccccacaagagagatgccgaagaatatgccctcctcaacgggtcaagccctcgctcagaactaaatcatcctgcggcactcactgcatgagctc

SEQ ID NO: 78459 - DNA, 2018 bp, Oryza sativa
agtgtctggaggtgttctcaagtcatggtacgtttatgcgatgttttcacaccccgaagttctcctccgaagccaaaaatttaatttataagcgactcctaagaaaaaaaaaccggtgcaaagcaagagtaaacccttttaaatcaatgcaaataataatcggaagtggcatgtggaatttttcttgagttctacatgtcgaaatccactaacaggattttttagtggaattttcagagccctagaaataattttaaccaattaaaattgagcaagcaatattttaattccaggaaaatccttttctctttttctttttctttttcccttcccttccgaatgggccgccggcccattctctcctttttctccccctcctccctgctgggccggccgcaggccgaggcccagccaggccgccccgcctccctcctctcccggggtcgccgacaggtggggcccacttgtcgggtccttccccaacctcccgccatccgtgccggtcaccacccccgaaaccgcccgccgcgcccacgcctccgcctcctccgggccacgtcgcccacgctcgcgtgtgcgccgcgttccccgcgcccactcccctctctctcccgctcgtgcccgcgcccgagatggccgggattcgattttcgaatcccgcctctctctcctcccccacttccccacgttggccggcgattcccgcctctcccggccacgtccggccctctctctccctatttaagcttccccgtcgctccctctcgctttttccccatttcgccgaactctcccgagctccccatcgctcccgcgccgtgcaaccacccgccgccgccgtttccgctactccggccgccgctagccgccgctagggtcgccgccgcaccgcgctgtcgccgccgtcgggttcgcgaggctaagctccaccccggccgccccttgcccgtcgagtttcgtcgccgggattcgcatcccctcgcgctccggtgagttcaacccctaccgcggccttcggccatgaacgccggtcgctgtggttcatctccctccctctaatctctctcttctccttccttagggcaccccgaatcccgtccgccggtggccgtcgtcctcccgtggctcgcagtcgccgttcgccatgtcttcctccgcgtcggccaccctcggtgaggcatcctctcccttctattcccctccctctccctcttagccgccgctttagcgccgccgcccgttagccgtagctttagcaccaccgcccgtcggcgccgcctttgcgccgccgtctccgccgccggttgccattcccggcaacgtgtgtgcgcgcgccgtcgccgtcgccatggccgcttggccggtcttgagccgagccgggtcgccagcgcccgtccgatcggccccgagggcgatctgggccgtcgatcccgtggaccggcggtggaccacccgcgtggtcccggtccacggtgaaccgcccccccctgagccgctgctgagtgggcccgcttgccggcgccccttcctccctctcccgagccactgactggtggggcccgcttgccggcgccgcgccccgccttgatgacgtcagccctgggatttattgcgcaataaatgatttaaggtttttcttttatagtaataaacacagtgaatcttctaaaattcataactaattcatccgagctccgtttaagcccattcaagtctcaataaatcaagaaaaatgtgtagaatccattaaaaatggttttgttccctgtttcagtagtcttatagcctgtttgcaatgtttgctttgtatgtcgctagattccggttcctccgacgctccggtgtacttcgaaatagtcaccgaggttcctccagcagcagagcaaggcaagtcatgcttgtcacttgaacatgttgatcctatattgcaaatgctctattgtttttcttcaaatattgcattgttttataatgttactatggggtgtttacctattgtcatagccatgctattattg

SEQ ID NO: 78460 - DNA, 1879 bp, Oryza sativa
  unsure (1)..(1879): unsure at all n locations
ttacgtagatcatcgtaccaacgtacctcaataccctctatatccggtctacgggtacccaccgtcgacagtggcgcgccaggtagggggccttggtgctcaaggttctactattatgacatcaagcttcgtcaacaatagcgtcaacaatggagtcaagcaaaaatctactgtatgatcggcaacgatctatacaagaaggcgccaaacgggttacttcacaaatgtgtctcgtccaacgacggcaaacacctcctcctcgacatacacgaaggggtctgtgggtcacatgccgccggtcgtacattggtcagaaaagcctttcgacaaggatttttctagccaactgccctcaaagacgcttgcgacatggtacaacggtgtgaagcttgtcaatttcatagcaaacacacaaagcttccagcgcaagcactgcaaaccatccctctcacttggccgttctcgtgctggggctcaacatacttggtccattcccacgaggacaggccggctacaaattcctgttcgtggcgatcgacaaattcaccaaatggattgaggcaatacccacgggggaaatcaaggccgacaatgccatcaaattcattaaaaggatattttgtagatatggattgcctcaccgcatcataacggataacggctcccagttcattagcgccgatttccaagattactgcatcggactggaagtcaagatctgcttcgcctcggtttctcaccctcagagcaacggacagttcgagaggacaaacggcatagtactacaagggatcaagacccgtgtctacgacaggctcatgtcacatgacaagaagtgggtcgaagaactcccctcggtactctgggccgtgcgcaccacaccgacaacgtccaacaaggagacacccttctttctcgtgtacagctgagaagccatggtcccgaccgagttacgacatcagagtacacgagtacagaagtactccgacgaggatcaggaggaacagcgaaacgacgatgtgaacctactcgaggaacatcgagaacgggttgtcgttagggcagctagctaccaacaggccctccgccggtatcacgagaagcgcatccgagcacgcatactntcgatcggcgactacgtcctctggcgagttcaaagccaagcagggtgaaacaaactctcacccaaatgggaaggaccgtacacgatcacacaagtcttgcggccaggcgcattcaagattgcagacggcgatggtcgcgagttagcaaattcttggaacattgaccaattgcgtaaattctatgtataagtcaatagtatccatacttgtaagacatcttacaacttcaataaagcctgtttcaaggtacagatttcaatcaaagtgtcccttcccgatgattccttacccagatgacacctagcgttgaaacctatcctcatgttcctttacgccgtcctgacaaggcctccgaggaacctaagggaacttcggctgaggacgcccagagctgataatgcctgtcgaatcctttagagacgaaagaccatgtaagatctggtcatgtaagagttctcgccgtgcgtattaaccaagccgtgtaattggaaatggattttccaactttacggctgggggctaggattagtgcttatgcaactaaggcaagtcggtccaagagccttatcttccgagaaaaattctccgacgataaggctgggggctagggagagtgtatgactcaagtgactgatcgaagtcacgaagtgagaagacactcgtacacaccgcatccagagtaagaaaagcttagttagatagatttcctttctacttcacaagtatttcttacagtctgcaaaaaattccgaaat

SEQ ID NO: 78461 - DNA, 1545 bp, Oryza sativa
tccctactttacaattcagcaagtcaacaacccccatcacataagctgataagaacattactaggtcggatatgaccatggataccttatgtattcaacaatcaaaggtgcatactttctacaaacgatttacatgttatatatttaaagaaaggatattgtaccatgagttttgtgtgctttcatttgcagaggtacttacttgggtgaaggaaaagagaccgagcgcaaggaatcttggggcctatgagtacttgttagaagcttatggaatctattacagatggatttggtctcacatcaaaattcatcttagggtatcaggaatctgtaaaacaagccatgtgcctcatctagtccgagtctgatttggcccttgggccttggtacttgtgggctaagcccaagtgggtggtgccctagcgcaaccctaggacgtcccaaatcatatttattcagtagctatcatagtttagggtctgcgttgcagtttcgccacttgttcgatttgtggaacccaaattcaagtacttaatcattcatatgtaattgagttgcaatctaacttgttcttgctagtgtttttcgattcatatgcagagattagccttctcggcaagatcaaccaggtttcagcacggttgataaccaaaggagacgtggtgttgcgattgcagggttcggatcgtgctgattggaagcccaatcgtgtgtgtcaagtttccactaaatctagagttatcaatgcatattggaagatcaggacctagttcctcatgataaacttcactcttctggtagttaattttcatgcctgacatttcttagaaataaaataagaggaatttcaccaccaacacattatcccttgttgccctagtgaatacgatggtatcatcagcatgttgaagatgagtcaagcctcgttccactaaattaggaactatcccttccaacactccatttttacaagcttcctctagtatagcttaaagtgcatcccctactagatcgaaaagaataggtgacagtgggtctccctgcctaagcccactataggttttaaagaaaggtcctgcctctccattgatgttcatccctacgttacccccctcattgatgttcttaggctgagttcggatgggggagatgggaacctaactctgtgcacggaaaacggagcggtccattaacacgtgattaattaagtattagctaatttttttttcaaaaatggattaatttgatttttttaagcaactttcgtatagaaactttttgcaaaaaacacaccgtttagtagtttgaaaagcgtgcgcgcggaaaacgaaggagaggggatgggaaaaggtgcatgcgaacacagccttaatccacttgacaaaagtgtcattaaagttcttcctctgcaacacctcatacaggtaatgtcagattactctgtcataggtcttctcaaaatctattttaaaatttacaccagtcttgtggtctctctaattgatgcataacttcatgcaggatcacaaacgcatccggaatata

SEQ ID NO: 78462 - DNA, 3539 bp, Oryza sativa
  unsure (1)..(3539): unsure at all n locations
tttgctgatttccctttctcttgtcaactacgctatttctcaggagtgcctacaaagcataacgaaagatcatgcgttttgattccatttattctcttgatttgatgacaggaatatatatttccatgatagacttgatctagtaggtggagcagcacaaacctgtgatctttcactggattcagcaggagataagtggaatgtgttgctgtgtttcatatagatatagtagagtggcgggaatagtatagtaagctatcctccactatcaaactagggggctatcccttttaggctttggattcttatcttcctacagcaccaacttcctactactatccctttattctgggactcgagggtcttggatggtaagatcactaacccccagcacccttacccttcggcttgtaggattccactacttgacttgagcttgctttccccactagatcagtctactatacggcatgcagatacaggaactggatactagaatcccgcttttcttttccctttgctgctaacttctttgaccttcttgctctgcctgctttgaattacatcttgcttgggtaacacattttaagttaagtaaattctacatgtcaatggtctgaaagagtgttattgtacctactaaagaaatgaaaggccgattacttctccagataccggattctaggaaacaagcaatacttttccagctccgccgaaaaataattcaaatatatagagataggagataggggaaatcttcccttgcgaatctcttcttttagttgatagagtgaggtccacatatggtgcatttgactcccgtgcatgctattttcgtgttcatgatccatcttagccttcttttggattcccctattggtagttcccactagcagatgtgtgtttctatggcataaatagttcctggacttcccttttctttgcacttacttcgacttcgatctgtccctgggtctcaccacttccttcctcaaggcgtatcaatagtagacctagctcgtagtcacttgcatgcttttgacttctcttctctgtgtgatatcgctatttgattttctccatctgcagaaagatgatacgtgacttccattgtctggctttgattgtgtctgcatctgtattcgctgattctttaatattgtaatcagttcagtgtcagtttaccagagcttctgcttccccctgcggcttgagcataagattcgcctttattatttcggctttggctgccttcatccccctttattattgctgctattgctggaagtcctgtttcattttggctgggagttctctgtcagctagtgggagtcctgctattctcattgtaggcgtagttgcttctttcatccagcccagcacgccatagaatcccttttccatgcccgtgctttgacctctttctacgcctaagttaatgtcgatccaaaggaagccatttagatctgagttcaggaaggaagtgaatttaagcaagagagcgataggatagatataaagcttagaccaataggcatcttaggaaagccggtttttaggaaaaaaagtatattagtatactacctcttggagtttcagttgctatccattctgtttgagtgccatatagcttttcctattcagttctagaactagtggttacagcgaatgagcaatcttgtgtatatccaaggtaaagggcaagagactctgtcaattcatccaatgagtaagcaggacagtgaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtcttccacgggtctcaatggaggagaactttcctgttcatcctactgcataggcaagatctcatccttcggcgaatctaggggctcagaagagtgctccctacgacgggaaattggggtccaaagactatctcttcgacgacgtggacacggggaggcgatccgacaagagagatgcagaagaatatgccctcctcaacgggtcaagccctcgctcagaactaaatcatcctgcggcactcactgcatgagctcatagggcaagatgaagagaaggagaaaggctaaagagatcgtcaacttcaccttggcatgcttccatcagcgctgaaaagacagcattgaacgagaagagaactaaggcaaggctggtgatgtgccactgtacggggagctctgagaaagtagaagtgctttccttcacgctgagcgtgaactctcgatttcgctatacgaggaagattgcttatgacatcaatcagctaagtccgtctgtcgaagaatttctcattgcattcgatgtttagagtaatagtatagagtgtttggtctcgcttttaagttgtatcggctggcaatatgccatagcggctggttcagaatatccccctcgcgaaccttcacccgcggaccaagactccaaccgaagcacagacctgagaatgggtagtcggagaatcagtagcttgtaaatagaatttctgttatgcgatgctcgaattctcaatagggccccctttctgttaaatgaagtgaggcggggtcgtcgaacgaacgacgttagtttacttgcacgcgattttcgttcagagccaaaacattaacagtctagaatatttttttattttttacgttctgttaagtttttattttagattccgtaatgacggaaccttagactttttttttttttaatttgacaccatttgaaaaattgaattaaatttatattaaaatatatttatttggtaaaggggctatttattttaatttaattataattcttaaagttaattattttttatggggcaataggttggaaaaggggcgcctagcctttttgttttttttgataagtgggaagttcttcaaaaagtatttaaaggttgggaggggtttgtaacaaacaatttttggggaggtttgaattctggggaaaaagacctaggactttttcgcaaaaacttttggaatttttcaatgggtgaaaaagaattgtgggcaaatatctattaaagggaggaaatgccccttttggttttataaggaaccgcaatttttttaaaatattaaaaaggggtaaggcctacggataatttgtaagtaaaagggggcaaaccttaaagcctaaaaaaagcttgtgaaaaagaggaatattattcctctaaaaaattattctaaaaattgttgtggcttaaaatccggaaaaatgtccccaccaatattttttctccctccacgcaaaaaaccggccgaaaagaaaatggcgtcctatttaagatctacatggggagagttggccccctcacaaaatttattattggattttttggggcacaattttttgaaaaaaaccncgctctttttctttttggaaaagaaaaacacctcacaaacaaaaaaggggtgtggttgtttatcaacacttactgg

SEQ ID NO: 78463 - DNA, 616 bp, Oryza sativa
gaatgccgcccccaatcgccgggaacggccgcgccaagtccggccgccttccattgccgccggccggcttttccgccgccgttccgacctcccccgtggccggctccctcttctctcatataaaatgggatccccgcactccgttctaccgttttaaccccatcccgagcctccccgtggtctctagccccatccccgccgtcgccctctctctcccacaccgccggcgacctccagccgcctgtgccgcctcgcccgtgcgccggccggccgcgccatcgcctcctccagcgtcgccgccacctcctccacgccggcctgccctccgtttcgcgaggagacccccggaactacgttcccgccgtcgccctcctccttccttcgcgccggccacctccagccgccttcctctcctcgcccgagcgccgcccggccgcgccgtcttctccctcggcctcgcagctgccccctctccctcggtcagccctccgtttcgcggggaaagcaccggagacgcgtcctcgccggcgtccagtggcgtcgccaccacttctccgcctccggccgcctctgccacgtccccggagcgccggccgacgtcgtcaccaccttcctc

SEQ ID NO: 78464 - DNA, 13859 bp, Oryza sativa
  unsure (1)..(13859): unsure at all n locations
aatcatagaaactacactatatatgagttgttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgaaggttttattttaaatccaaatcgaaatgcctaaacttgataaattgacttatttctcacaattcttctgttctgccttctcctagtaagtagctcacgaggaatggggggacagattccctcaatctcgagatacgaacgtatcgtgtcaaaatttattggcaaatttttcttcagtggtttgtggaccgatagaccttaccttatttttatttttatttccctcatttttttgggactttatattgtcagaaggaggagggaggctttttcctctactctaattggatccttctctggtttgttttcgtttttttttgtggaaggcccagaggttgcttccgctatggagaacccaccagggcctgggcctagtgaagcgggtccttccggatccgctgcgggcaagtcagctgaagcctctactccgtcgtcctcttttttcaatgggctttcgggccagatacccgcaccggattcccccggggaagaggtgccgcaaggggaacagccccgttttgacccttattcaattccggaagttcccctggaacacgtattcggggctgttccagatcggggagagccatccacaagccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcaatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaaattggaaaaatccggtactagctgtaatgtattcaataaaataaagaagaatgaccgtaaatcatttcgaaagaactacgaaagcaaccctgatctttcttctatgaagaaagtacgtaggcactcctcagcgaggacgcgggttttaaagtaggttctacacattcgagaagacccaggcggattggagtggttgtgcgccggggcaatctctgcttgcatttcgcattggaatttcttgactagcccgaatagatggactcgttcgttcggtcgggcggggcaaatctctaaagtggaattcgtgaaaaggtaccacactcaaatcacatatgatattatgtcaaacaaatcaactagctaaaaagctaggaatttatgtagaagtctgggctggtcagagttcaactcactactcgggctccttttcagttaaggatgcaagggagacttccatgtctggggctgacagctttcgtgtactgaatttctatgagattctcttgtccgcgggaacaaaaagctagtaaattcagtacacgaaattaggatattctagacaacgaaaagctaaacaaagaaaggaatgacaatgagtgtggaaaatccatctacacaaatccactcactacgaggaggtaatcaatcttatgctcaggcaattcattcgtataaatcactactcggggtgtagaggaaggaaatcaggggaatccccggtattaaagtagacagatcaagactagtaggaaaggatactccacgcactagagctttgtctggtcaaagtgctcattctaaggttcaatgcgccgcagaacgagtgctattccttttatgaaattacaccgggaaggaattgagcaagccaagtcatttaactcactccacttaagattgaacaaccccagtcagtgttggttttggggtaaagaaaactatgatagctagctaattcaagaaattctattccatgaaattcttcctccggacaagaaagagtgcggcatcaaaatatgaaatgaaaaactaaataaactaaaaatctctcctctcagtaaattcgtctattcgactaggaaattgaagacaaaggaatttggaattacaagacggatatcagcttgctacttctgactttgactttcaatagggaggtcaaaaactagcacttttttcgaggagtgatcatggtttgacttcgatatattccgggaagatggcttgaagctaatagcaaagtctatttcgactagcttgtggtactagctaggaaattccctaacctcgatatgaacaacttactcaactcaacagagtagcaaatgcccaagaaagcccgagtcaatctatttggaaatccaatctattttctcgtatttgtgtgggaaatcaagctattctagttgaaattcaccagaagaaatgcacgcacttcaatatgccaaaattgcaaaggaaaatccttcgattaacagtggaattcaaccaagaaatgaaaaggtatatataggaaatgcactccaaccaccaaccaataagtgattccgggcaatcaattctatccgcgagttgtggaagtgtttcatttgcctccgaactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgatcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgcctactcaacacttgaacattggtgtgtttcacattcaactctatctagccaaatatcatagctagcccaatgcatttcctcgtcgtagtgaagtgagggaaggaatttactagcttaactaacaataccaggcttgtccgccgtacttcctatatatagtattgaatttactagagcatattttactaagtggtgtgtgtagtttttacatttcctacgcttttcgtatcaattcctccctctttcctctttcaacactttggcccttttatcatataattgaattgaattgtcttggcatttagcatttgctctcttctgggacctaaagaaagtgagtgcctgtagcgatgagtgccagctttttcatagattgacttgggtgttgcatctctttttccaactcggatttaccattggcttgtcgtcctctcttacctgaccctgtcctatagaaagtagtgtgtagtgtgcttaaaaaaaagcaagtttaaatataacccgcaaaaatgaaagctcgctttgattgagtactcttcttggcttgttcagttcttctcatctgcctcggtaactaggtgcttttaagctactcttgttggcaatttcctttggtttgatagtcggatcttatcttttttttaagaaatcaagccttcctccttagccttgaacagccaccgcccctggcatctcctctgtaaactggatctcttctcttaggttaaacaaccgaatctcctagctctcgatcaaacccttatcccaatcgacatccggaaaggtcgaaatcgtccgattttagcatgaaaggcgatattaatcgttcaatttcattcactcgcagatcagcttccaggtctgcttcggccaatggtgctgtttgaagctttctttctaaggaaccaaaagaggtgggtaagacaagctatagagatgttccacaaacatcttacttgaagctctgtttcgagtgcactaagcgaagaggcaagtgatgagtacaaaacatggaaaggtcagtatagcttgaatgaactacgtagtaaggtttagtactaagcatgattaagtcacggtaactaagtaccggtaacgtttaatagatagaagtaagtaacaagtaccggtttagcacatatgggtcacataggcataccgataggataataggcttgtacgcaaggtcaagtataggctagagagaaagaccggtatatgtttatgttgagaagaaatgcattgtttgatttccgaagcaaataaaggcgcgcagcgaaaggcatgcatgtttcatttgcaggtgctgccggtccagggctcttcggctgagcttactaaataaaagaaagcacggcctggtttatgggaatcgtaaatagacgaagtggtgttttttcctttccttgaggatctatgcttttcatggctctctttctaacgtggatgacaggtttcaaatagtggatcagtttcttaatagccttttctaagtgcttttcgttgccttcttcttatctttatgtacccaggaaaaagagaagaatcttcaccattaccatcaccagtatcacctccaatggttggcgtccctttaattgtcatttagtagtagataggtttgttgaggacataatctcccggccttattcatgcatgataaaggtagcctttcatagtccaaagcctttgtgtgcttttgtattgaactcttttctacaacgttgaaggattgccttacgggattagcaatggcttaataaaaggattaaaaaagggcttctcttaggtcccatactagatgaccacccggaactggatgtactcgtactagaacatttggtgattacccaccgggacttcctactaagtatttgacacttccatcaagaagaaaactataaagtactcaatcaatgcgaatagcaggaatggtacttgcaaaaaaaacatataggaccagagaaatgggaacgaggctgacctatccaggtagtgaagtctacctatgctaaagagcaagttcaatatttggttcgagtagccagcctattttcaggagtggcttattatagtattattaaaaatcatacgaacaaagaaagcctattttaggagtccaccatatcaagggaaagggagatcaggcttggccttcgctttgcttattcatctttctttctttgcttttgaatgacttgatgggtctggataataacaagaagagtcaaggtagcgaaagtagctatactctagtagctggcggggctagtggtgaaggaaatcaaatggcagagaagacacggattcagacttcttttttcaaatagcccttggtggtatgcagattcattgaacgaagaaggcagtcttgcttcctcacgaacaagatcggagcacccaaggttaggcactcgattggatgttcccgtacgtactctagaagcaagatcgcgggacgtccctataacacatcgctgacgtcctcaaggctttcgttgtcgaagagtgaaagatctcacaagtcctccatacgtcagtttctattccagcccagcaacgaagtgcccgtcggtctgcaacattccctggtacaatgctaggaatatgcagtcacagataagtcaagaataagtgagtatgtacgagtcaactcataggtttagtagggctactagaaagaggagcttgggacagagctatacaggactgcttcttgctactccaagagataacaccgctaccaagccaaaatgcgtatcccgatgtcgacttgcgttcatctggacccaaaataaccaaaaagttccagaggcatcttccattcatttcgattttggtctttctgcaccatatttagatcttccctttctacgatccggaattcccagtaaatccttgactcctcgaatacgatgggatttcacacctggcgaatctttcactctacctcctctgactaagactatagaatgttcctgcgaattatgaccttcgcctggaatgtgagcaaatatatcatgtcgattgctcaaccgtacttttgctatcttacgtagagctgaattaggttttttcggtgttctcgtcgaaacacgcaggcatactccttgcttttggggacattgatccgaagctcgagtacggtccgtgcgctgtttttcttctctaccatgacgaatcaattgattttttgtaggcatccctctttcctatgtccttcccccctttgccctttcactagtggttactcccgatccgaagcaccccttttccattcatagagaaatccaatcgtcaaaatcaataaaaaggccatcatggaccaagatccaaacagatcaatcttgttaggaggtactgcccaaggaaaaaaaaaggtgacttccagatcagggataataaataaaataggaaccggataaaatcgtatatcgaaacgacttctggcatcaccggagggatcgaaaccacattcgtaggccgacaatttttctggataggtcgaactattggaagcaaatggaaaaggaacaccgagtggaatcaaagaaactagcggactgatcactaaatagatacaaataggtgcaaattccgacaaaaatgcactttcataagccgttatcgctaaatctatccgtattccctgaagaactgtggcgctttcatagccgtttctcgcgttgtaaacaccaaaaaaaatgttgtccatgaattcactttttttattcaattgagctataaaatctttccataaccttttgcgggattggccccccaaaaaaagtgataagcgcgactcaatcttgtcctttgggcccgggggaacggcagcacttaatgcacaaatagatggaataacagcaaatagcatatttcttctatccttcttatccgtggaactaatcttcatcatagggtaactatatctttttaaagctctgctcccaaaacaaacgggagactttttcgttttgtggccgtggcgttgggttttccaacgaaaaacaagaacattctttcacgaactttcatgacactttatcattcggaaccctctccgtattagtaagcccacaccttcgtaacccaaggaccgacgaacagaaattgaaacaacgcaaccgtactatctatttacgataatttgattgctgacaacatcacgcttctctttcttattcttatttatataactgtcactttaccgggccggaaaagtgacaccgtcacgtctcagagtcgtatgcctggaacaagaagggtcgtcgtacaatttcggcgattcaaaaaaaggaggcgagctccctatccctctttgtctttccacttccctcgttcaacgaatcaatcgacattttgtacaaattttacgaacagaagctcttattttcatatttccgtattcctttcttaaactatgaatttactcttttggaaaaaataagtctctttgtttgaattttagaactttgaattttttaccctagaaaaaaaaagaaaaacctaaccctttgaatctttggtatccttcaaatctcaaccgggactaaagttaagatctttagtcccggttggtgctaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgagtaactagaaaaaatgcccgtatcgttggacgggtgaagtctattttaattttattattgttatatggtttagttaagatgaaatttattgtaggagttcgcttggatatatatgtaattttataaaattataagctgcagttaggagtccgatcatcttaagttagcatgcgagtttttttaaacaaatactccgattcaaatacggatatatatttctaaaagcaaataaacttaaaaactgactcatacaagaatgacgtaccaaaatacaggcaaaaacatcttcaacttttataatagtagagatagagaatagaagagatagagatagagaagagaattgatatagattaaaaccaaagcataaaattaaaaccgactcaaacacgaatgacgaaccgtggaaacatcttcaatttttataaccgactcaaacatggatgatggaccgcagaaatatcttttatttttataatagtaatagacttgtaaaattttaattttggtttacatgtttatagagtaaacagatgtatatgcatgtatatacgtgaggcagaatatagcggtaatagatcagaagcagctttgcatgatatacggctgtactctttccttgtgtgacgtgggcagttggaaacgtgggcttgactacaacatgtaccggcttaatatatactgggctgtgatttttggaaagaatacagataataaggatcggactgatgaagagatacacgagcgattagcggcttaaaacacgttgcgcggaaggaaataactacaaacacgcttaggactctgaacggatgacggatttgcgacgtacgaagatgatggcaaaaacattttaaacttttataataggtagagatacacggaaggtggaattatgcacggcatacgtggttgaatgaatatattcgacaatatactattttcagtcgtattttggttgattacgactgccttgttttggtttgctttttgaatgtatgatgaattcgaatccaaatacacaatttatacgcgtacgtcggtacgtgtactttatcagcaacacacaaggatacatgcgcagatattgtatactattctctcattttttttaatatagacgacgttgacttttgaacatatactagtattatttaatcatttattttatttaaaaattattgtacaaatgcatataatatataaattacgcttaaataattttagtgataaaacaactgacacaaaataaatgataattacgcaaattttttgaataagacgaatggtgtcaaatgtgtgttcaaatgttaacgacgctatcttaaaaaaaatgatgcagtcaatttatctgcaccaaataaatgcgccagaagataaatcacacccacttctcataccactgatccaatttgaacttcccaaaacactcaattacaaaatgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattccgttagggatatagattatcttttgtaacacggactccttcccatatataaggggggtccgggtgcctctaggggcagttgttgattttctccaaatcatataatcaataagacactcggcggattcatccccggacaggagtagggtattacttcttcgataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcgtcaccaacaacttcggcaatgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaagaaataatttaaattgaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcgccgccgccgagccgccgccgctgtttccttccaatccggccgctcctttccttctccggccgaatcaatagaggggaaatgatctccgggatctcctctaccttttctcctttggaatcttcggctaaatcggtttggaaatcgatggattcgagttcgaatcggatcggctttcctctctccaagccgcgagtttccttcgccgttgccgtcgccgtgggccttcgccgccgcctccgagcccctttaaaaggacccccggtgtctcctctacccgtcgcagctctcgccttcgcctctcgtcgccggaagagctctagcgccgtgtgccctagcttcgccgtcgccgccgccgcttcagccgtgctccgccgtcgctccagctgtcgccgtcgctcgggaagaccgccgccgtcatcgccaagtcgccgccgtcctcgtccgccccttcgcagccgtcggaacccgccggagcttcgtcgccgtcgacaacccgaaggtagccgccgcttccttctcgtcgccgtcgccgtccgttgcttctccgccgtcgttttggtcgtcggtgagttcgccgtgccgtccgctacccgttggtgtcctccgttcgtgccgtagcgccgccgttcgccggtgagcgtgcgccgcccgagccgtctgcctcgccgagccgccgccgccgtcggtgacgtcatcgctggcgtcatcaaggccgtccgccgtgaaccgccgtggacccgatcgatctcggccgtccgttcgtgtgaaccgccgcccgtgcgccggtccacccaaaccctagcccgctgacgcaataaatccccttttcttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaattggactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaagaaggtgcgctgcagtgggttgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcatagtaaaagatgcttaaactggtaataatctgattagctcctggtttggaatggtacattcctagtttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtttgcgccgtttatttaatttccgctgctagaactttattgattgagaggaactatctacctctgtaatgacattttattcgcttattaatcagagtaatatttgtactctattatcaatttgttattgtgtgcctcggctgattcctggacgagggttcacacacatgtaagcgtttggaattttggatagaaattccgggcgtgacaggcaagatctctctccttgactcggtgtcagaccagtcgggagagaaccggatttcagccccgtttggactcccaaacgcggctgaaagttacttcaagaccatctcaatcgagttggcttcaaaccactcgggtgagatcgcatcttctccaacatcaccagatcaagatgatggggcttacccaccgatcctgatgaagctccccgacgatttggcggccgtctccatcacgacagcgtctccatcccgtaggcctaggcggaagtcggcttcaacaccgacttcgcctagcttcagggaagtcggcgtcattcttcaaccactcggacggtttcgacggatcagctggattgctactacagattttccaacgttgaatcgcgccccaaccacattgtggagtccgacgagtttagctcttgctatcacgacccgggttcttgacgactttgacgggaagctatattgacactacacccctctctacttcgntgtcttcatggctgataacgagacagaggagcactgtccaagcccggnagaccgaagcacgttctgagacttgacgttcccccctggaggaggagcttctagcccaagaacaagaaccggntctggcgtgagcacacagagcgtgaacgcgacccgaaggaggttaagaatcaacgccacaactttggagacagtcgcccagccgctaacctcattggccaaaaatgtttaaggggaccggtttctcgacccttaaagaagggggtgccggacaccctctctgaccttctctagggaaaagacttattaatttgtccttgtgaaattttaaacaaaaaaaactatttgggttggct

SEQ ID NO: 78465 - DNA, 2945 bp, Oryza sativa
gtcggagagaaaggaaggaaaagcccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaccccgcacgatttgcactggctggattcgacctttctgttcctttgctttgccgaaactggaccgactggttctgcttgaactgacctaggccagaactgcggatactcctgaaacttacgtatcttggactgaactgttgatgctagcagcttgataacctaacaattcaccaagctggctagagaagggtgaagattgaatctggcatttgtaactcattgatcctacgtctgcttgaacgggtcctgactcgaatgtcaagtaattccaggaaacctgcttgacctgtccttcgtctgaactgcaactgtcctcgttgttgcttctctaagctgaactgttgacatgcttcacaggtgtaccttagaattgaacctgtcgacctgagattggggtgactctgctaatggttcgcaactgactcctttaactactaaccactttgtttcacctcgtcgatccttcgactgaaacaacgacgaggtaagccaaaactcatctcagagacctaccacccttacagtgagtagtcttactttcgcgtggctgggatcagttgaactgttgtccttcaaatatagccaacacttctctgatttacaaagagccctgactttgaaaactgaaaacttcatcgatccatctagttgaagcaatgacgatgcactttcatcccgacaagatttggaacttaagccttagttgatgataggaaattccacataaagaaattctcatttagctcctgatcttactaactcttgactattttcccatcagtaataactgctggcatgactgtccttcttctgacctgactccggtgtcgtgtcatccacctgaatgggttgtgtagttgatatctcaaaactaaactgaccgactcgcattggaactgacacaacttgaggagttgaggtgtcgctaacaaagctcttgatgtgatgacactgatgccttactgtggaacaaccctctgagaggtgccctgccgtacatcttccatggatggttggacactttgcaaaaactgctcttgaaaaccataaccactgtaggtagcatttgttactcctgggattggtggttggttagctgtgctgatatgctgaggacttggtggcgtactatctgaggttgtaggtgcttgctcttggaaaacaaactgactttcgctctgatcccgattccggcttgcatctgagcttgtacttgttgttggagacattgtcgttgcatctgctgctttggactctgcggttgcggtatcaacatctgacacatccatcatctgacattggctaaccaaaatctgaccagagcgaggtgctctgatttagcttgtagcttgctgccttgaactgatccaatggctctgaccgcaacatattactgctggagttacttccgcttcatttgacctcgtgtcgagctttgcatctcctgcttcaatacacccatcttctgatcttggacaccaaaagctgatcacgagctggggttcttctggtattgggataccttgaagctttcaactgaaccattgatcggtgactttaatacaccgtcgttgctcttctctctaacactgaccatcttctgccagggcggaagagaggtggaagagaggggttgctaaagataaggtactaaaccacttacctactgatctgttgtgagtagacttttattgttcaagttgcttaagcaaacaacctagtatggtcgcatccccaccagtgatgcaaaccatacccctacacacaagcaaacaacacacgatctagaagctaacgaaactactcttctgggacagattgggtttaggtcatctccggggaaactcttctttaatcttcgcagaacgacgactctgaactgatctcctcgctccttgcacgaagcttgaggctcgacctgacttgacttccgaacagacatgacgctggcggtttgtcctccaggtttgacaactaaaggaattggaggggcagggaggagaattttgaaaaaccgtttcgcaaagaaaagccgaagggcgaggggagacatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagcctt

SEQ ID NO: 78466 - DNA, 2418 bp, Oryza sativa
aaggtgcaagcttgtgctaaggctattgactagacctctagggccatgtaatagggggatccctaaaaaattttacgaattaatacaattgcttttacattccaaatattgttgagagaaccacgcctttcaatgtgacatagttgtccattcgacaacagctggcgccgtccgtggggatacccagaccgaaagggcaaaatgggacccttctcgccacacgccacgcccttcgccatagtaccaataaggtacgtcgtcaagggctgcgggtgaataggtttcgccacacccacgcccttcgccatagtaccaataaggtacggcgtcaagggctgcgggcgaagagttttcgccacacgccgcgcccttcgccatagtaccaataaggtacggcgtcaagggctgcgggcgaagaggtttcgccacacccacgccctttgccatagtgccaataaggtacggcgtcaaaggctgcgggtgaagaggtttcgccacacgccacgccccacgccacgccctcgccatagtaccaataaggtacagcgtcaatggctgcgggcgaagaggtttcgccacacccacgccctcacgcccttcgccatagtaccaataaggaacggcgtcaagggctacgggcgaagaggtttcgccacatgccacgcccttcgccatagcgccaataaggcatggagtctagggctgcgggcgaagaggtttcgccacaaccacgcccttcgccatagtaccaataatgtacggcgttaagggctgcgggcgaagaggtttcgccacaaccatgcccttcgccatagtgccaataaggcacggcgtcaagggctgcgggcgaagaggtttcggcacacgccacgcccttcgccatagtgccaataaggcatggcgtcaagggctgtgggcgaagaggtttcgccacacgccacgcccttcaccatagtaccaataaggcacgacgtcaagggctgcgggcgaagaggtttcaccacatgccacgcccttcgctatggtgccaataaggcacggcgtgatgggctgcgaggcgaagaggtttcgccacacccacgcccttcgccatagtaccaacaaggtgcagcgtcaatggctgcgggcgaaaaggtttcgtcacacgccacgccctttgccatagtaccaataaggtacggcgtcaagggctgcgggcgaagaggttttgccacacccacgcccttcgccacagtaccagcgaggtacggcgacaagggctgggggcgaaaatgggttaaggagttgctcccaagagcagccgaaagagatttatcatttttcaagatgctccgaggggccggcaaactcaattggacacctgagtgtcaagccgcattcgatgggctaaggtagtaccttcggcactagtgtaaaaatccatttggaaaaacattttctgttgattcggtgtgccgaaagagttcattaccggcaataacaagcggtttgactccgagaagtccaaggaaatatgtgaggggctaaaacttgaaatcaagttcgcatcggttgcacacccgcagacgaacggggcagccgaaagggacgaacggcaaaaccctagcagcactaaagaaaagaccgaaagccgataacagttaaaaaggtcgaagtactaaaaagaccaaaagccggcaatggtcaaaacgatcaaagtacctaaaaatacctttgccaaaggcaaaaaggggaaagtacaagccgaacagccgtaacacgcaccacaccccatttatttgccaaaaagcacaagttacagataaattccattgcccaccaaaaggcattcggactttacatccgattcatcagcaaaagcagtcctcaatggcgaaggactacccccttgagcatcttcttcatcgctagttgttagatcaacacaaaaaaaatttaaagcggcgaagaaggaaaaacggggattatgctgcgtcgacgctgggcaatggcaaactgacgctcagtcatataaaattcatgggtgtcttcgccttttttgtgtatgatatttcgtggaaaaaccccaaggcaaacgtttgatcaacgaaaacaccaggggggcgatacgaatcggtcgaagcatagctcgccgaacgttgaaaccgcgaaaccgcgacagctcgttttcagaaaacataccgatcgtcgctacactcgacttctgcaaatacttaagcatttctggatgcatatgccaaaagtcgagagcgaatgatgcgggctaaaagtcaatgtgaattccttttgctaacacacaaggggaccgacatgcttcacccttccgaacgtacaagttacaaaatgcaatgatagcgaaaagaaacttaaaaacacgcacaagctccatcgggcaaaagcacatacgtgttatacaaa

SEQ ID NO: 78467 - DNA, 2683 bp, Oryza sativa
caacgctcgccgaacattgaaaccgcgatagcttgtttcagaataaagatactgaacgccgttacattcaacttatgcaaaacacaagcgtttttcccagcgcaaaatgctacgagtcgaaaacagaagtcgaaagctgaaaagtcaacaaatcttttcgccaatccccgaaagggggccgaacgcatgacttttggcaaaatcccctctaaaacaacagggaaaaggggaaagaaaaaaaaatacaagtcaagaatcgtgcaaagcagacaaacttggcaaaatataatcacccagtgtcataatacagcttcgccattttcgaaaggcgaatgccagtgttcatattttttctgcaggagtctaaaaagaggtttcgacaggaacatcagccgaaagggggcgcctcatgccataccgtatagtttgcacggtctcggccgaagctccttactcacccttgcccgtgaggggcttgttggaggcatgccatgaagcccttcggccggacctgccgaaaccatagtaccagccaggatttaagctaaagacatcaagaccattcaggcgaagccctatggcgaaagccataagcgaagatggcgaaggctgaaaagccgcgtcggtactccgaaagtaaaggcatctcgggcgaactacaaagacttcgccatgacgagttcggcatcaagaaggcccaacaggccgcccccggccttttaggcccgttcgccatagaccaggcccagcctatcagcccattaaagacccatatgtgcaaatgacactgcgtacccatgtaaatgtccctttcataagggcaaccatgtaaaatcctttgtaaccctaaaccctagaaggtggaagcttgtgctaaggctataaatagacctctagggccatgtaatggggggatccccaaaaaattttaagaattaatacaattgcttttacattccaactattgttgggagaaccacgcctttcgacgtggcatagttgtccattcgacaacaaacttattagagaaggttagtgatttgataaacaacgttagttagtcaactggttgcatcattgccccattttcaaggtaaaccaaaaaattatcaagagtaatgcaaattaacagcctgcattatctcataagttgagagtgtagctcctgagacaagtcatctgggctgatggacaggggtggacagaaattccccgaagaccgaaggccgacccaacctgacccgaaccgaactaccggtttttttcggtcttcggctggagcttgggtttctaattttgttttcttcggtgttcggctgttttatcagcttgtagataacgcaaaccgaacgcaccgcatacaccgatctactatagcatgtcttgtgtctcacaatcaagaatggcatgtgggccccacatgtgggtgggtcccacattattttgatgtgaatgacaaatgggtcccacatatttttttaattctagaacacataagcgccacatcaaccccatatggaccgaagactaagtcaacatcgccacgtaagcgccatgtcagcgaaaccgccctccaaaaccgccgagggagtcaaattgtaccggttttaagagttgggggttgagatatccggtattttggcttagggtcacgaattagattttgatcagttttgagggtcacagaataaacttattcctcagataaaaggcaagcagaactgaaaaagtacactgaaggtccctaaacttgtcatcgggataaaaaacgtcctcaaaccgcaaaaccagatatgtggggtcccttaactatataaaaccggtcacccgaggtccttcggtggttttgaccctggttttgctctacgtggcggctgagccagcgtggcacccacgtgggccccacatgacaggtgtccacgtcgccctctctctttcccctttcttttttctcttctctttgccacgagtgagtagcaagggacgggcggcggtgagtggggctgagcgacgatcggcggaggcggcttgcgagcgcacagcggccggcgaagtggagtggagcgggggcgcggaggaggaggcgggaaaggaggagggcggcgccgcgacagcggaggacgccggcggcggccgccgccgccggcgtggggaggcggtcgttccatgaaaacctaaccactaccaaccctcttgcccagacgcggacaaagtggcgaagctcggcgccgccgtgtccgatggccggagcgagcgcgtcaccactgcggcggacaacccagagacgctggaggaggtgattggcttctccccatagaagcttgaggctatgggtgtggacgcactcatgatctaggcgaagatggccgatgaggacgtgccgttcgaggtggcgctggccgcgggtgacaccatcaccgtgttcgacacgctagtgtcacccgacgagtagttggagtcacacggctccaacgcctgtgtcacgctggtggcgaccgtccagctacgtgacccgtcacggcgctgcgatgcgttggttgcgccctggaggctggaggggggagagagaggggggagagagaagagggtatttaggcgttgactcagcaccgaagaccgtggtgaaagcgccatggtggacaaaaccagcgccatggtggacaaatctggcgtcaatactgtc

SEQ ID NO: 78468 - DNA, 688 bp, Oryza sativa
aacatcctccttctgtcccgaaaaactgtactaattattcctaagggttaattagatacctatcatgtgaaatcattgtcatgattaatatttatgatgaacaaattgactttgtaaatgatttaatcaatgaagtggtttggaattatgtgtggatgtttgtgtgagtgcgtgtgattaatgtgggtcaggttatgatatatgtactcaggaacgattgttttatctaattcgattgttttatctaattgtgtgcaggtgacttgaggttagtcttggtcaatggtgaggaccgggactatctcagggaggagcagaggtctagtgcgatcgggataccatgtgagaaggtaagagagtcaggattcttgaaggacaatttcagtcaacggtggggatcggaactagactcaataaggagttgaggtccagacggttaagaatgccgggtgacgaagttggatacgacagtactacaaaaaccctcatagacaacgactcaaggtgcaaggttcatttaaaaccgataccaatgtagcttttcccacctccctacgatgaaaaaacataaaaccgacacctatgccagttctaacaaaaaaaccgacacatatactataggtgttggttttttaaaagaaccgacacctataatatattataggtaccggtgttttttttaaaaaaa

SEQ ID NO: 78469 - DNA, 686 bp, Oryza sativa
ttgaaattaaaatacttgctggacgcatgaattctttgattttttttaatcattttggcagattattgccgttcatcaaagaattgattgttaactcttacataaaaaaagggctctattcatgcatttgtcaaggacgggcacacacattgattcattttctttggaactccaatcaagcattgttcttaactatttgcatcaaagaattacttgcttactcttccaaaataacaattgcgcgattctgtatttccgctgatcatatgtttgtcaactaggatggcctctgatggagagaccccctccatcaaattctttccctaccttccatcaattccttttcctatcttcatcctttgatgatactattaggcagttctttgaaattaaaatacttgctggacacatgaattctttgattttttggaatcattttggcagattagtgccgttcatcaaagaattgattgttaactcttacaaaaaaaagggctctattcatgcatttgtcaactaggacggcgcacatggagtggtgccctctccttcatcaatttcttttcttattatcatcattagataataagcatttctttgaaattatttatacttgttggaatcatgaattatttgccttttatgaagcattgtcatcaatgtaaataccttgcatcaaagaattg

SEQ ID NO: 78470 - DNA, 1365 bp, Oryza sativa
ttaccctagaataaacaaaaccccaactagtggacactctactcaaggtaccactagtatgattttaggtagatgcttcgccgcttaattaggtaacattaggtggttttacaactctagactttgggatattcatatcacctggacactatggaattgttggatcattgtggaattggattcacacctcccctctattcaaaaccctcaaaatggttttaggctgggctcggggtgcatggttttgatagtagcacctcggccatataaggacaggtcttcgggcctctgttgcaaagcactaccgtacttccacatgtctagtggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctaggggctcagtcttgcctacctgtcccaggggttccggccgtaggtggggttgggtcggtactcttgtctatggctaggatatgttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagtttggtctgaatcatcgtaggccttgggttaaggcaggctcgtgtgggttcacggcattgattaataatattatatagctctagaatcgtgtttacaaaatagctttgagcaactaagtgtctattaatgctatttactgcaaaccctaaccctatatattataacccccttgtactcccttgcatttattctgcacttgtgggtgacttgttgagtacggtggttgtactcagtcttgctcaatttttcccaaactcagaagaggagttcctggaagatgaaggctttggtgtctagctcgtgcctgccgtcaaccgcctgtggtcgtcgccctagttttccgctgtttttcgtttgtcttcttgtgtgctgggtcttcgccgcccatgtaataaattaattaattacgcttccacttgttaaactctgaattgtatcaacttttggtgtaccttgcctcctgggacaaggaataatgcacgcacgtaaggaacgcccgttgggttatttccggtcgtgacatcaat

SEQ ID NO: 78471 - DNA, 13160 bp, Oryza sativa
  unsure (1)..(13160): unsure at all n locations
gaagcgccgagagatggagtgacctaagaggaaggagtgccaaataaaacgcctccccaggggttgggttttcttaaagcgtggccccggttttcctatgaagagggcaatgggcccacccaatataggggtgagccccccttgggcccccagctttcccatttatgctccggcctttttattggtgaaattggaacgaaaaacatttccacacagaaacagactatgcccttgttggcgccaagctattgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggagagcctaaattgccaactacaccgcctctatactagggtgtcttcatgggcggataacggagacggaggagcaatgccaagcccgggagaccgaagcacgtcgcgagactgaacgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttaaaccagacgaagaccatgattgcggcttcggtcccagttaactccgaaagcgtccacacgccgactggcagccgagtcccccactcccgatctcatgactaccgtcatctaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcatgcgccggaccgccacgacgacgacctcgacggagtagcagccttcaccgacgacctgcgtcgagtggattggccagccggcttcaagccgactggaatagagaagtatgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaactttcaaggcaccttcgagcgtcccggcacacaatacgacctctacaacgttattcagaaggccggagaaacccttcgagaatacatccgacgatttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtacgccaaggccgaagacgcccgcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagtacgtcgaggaagaaggacgacggtgacaccccggcaggatttcaagaccaccgcaaggagctcaaccatatcttcagcggcccctggcttatgagtctaaaaggaagcaaaagttgactgaacgggagatcatgctggtcagcccgacacaccccagtatcttcgatggtcagaaattgcaatcaagtttgaccgctcggatcatcctgaccgagtggtccacccggggcggtaccccctggtactagacccagtggtccgtaatgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacaacataccatgccatactcggacgcccggcgttagccaagtttatggccgtcccgcactacacttacatgatgacgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatttcaaaaagtggagaaagcgaagccaagactaaaaagattcccttagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttatatgtcaaagaagatgccaagcctatcaaacaacgactccgccgattcgcacaagacagaaaagacgcgatcaaggaggaattaaccaagctgttagcagcaggcttcattaaagaagtccttcatcccgactggctagcaaacccggttctagttcggaagaaaacggggcaatggcgcatgtgtgttgattatactgacctcaacaaatcttgccctaaagatccttttgggttgcctcgcattgaccaggtagtcgactcgaccgccggctgtgagcttctcagttttttggactgctactcggggtatcatcagatccgactgaaggaatccgactgcttgaagacttcattcatcacgccctttggagcatactgctatgtcaccatgccgtttggactaaaaaacgcaggagcaacttatcaacgtatgatccagagatgcttctcaacgcagatcggtcgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtactgtcagggaagctgcttggttttatggtgtctcataggggcatccaagccaacccggagaaaattactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgatgcacagaaggccttcgaagatttcaagaaactcctcaccgagccaccggtcttagcctcaccacacccgcaggagccgttgttgttgtatatagcagccgcctcccaggttgtgagcacagtcttggtcgttgagcgcgaggaagaaggccatgtccagaaagtccaacgatcgatttactttgtcagcgaagtcctagccgactccaaaacgaggtaccctcaggttcagaagctgttatatggtattctaattactaccaggaagctatctcactactttcaaagtcactcggtaacggtggtcacatcatttccactcggtgatatactgcacaaccacgaagcaaacgggcggattgctaagtgggctttggagttgatgtctttggacatatcattcaagccccgaatttcaattaagtcccaagcgttagctgattttgtcgccgaatggaccgagtgccaggaggatacccccgcggagaagatggagcactggaccatgcattttgacggatcaaaacgactttcgggcactggagcaggagtggttttgatttccccaactggagaaagattaagctatgtgctttggatacatttttcggcatcccacaacgtcgccgagtatgaggcgctccttcatggactgcggattgcaatttccctaggaataaagcgtctaatagttcgaggcgattcacagctggttgtcaaccaggttatgaaagagtggtcctgccttgacgacaatatgatggcatatcgacaagaggtacgcaaattggaagacaagttcgatggactcgagcttagtcatgttcttcgacacaacaatgaagccgccgacagacttgccaactttggatccaagcgcgaggtggcgccctctgatgttttcgtcgaacacctttatacgccgaccgtacctcacaaggatactacccaaattgcgggcactcatgacgtagctctggttgaagccgattggcgagagcccctcatacgatttttgacttctcaagaactcccacaagacaaagatgaagccgagcggatttcaaggcggagcaaactttacgttatgcatgaagctgagttgtacaagaaaagcccttcagggattctgcaacgctgcgtatctttagaggaagggaggcaattgctgaaagacatacattctgggatatgcggaaaccatgctgccgcacgcaccattgtcggcaaagcttaccggcagggttttttctggcccactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctttttgtggccattgacaaattctccaagtggattgaagctaagccggttgtcacaatcacagcagataacgctcgagacttcttcatcaacattgtgcatagatttggagtgcccaatcggatcatcactgacaatggcagacaattcaccggcggagtttttaaagacttttgtgaagactttggaatcaagatttgctatgcctcagtggcacatcccatgagcaatggacaggtggaacgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttatattcgagtctttgcgctttcgaaatttccgtgaagaacgctacgaagaggaccgagtggatgacttgcaccgattggaagaagtccgcgaagcagctttgattcagtcggctcgatacttacaagggctgcgacgttatcataatcgcaatgttcgatcccgtgcctttctagtcggcgacctagttttgaggaaaattcaaactacacgagatcggcacaagttatctcctctatgggaagggccatttatcatctctgaagtcacccgaccaggttcctatcgactcaagcgcgaagacggtacactcgttgacaactcttggaacattgaacatcttcgtcgtttctacgcttaagcttatcattgtacttccctatcttgactgtcaacatcaagttttcttcttgacgttgtcagtcgggggctatcatcataataatggagtgtgattttttatcaatttaatttgcttacttggtctatcattgccttgtttggtttttctacttcgtctgcgaggactgaaagtttttaatagcttctttgggttttaggctcaacaaagcttgataaaagcttttaagaaatcaaagacttggctagaattatcaaacacagcataaatacaccagtattgtacaagttgaacctccatttgttacattcatagtcagtcagaatcagttttttcatcatcagagttattactactcggctgaaggtcggtattgcggaattgctctacaacgtcatttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatctggagcaactctcagcttgtcgaagatttcggttgcgtcgagtgcactcggaccactgttattgaggaacatagcttggacaagtggtgtagcgacattagcgacttcatctcttgctccttcaagcattttgatcttaccaaccaggacgtcaaattgagcttgagatttaattttgcggtctacaaaacacatttatgatcaaaatctactgccttaaaaagagagaagttcagattgtcagctggcggtaccttcaacctccttcaaggccgagtccctttgcgcagccagttctactttgtctcttttcaagacttcaatttgtttctccatctgagccatcctggtggcttgcgctgtttgaaatccaaatgtttgaggatacagttatgacagcataaattaatgggacagatctagaagattaccttttgatgaaccactcagctcgaagtttgaatcctggagcagggcaattcggtcccttaattccttctctgtctttttggcaagctccttggcctcgtgtagctggtccctgactgcttcaagagttcccaaatgaggaaccagcttttctaaagttgctgtcttggcttcattgcgaagatggattctctgcatgatggttcatggtttagttctgctaaagagaaaacaaagtcatcaaaggcagtcacccagaggatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcgtcagccgcctttatgcgagggatttcttcttcgtcatcgcctggtggtcctgatgtatttccaagatattagacgaataagctggagttattcaaatcggcatcacttgagaagatgagttacctgaggatgttcctagctgagcgtgaggcgattcttgttctttatttgaagacccaatcatagcgtcgttaccagcctctggtccttgagaagtcgtcgtctgcgcttcaacttcgggaatttcttggtctggacctacgtccgactggtttccagtcgggggctcttgggttgttgtagtttcagttgctgccgactggtctccagtcggaggctggtcactcggatcggctgtatcacctgaagtatgagcgccagtcggctggttctcggcagtcggctcagaatccttggatgaacttggctctgtcacagccggatcaggatcttttccagttggatctatgtcggatggtttcctgcaaagtgtcctttcaatattcagtattattttcatgagagaagcataccggagcgaaatggtaccaagaggtttatgcctggaagatgttttgatctttggcgttggacggccagccagttttttcttgggagtggtatgctttgggagtttattgggtaggcctttgttcccagatttgtagccgtcgtcgctttcgtcgtcgttaagcaccagctttctcttgcgagaaccttgtttgccccagtcggattgaaggtttgaggttgcaagtccgatctgattgtcggccctccacctcccttaacggtgtgctggcgaggagaccggcgctgagtaattggggggtcagatttcatcaatacatattcctgaatgagatgcctccatggttagttaactcaacatgaagacaagattatgttttggtcatgggttgaaggtttcagatacatacctgcggaggcggattgaatgcattatatggcacaactggcagctgatgtgagtagccgacgacaatagcatttgagaagattttatacattctctccttcatgattttaaaatccagagagtctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaataggaagagagttccaggtatcttggtacaccggaggaagacaagagtactcaggaagagcgggctcaggattctgaatataaaaccagttcgcatgccaccctttgtttgaagtcttgaagggcatcgagaagtacttctggctcagagttcccctcagctgaaatccggcccctccgactacacatggcttactcttgttcggttggggtttgagaaagaagattcggcgaaacagagcgaagtggggtttaattcccaagaaggcttcacaaacatggacgaaattggcgatgtggactatggaatttgggtttaggtgatgcaagctgattccatagaagcttaatatcccgcggaaaaatttcgaggtcggaagagcgaagccgccatagaagaaatgagagaagaccacaacctcgtgtgtatcgggggacggaaaagcctcaccgcacgctggccgccacccgatgatctccttggcaggaagaacgccgtgcgccaccatctccttcaggttctcctctgtcacgtcggatggcgcccattggccttcaaagctttctttctcttccgccatcgattttacccgaatgcgctgatttgattcgagggatggctagggagaggtgagggattgaggcggtggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccagtacttttgacagcgtggcccattgtgctccttagggacttaggcattttttgctttggcaatctatgcgcataatagtgttgcccaatgctgataaaatcctttttacgtggtcatataattctttggaattattgcaatgcaaattaaaaggtgcccgacagaaaggtgttatgctgtttttgtaagcttttttaggctacaaaagctgtctgggttaacttggaatgacttgtttttaccatagtcgtttctttggtatgttatatgcctgttctcattatggtaaatagtcatagcctaggctattagacttatttattaccataatttttataatttttggtgggtaatcttagagttttctattcggatgcccgtcaagtgtgttcattcgtgaaccttttagagtgttaaccactcggattctttttattatggctaaaaagcagtcggctagaatgcctctttgggcgtcgcgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaaggtttgaagcactcggatcattatctttgagaaggctatgatggttgactgcaaaggtcgtgagggctactgtggagattatggatatcccatatctacacggcgatggtatttggactgaatacaggataccaaatatagatagaatattttatttgtgtctcgggtttgtttctcaacttgtacatcaaggaaataccttgagacttagtcggctacgactgtattttatctgtatatgcatattccgttagggatatagataaatttcatgtttcctcttttggcttctctcttgtccactcgtatatcgtggcatcactacatccatggcattcttcccaagcacaatggacccaaaacccgccataatgaggtatgtaaaaaaccacttgtatgccatctttttggctcttatttacgtgcctactgtcaagctctatggtcatcctttcaagagctagcgagtttggttcattgtaaaacccccgaatacaatctacttgaatcgtccttttactattttttttattttaccctagttttagtccatctttgtcagtttgcgccgtaaaccgtccgtcgccgctgcgagagtgcgacacctctttgtaggtttgtcctgaaaaccttccgttttgcccacgagacgggtagttatcctcatatcaatctaaatcggcctagaggctgattttgatctctaaatcggctccgctagccggtttagcttttctttttgcaaaacccatcttgatttggctctttggctagatcgaggtggttggcgactctaaatcactgcaaggcgtttagttgttgcgatcgtgcttgtcgacctatcaaaaaagttgccaacacgatttttggcgactccactggggaatgatctaatcggccatattacggccaaatttcgtttaatctagtagctaccgtttcgtcaaatcaagtttcggctaaacggccgaaattaatctattatcgctggattaatataatcggcggcgagggtatttggtcatcaccgaatccatctgaacacttgccgtgtgtactgaagatcatcgtcaggggcagcagccggctcagcaacgctgtttcttttgtttcgcactgcaacagagaaaaagatcaggctactagagccgatctactgagagacaagcagcaggaatattgtttctttttattgctgcacactgttaccgagaaggatcaaaagaaaaaatcaaagccggttcaatttgcatcggctatcaccaggaagtttcagtttttgtaaatttttgctacgtacacacacagtaacataccgacggaaatcaagaccgtatattaatctattcggtcaaatatttcggctatgagctatatggccggatttaatcaaggaatttcttcatcaactaagacgagcgggaacgggtccatcaatattgctacccaatacattagatccgatcaaggcgtcatgagaggaaatgtcctgctacctcaagttgtaatttcaccaaaggtaaccttcgattcgcccaacccgtcctttgctattcaaaacgttaataatcattgtgtagatgcatatgctacttctagttttgctcctatacaatatgcttataatactatgggagggtcaacgggtgtttatacggccgattacacgggaatcggctatatgcaaaacctagctaacggtatgtcacaccctgaagttctcctcccaagcctaaaattaaatttataaatcaccctaagaaaatgccggtgcaaatcgagagaaaaccctaagaaagtaatacaaataataatcgaatctggcatgtggaatttttcttgagttctacatgtcgaaattcactaacaggatttttagtggaatttttagagctctcaaaataattttaaccaattaaaattgagcaagcaatattttaattccagggaaaatccttttcttccttttctttttctttttcccccttttcttttcgagtgggccgccggcccattctccttcctcctctcccctccgctgggccggccgaaggccaaggcctagctaggccggccgcctccctcctcccacccgggacgccgataggtgggccccacctgtcgggcccgtctcctacctcgcgcccgcgccgccgcgcccgcaaccgccgccgcgcccacgcctccgcctcctccgggccacgtcggtcacgcccgcgcatgcgccgcacctcccgcgcccactctcctctctctcccgcccgcgcccgcgcccgagatggccgggattcgatattcgaattccgcctctgtctctcctctcccactcccccatgttggccggcggaatcccgcccctaccggccacgtccgagacttccctcccctatttaagctccgccgtcgccccctctctctttttccccatttcgccgaactccctcgtgctccccatcgctcccgcgccgtgcacccacccgccgccgccttttctgctgctccggccgccgctagcagccgctagactcgctgccgcaccgcgccggcgccgccgttgggttcgcaaggacgaactccaccctgtccgcccttcctccgtcgggattcgtcgccggaattcgcatcccctntgcgctccgtgagttctacctctaccgccgcctttcgccatggatgccggncgccgtgggtcatctccctctctctaatctctctcttctccttccttaggcaccccgaagcccgttccgcgttgcncgtcgtctcccgtgctttgccgcgccgttcgccgtcgtcttcctccgggccgccacttgtgcgaccgggaaaattgcctttcccgaacgctagtgtattaatccccgtccaagaaaaacccgggtacaccacaccaacctgattaaaagaaccatcttttatattcggataaattacattatacaaaggaccttaggcctgacaataaaataaacagagcgacttaggggctaacggtcatttaaagcgctcaatgggtataagcggactcacctagaacttctcaagtttctt

SEQ ID NO: 78472 - DNA, 566 bp, Oryza sativa
cattgcccataattggcttcccagacacaaacttctttggtataaagatcgatcatccacaggaaggagagagcaagcttacagctcacagcaatcagctaagccagtagccaatcctcactcactactcatcttctcttcccatctttgttgcttgcattcagagatcatccaatcggccatggctgatgaaatccagcatctgaccagggccttctcaggttagtaaacttacaaccattcaattcttggacacattcgtgtggcatttatgctgctgtttcatattgttttgtcttgcaaatgcttatggattttgtggatcgatcgattgatcaatgaagggctcggtggcctcggcgtggacgagccggcgatggtgtcggcgctggccaagtggcgcaggcagccggagaagctgtccgggttcaggaagagcttcaatggcttcttcaaggatcatggcggcgtcatcgagaagtgcgaggaggagtacatgctccacctcgcccccgagttctcgcggttcaaggcaagcgatttacctcttctctttgaatcttgaa

SEQ ID NO: 78473 - DNA, 589 bp, Oryza sativa
aaggaaaaataagagagcaaatatttatgcacctgtaactcatgagctcgaactgcccgtcagggggaacaaacgaaaggatctgattggactcccaaggtctgaatcggacacaagggtgaaacctcacatcgttgataattgtaggattagagaatgacaaggtcagttctggtacacctggaaggctagaatttacttgaattttaccatatgcttcacatttcactagagctccttctctgtaaataaaatttactgggatgtcagacatcaaaaacattctttcactatggtgcatgtcctaaggtaacaagatcagatggtgtcatgtgcgcacatgacagatggttggatctctccagaaacgagctacattgtgtttattcacagacatggtttcgttgggatccttactgctatgacaattaatgggcatgaactagatcacagtagtgaaaagtttgaatatgctatatagatttcagtaatagcttcctgcagatattaatagatgaaaaaactgttcaggcatgaatctagggtctaaaactcaaatttacagatttagtgaaatatatttggaata

SEQ ID NO: 78474 - DNA, 573 bp, Oryza sativa
ggcttccagacaaccatgtagtgcgacagaatcttcatttcctttcgggataagctcaagcttatgaatctcaggtagacttttcagcattgaggtgtcatattgtcctactgcattttgttgccaatggacattgataagtagccggtttggtgttgtctgtaaatccacctcatctgtttgtattctcgtctgctggaattcaccccttccatttattaaataaaattcaaactcttccatgtgtgcctcccgatcagaatcagtagtgtcaccaatatttgactcactaggtccttcggtcatttggcattcaatagtctcagactggctactttcaggggcgttttccgatggagcactctgaaacttactatctgaatcaggcgttgcatccatcatgacagcagcaccagccactattacacctcccactatcattaagagaactagtactcttggaaaatcttaatggttccaacaacttcaggtagatattcttcagagttaatccattggctctctcaggaagaactgccagcagtggggcctcaaattccttcatttgtggtg

SEQ ID NO: 78475 - DNA, 721 bp, Oryza sativa
ttcctgcagccctgctcggcgagcggcaggatgagatacggcagcttgggaggcgggtgcaggggcgggagccgctcgagggactcgcgccatggtcggcagacgccggcgaggtgcacgcggtcgtacacgcaggggaggcggttggcgatctcgcgcacgacggcgtcggcgaggtccgcccatggcgggaaatcggccatgagagacggtgggggaggggagaggaggggaggttgagaagaagacccttgtgctggtttgattcctcttggcttctggaagcttcggaaggagggagctgcgtcttacggagtggagtactttttatactgcaaggaaatgggacggggaaggtagggccgtctgggcccacccactagggctcgtgtgggcccatattgccgataattcaaaaaacaaagaccatttttcatctcaaatcaaattacaacgattatacatttgctcgattcctataactaatccaataataattcaagaaacatatggctcatccgaagttaagaacatcctacgtttatgcgagtgattatgacaacttatggcattgactacagggctccacaacggtcaacttaactctagcgggaactttatcctcgatgtatcttccgatagccacaagcgctgtacgggctttcctcaaaatactatgcgcatggttctgcaccgttcaaatctttcgtcagaacaccta

SEQ ID NO: 78476 - DNA, 6749 bp, Oryza sativa
tttttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaatcagagtaatatttgtactctattatcaatttgttattgtgtgcctcggctgattcctggacgagggttcacacacatgtaagcgtttggaattttggatagaaattccgggcgtgacaagttggtatcagagcccctttaaccctaggttatgccaaatggttacccatagaagccctctgaaaaatattgaaaaagtagaactgttctcctccctttctcttttaattaaccaaactaatggcacatgcacttcataatttttttttaatggttctcattcaaaatttattccagtgttattagtactgtacatctattactgtactaatggctcatttaccagcaaaagttttacaatactgttttatttaatcttgctgcaataaaataaatttagcatgttgattttataatttcctttcatttcttttgaaaccagttattcaaaattacaaaatttgtgacctcgtttccaactgttttaatttatttcgcaaagcttggtttactttatttacttccctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagcaatagtgaagaggtcccctcagtgatgtttgaagctggaggaagaaactacatccatgcatgtcaggaggtggcaaggattgccataggagagctccgtgatcgctacagtgatcaattggccgacactgagtatcgctaccatcctcgccaacctcagggaagtgaccgtggtagttaccttgagactgaaggaattgagaatgatgttaccacgaaacatttggttgagatgttgtgggctatggatgaaagtcgtgcagagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgctccagctcaagcggatcctccggtcatcatcataagtagtgatgaagaagatgaatccaagcgcaaccattccaagattgagtgggtagcaactcaagatgatgaagacgagccttcaatcgacctccgatgcttggaagaactagagtgacttgctaagtcgttgttttagatcgttgtgttagtttgcttgctttaagtttgcttgtgtgtggctcgcatgtgatttacatcagtggtgggatgtaattgcatgtgtttgtttgcttttgagtgttagaaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacacaatggagagaatcccactctggcccaagttcttgctcaacagacacagcttatgaacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcatttccgccttaacaggactactgctgaacctatcacttggcttgaattcaccgctgctttccggaagaaacatataccatcgggagtagtgtctctcaagaagaaggagttcaggtcgctttcccagggatctcgctctgttacggagtatctgcacgagttcaatcgtcttgctcgttatgctcggaaagatgtgcgcaatgatgaagagcgccagaagaagtttttgagagaacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtctctgctcaaagtaactctgctgtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtactccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatacccagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacttcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcatgatattaccggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcatacagaagtgtacaccgatcacaagagtttaaagtatatctttactcagccggatctgaacataaaacaacggagatggttggaattaattaaggattatgacatgggaattcattatcatccgggtaaaggctaatgttgtagcagacgctcttagcagaaaaggccattgcaatgctacagaaggacgacagttgccattggaattatgtaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcagtggaagttgggataagaatctaccctatgcagaattttcatacaacaacagttatcaagctagtctacagatggctccgtacgaagcactgtatggtcgaaagtgccgcactccgcttttgtgggatcaaacgggagaacgtcaggttttcggaacggatatcctaagggaagcagaagaaaaggtaaagatcattcaagaaagattgcgagtggctcagtctcgacataagagttatgccgacaatcgccgtaaagatttgagttttgaagaaggagactatgtgtatcttcgagatgggacctgttatagtttaaagggagcagatgcaagctttttctttccatagccggccaaatgactacccggatcatcggtctactctacctcaatcaaccatttcaactttatacaaaaagtttttccgtaccagctccttctacctataccggaattgaaacacctaaagggaatttggtgtctttcttgtcataatgggaagaaatcgccctacccgttgtaaaataaggagcacctggttttgcccatatcccaagacctcaattttatgtccaaaacatacattcccaccagaagtagtcaccattattaggtcctaaagataatgtgtttggcagaggtacataaatgggactgttctttggtttaacaggacctttttttattggcgacccaaaccccccttaaaaaaccaagttgtccatttaaacccctccctgaattcacaccttcagggaataaaaggggccatccctttaaatttgccctcctttttagcttttttttaaagagcgggaatgcgcaaaaaaaaaatcacctggtaaaaaaatcccggtgtgaaatcccacaccctttttgggggtttttaacagcaattttatataatctccaaaactttcttaaacacgaaaatccctctgtaaaaggaac

SEQ ID NO: 78477 - DNA, 609 bp, Oryza sativa
aaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagcatatatatatatatatatatatatatatatatatatatatatatatatatatatatatatatatatatatatatatatatatatatatgtatgtatgtatatatatatgtg

SEQ ID NO: 78478 - DNA, 6351 bp, Oryza sativa
gatctagtgggcaaagcaagctcaagtcaagtagtggaatcctacaagccgaagggtaagggtgctgggggttagtgatcttaccatccaagaccctcgagtcccagaataaagggatagtagtagaaagttggtgctgtaggaagataagaatccaaagcctaaaagggatagccccctagtttgatagtgaaggatagcttactatactattcccgccactctactatatctatatgaaacacagcaacacattccacttatctcctgctgaatccagtgaaagatcacaggtttgtgctgctccacctactagatcaagtctatcatggaaatatatattcctgtcatcaaatcaagagaataaatggaatcaaaacgcatgatctttcgttatgctttgtaggcactcctgagaaatagcgtagttgacaagagaaagggaaatcagcaaagtcaaagaaaaaaacaatcaagaaatgcgtcgagtagtgatgtgaagtccattcgattgatcaataaggtggcggagccaatgtagtccacaataaatagtaaagtatagcgatccgttaagactgggttgcttttagttgtaagattgaaatgaaaaaggtgagtcttgattaagaatgatatgcctcttcggcgaactacctacacggaacttgtgtattaagtatcaattgaaatggtttactccttaaggagatgtacgaaccatgaaagaagagtgggtatgagggcttctttcatttgcattttgatctttagtagaatcgaatagaatagtaggcattgtcaaatctcaataaagtagcttgtgctactttctctttcattcctatgtgattgtttattgagtcgaggatagatatggcaaattctctggcaaattctctggttctctgctttcttcctctgatttatcagataaataggaaacttaagattcatatgctaggaatcattctttcctcgatctcgatggccaatctgcgtaagtaacggactatcctctttctccttcttgctccatgcataactcactgcttactaggtttaaggtacagctatcctcgttcgtcgtctggaactgttctattgtttatatcgatcgctcttatccccgttcttaatccccggggcaggctccctcatcactcaatcgctgcgctgattcgacatctgccgctttcttcccttcgttctttctcgcattaagggaaatgctggctttgcggaagtccagggttatcgggcttgagtggaatctttctcactggctttaacccgttcagtcgggactcggcgtcgagcacctgtttgatccgttttattgctccctatagattgtttcggacaggacctaggtctatgcgccgaccaaggaagggattgatcaactagatcgataatagggactcgcacccacatctggatttccgtccgctagagcagttgcgcgaaccgttgttggaatgatatgagaaaagaagggtgatgatccgcatagtagactaagaaatatgaaacatcccactacattcccttactagttagagaaagattagcttttcaggagttcgtgtcgtctaccactagaggagcacaagttggaattgagttcgtgataggaagggcaattgggaggtaaagatctgggaaagagttatttgacatgtgcctaggctagttgtcctaagaaggatcacccgtcgagagggcagcgaagagtaagtagagaattactttgagcttgtaccttcaattttcaatgaaagatttagtacttcttggatagcccttgagtagtgctaggaaacgaatcctgtagtttacgtacgttatcagtagtttctttcctttgattgacaagaaggaaaagaagctttgcgcgaggagcggcggggacagagagagtaggcaccgaagaagcttacccgagcaccgaactaaccaaaacctatccttttgctcttggaattgacaccggaaactactgactgaaagtactagctttcccctgtagaaaagaaagcataagcaactagtagtatctaaaggaagaagagtataaataagcatcttactctttaagggcaagctaagcaaggagaagttttcctttaaatctctagtttcaagcggttaggtcagttcgaagcttagagaaaagtggagttgaagttgggcatttaggaagttatgttgcggtatcagaccactctgtcgaatgagttgaatacacttattcaaaggggagaagcttcagttcaagtttccgtttttgttggaaatccagaaaccatatcagtcgaggtatttactttgttagtttccgttgctagagtaagttcaaccccgcggagtggagatctttttttcaagactgaagtgaaagttgggaatgaatagtatcttcaatagtgaagtccagttgttatagttcctaaaagtaaaccattggctggctcacgtactggcctggctgcttagctttcttaaacacagaattcctggtagatcgattggctttcttatccttactcagctgctcttcaagtgcttttaccaaagcaggtatttaggcaagtaaagacaaatccaaatcttacttatgaattgaaaagggcagatactagccaagttctccttctgttaacagctcagttcttacaatctatgatatcaattggcattgcagctttttgttatgctaagtattcttcaatgcaagttggtgatatcactcattcaggacatggctatgggctgaagggcaggccaaagaaatgctcgccgggagggctgcctagggccttgttttgtattctgaaagtagtttttcaggtatatttagcccatgaggattactaatattagtagttagtagctatttgaaggtcagagtgaagtaaagcagcccatttgggcattgtcccccgctcttcttgcatagaaacacaagctagccagtgaccttctagctaaagtagtagcagttgcagccattacagaacaccttcaacttttccttgaacatatattgagagaaatctatccatgagttcatcatggacgacgaagcagaacaagctgttcgagagggcgctggcgacatacgacaaagacacgccgggccgctggcagaacgtggcgcgggcagtgggtggtggaaagacggccgaggaggtgaagaggcactacgacaagctgcttcaagacctgcaccacattgagtcggcaggccgtcagggttcccaatacggcggcagcagcagcagcaaatccaaaggtggcagcagcagcggggagcagaggtagttaagtaatacgaatccatactaggaaaatgtgagtcctaggcactggaattggttctcttctccctaatccctataagccagaaagggtaataggcttcagtgtaagcatttcctcacacttgtcttcgtgggccactttatgttgagcaggaggcgctcactgttctcgttgaagctgtttatacaggttttggtggcaatccgagtgagattgaacctgctttttagcttcttcttcgctcttctctttccaaaattcactacgaattttgactacctccttagtcaccctatccactctcgtcctgttttcgggttccctttcaggggatgaggatatttcgatgatttatccccccgtaggtggaaaacgcgtgggtgagtagagtctgtgctttgctttggggggcaccggcaagaagcttctcggccaccctactctgacttgattagctacttactagtaactaggatcgttcaaacagtcagtcagcaatgcgtacttctttcctagttgagtggatctgcgtagcagagcccaatcttctaccacaagctctgacctgacttgttgtacttgattcacccacgtaaatagacaactgggataagggcttgaatcccataaaagagaagtgagtccgcatgtcggcaaatgatttggaattgaaactggccacagaggaaaccgaagccctaactccccattctttctatcttacatcgccatcgagccctggctgtagagtcacaggtttataatcgcaatggatttctgttttctttggcttttccattcgcttcgttcaaccctgatctggatagatagctcggcttctattagctgagaatggttttgtcaaggaaaggtttcgctatacaacaacaatgaactcacttctgatcaaattggatgaatcggtaatctttctctgtcttgtgagagagagtcacttgctgtattgagagcgggtgggtgactagtcaaaagcaagagatttcacaacttctctgttgagcttacccaactactttatccttaccgaataaccagttctatctgaataatgcctttcctttctattggaatggaacacactgactatctattgaatcgacttgagaattctcgtaatataatcgcttttcctatctattggaactgcacacactcccattgctagcaaagctcaggagatagaatttgagatgaaggaatagcagagttgacttctttcccgggcatcactcactctcgcaacaattcggacagggaagggatataatccattcaattcttctgcctagcttttggcaatcaattccagatatcggaacagagactggaagcagcaaccagggctccatagtggtgccgtgaaaagagcctctcagtattagatagaaaaggctttccttgcctgcggatctttgtgcccttcaagtgccccttgctgctgtgggtaagaacgaacatcgttctagccagctagtgagagtttccccattgatctttgatctggctaatcaattttcaggttttttatttccttcaatgccgctggtgcatagtcagacttgcaggggcagctcaatcaagtagagacaagaccagctgttgaagcttggcagtggaatccaagagataagaagtagtatagagataagagaacgggattcaaagtagtagtagttgaaataagatagagcaagcaagagtagtagtattagcaaagaagattagaattattgtatccgctaatgggtagttgatacatacggacttagaagggcgaccctcacttccgtcaatcggctactggttctcggctgctaccatgctacctttttacaatcaatgaaatggcgctcacgaatagataggagtccgtccttcgaaaagaagatgctcgagcgtaagttatcgttcgtaacatgcctacgttagtcaccaaaagcaggtacggtttggttaccggaagaaaccctgaactcggaaagatatgctaactgggtgattagaaaaaagtaaggacacattgggttcgccgaacccttcaatcactcatccctcctgagatggaccacgagctggtggcaaaaaggataaccctctgactaggattgatagcgattctcttaataaaggaatatgcctcgtccgaggaagaatggcaagataggcggatgacgaaggagcagggtgaatagaaacacaatctggttgaagaaaaggaactacccccggggggccccggatagctacgaactggaatggaaggttatccagatccactagccacttctgttggtccgtcctttacagcaagaaagagatcatcgaggcggaagaaagatgaggtatcgatctcaaagaaaagaagaacttgaaagaatcagagattcaagtcagaagtgagggataaggagtcactctcagaacgataagtagatctcgcatcttcgttcctagtcaagagatggggaaagtaggcatatgaacggtaggaaggctcctgcttctttgccaaggactattaccgcgatgccgggccaaggagcggatctcggaataaagacatatccgtcactagcaatggttatcgaaaccttgaagggaatagacaagtacagtagggaaggaggtactccagggttaggtaaatatctgggttcgagctaggggttatattggttacgaggaagaccagaaggaaataaagcaggttagcaagcaggaggcaggaaagcaagatagttagcaagccggatcgaaagatagggcctttcgcactaagcaaaactgggtggatactttattttattgacctgttgaaaggaaagaaaacacctcgctgtgatcatataacctttatcgtaggatggtttgaggaaaacctaccggccacaatgattggtgtaaaatagggttaaattattcccaaatccaaaacgaatggggtatggtgtgcataaggaaccccttttctgcaagggagggacataaaccgatctcttttcc

SEQ ID NO: 78479 - DNA, 1627 bp, Oryza sativa
  unsure (1)..(1627): unsure at all n locations
atcacgatacgattaatctgatggcgcagcacgaacaggaaatagataacctagccctgggaaggaaagggaacagtttagtccctccaatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacactccctgtggtgctttcagcgggggattcgttatggaaagcgggaaactcaagtaagtacggcttttcgatagctaatacgagttgggatgacttgttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttcccgagagaagcaaaaattactttcgagggtttagttatggaagccctacccaacggaatgttccgcgttcgcctagagaatgacaccatcatcctgggctatatttcaggaaagatccggtctagttctatacgaatactgatgggggatagggtcaaaattgaagtaagtcgttatgattcaagacattatcacttatttattctcattataacgtatgcctttcgctgcgcgcctttatttgcttcggaaatcaaacaatgcatttcttctcaacataaacatataccggtctttctctctagcctatacttgaccttgcgtacaagcctattatcctatcggtatgcctatgtgacccatatgtgctaaaccggtacttgttacttacttctatctattaaacgttaccggtacttagttaccgtgacttaatcatgcttagtactaaaccttactacgtagttcaatccagctatactgagttctccatgttttgtaccatcactttgctctttgcttaaggcactcgaaacaaagcttcaagtaggaagtttgtgggacaattcttataggtggtcttaccaactccttttggntncttagaanggaagtttnaacagcaccattgcccgaananaacctggaacttganctgcaagtgattgaattggaacgattatatttcgcttcattgctaaaatnggccgaattcaaacttttcgnatgtcaagtggtatagaggttgacccgacctagagatatcgttgttatacctcaagaagaatccgttcaccggggaaggacgggccggggtg

SEQ ID NO: 78480 - DNA, 1627 bp, Oryza sativa
acattggtcgatcagcaggtcaagttagtttatgatcttagctaacgtgtgcttcctctgcattgtgtttgtttccccctctttgctgttttggtgagtgtgatggtattgtagtgctgagatattagctgttaattagcagaaggcagaactcctgttctagtacaaatctcttgctgatatgatcaatgtgtacctcgatccaagtgcatcgtttgctacatttctgtttccattttggatgattcaagacttggaaatagttgatacttgataacccgtcatatctatccttgtgttgccactgatattcagtgtggagatgtgcttatgactgtgtgcttacattttgcttagacgggagcacacctttactgatagacagatggcggtgtatttctttctttgcgttaagtggattatattttcatggaattcgatgtttggttatgcaattctatcagtatataaaggggtttctgagaagttcctgaagaaagtctgaacattgaggttctgtgctgaatgcagccttcaaattgtctgaatgttgatttattttatattctttgccattaattgcccacattttttttaccaagttttggttataccattctaaacttcctatgcagaactcaattctgcagaaattgcagattgttttctctatttggtgcctgcagattcttctgattttttactgttagcaggttacctgctaatatcctgatcatgttcattttgctggcagtaccatatttttttctgaattagtgcaagcaacatgcatcacccccacacagttaatatcctgaatagaccattgtaagttggaactgaacattgtcttagcacttcttcttttattttttttaaagaatcagcacgagattgtgctatttcattggatatagaggtaaaaaaaatacagcccctatggataaaagggaaactgtacacaaaaacaaagaggctattgctacgaagggaggaattctccaagccgccttgcacctgccatgatccaggttcttgtctcttcctttattttcgccataagattgggagccgttgtttccttgtgcttgaagatccgttgattcatttccttccaaatttcccacacaatgagtagggtcaaggatcacagttctttcttgggcacttcctttttgttgtttagcatgtcccaccactcttgaacgctttggcatgggtcccaatggttcagatccaattgctgataggcaactcagctggccgttagcctccaaatactcatggtgtatctacaagaggcgaccaggtgacataccgtctcgttcgtctcccgacataaggggcacaatccattgttttgccattctcttgcagttagccggtcggatgtccaaactctatttgtatcataagccacgcataaaatttgcatttcgcaggtgaccaagatttccaaatcaaggaattgtagttggtgccgacatttcctagcaattgtgtgtcttagcacttcttgctctgttgttatatgttataactgaacaacgccttagcatatctttatttctttcagtattgcaactgagcattgagctagcattaatttgttgcaatcctatgatgg

SEQ ID NO: 78481 - DNA, 2731 bp, Oryza sativa
atactttcaccagaactctaaatgtgcaacttagtctcttccacataaacatgccatgctaccccatacactgctcacctattaaggttgcctcctcgaattatcagatggatatgcatttcattccatgacattgctcttcctaccgtctagagcttgagtgcatatttttttttcgccaggcagcttgagtgtgtattcactaataatgaagcatatgactgttgagtaatacggtttcccctaaatgtgtaataaagatatataattttactgttaagcaaactcttaatataagatttcccaccttgtgagctgtccatctcacaaattctggagatatgcgactggtattaccaacctttgcagagaacagttacagtagcagcttcactggaatctttaatcctccggattaaaaacagtaatatactccagtgtttattcttaagcatattgagatctcaatcacccttaccccatagatacatattaagcatgtctttacaccaagagtttgttaaatcatcatcagccccctatgtactggtgcacttttataacattgaacattgtctttagcttcccaagaaggtaaacttatgagatggttgtgttttagattggccaatggccagaaggcctggcaagcatcattaagtcctatttcccctcaaaagtctagcaactgtaacttgtgatctccaaatacaagcaggtatgccaagtattagcacacctaaccatgtcaggtatgtgtgttcattccagaagaatcggaaaaaaaaagtccactgttggtagattaacataagcgggatgcttttgtcataccctggtgaaaatgttgtgctgtcaccaatttcctggggacattgattgacattttcattttctataaaaaaaatggaaaggagaactgatcaatattgtcactggcttcacaattcactatggggcattgattttaccatattgctatgatgctatctgatgggttgaatagcgaatttcatgatgtgtatggtcctttctgatctattatctctttcatgtatttaatgaggtttatgtctatcttactctgtaactgtcaaaactcaaaactgctagtttctatttattgggctccagtttggttaggctctcaggtgtactaccctatgcagaaattgcattttttttctgttgcacaataaaacatcatctccgtgcatttttgtttgacacaattgcacagcaactaatatagttgtctactcagtgctctaatgccaattgagtatatttcatagtagttaatcactgctacccaccagtaactgtcttttctttcagagaatcactgataagtgataacactgttagtgataaacttttctatgcaaggctcaatttacctacgaaggttacattccactgcactatgtacctaagcaaggcagcgcaccttgcatgcatcatgtggagagctagtactccatgtcgtcgcactgttcttctttatctggtttaagtaaccatttggctttacaatcccaaatttgaacctctcttcctatgtttgtccatgcaggatatctggcgtcatatacattccctaatgccaatgcgtgatgctgctcgcactgcttgcctgtctcattcctttctatgttcctggagtgctatcccaacctcaccttcaataagtatgtgtttagacccaaagcatttacgtatggaggggatatcagccacagaattgactctattctgggaaaccactcaggcattggtgtgaagacattgaagcttgaattatctggtaccgcatatcacaatcttgacaattggcttcaagttgctgttacaccaggcattgaagaactcacccttatggtatgtagactggagataacgtacaactttccctgcgcacttttatctgatggggttcggaactcaatccggtatcttgaacttggcttttgtatcttccgtcccgcaactgaacttggccccttcagaagactaacaaagttgcatctgcaatacgtgcgtattacaggggatgagttagagtgccttctttcaaactctcttgctttagagcagttggcactcattcactgcgatcatataatttgcctaaggataccttgtgtgctgcagcggttcagctgcctgagggttcatggatgcgtgaggctgaaattgatagagagcaaagttccaaatctctccactttagaccttagcggaaaggcggaactgttgcttggggaaacattgcaaatgaagaacttaagcatgcgccatccaaatgttgtctgttatgctcgttctgagcttccatccagtatgccaaatattgatactcttgccttaagctcctatgatgaggtatactctaaaactttgtgttgtcgattagcaatgtatgtgtatcacatggcttttgaataattgatctgagacgtggcatattggttgcgcaggtggttaatacaccaatgctgcctaccaaattcctctacctcaagcacctgaccatttgtttgagctccggaaccttttcgccgtcctatgactatttttctctggtttctttccttgatgcgtctccttccttggagactttgaacttggatgtaaagctctgttcatcctatcctgcaaagttatctggtcactgtgtcaggtcaattgactatactttggtttcatcttcaggtaacaaatgatccta

SEQ ID NO: 78482 - DNA, 3625 bp, Oryza sativa
gagagagaaaatagaggatgagaggatgaggagatgataggtgggtcccacaattttttttataaatagagtgctgactggactgccacgcgtacgctacgtggaccaaaaccaccgtggattgggtcgaggggggtaatttgtccggtttgtatagttgagggtgaagaatgtccggttttgtggttcggggagaggggcgtgatttgtactttttcctaaatggaaaaattttatttatataattgctctcttatttcaattttaaattcatttttccaagaacatagtaagaatatgacaaaaggaggtagcaaaagtaaatataaatttgtcataattggataaaattttcctcttaccatatatcttaatagaaagtttcttccattaaaatatcctaaattccataaagatatctatagtacacaagaaaagctatttcttaaagtttagaaactccaaaagtaagatatactaaatattaaaaacacatatagtacaaatgatagttacatgtgaatcaactccattttccacgacacgatattttctcataaactcaagattttacgaattcaaataattagaatttatatgttgatagggtagttagaagaaaatcatgactaacatttaaagcaatcctaaacaaactatggacaaaagaatataataaaaaatcaccaacatgttaatattactcataaaaattcaagcaacaataataaacaaggtgtcaggctgtcagcaacgtactgcgcatgtgcgcgggttacctttctagtttatataatattttaataagacaaataatcaaatataatgctaaaagtcaataacgttatttattaaaagtgaaaacagagggagaacatagataataccaggattatatctagacttctgaaaatacacatccctccattggacgactatactccacaatgtccgcgcaaacttattaaaggattcagtgtttttaccctccttcaggagtattaataaatggagcgtagtcctatttttaactgtcgaccatgttacgttagggaagaccacgcctgccctttagaaagtcagttttagtagcatttatatcatgtccatgtacgccctgctcattggctaattaattaagttccagggcaaaggaagactttgccaacttgcataactatagaacgactcgcagatcgatctacctcccaagagtcactattattattactaattttttttataaagctgacggcgtccatctccatatatacctaaactaacatatgttacaggttgtattcgatctactacgtaccacaccttattttctactatgctcgtccgaccagtataaaatgggggtgatgccaccccagtgttgatgcaacgagaagacagatctaagaaataaattaccaacactcccgatcaatgtctcacaaacccgatcaaaaatgtgcgacgcaccaagattgcgacgccatggcagtgccaccaaaaaatgatgcagaggcatttgatcagcctgatccaaatgatgagaggctgccggaagagaagctcaacaccatggccgtacgcattgcgttcttctacagggtgatgaacggttgtggtgcactggctttcgcatgggccacggtggtgttgctaggtggatacgctaccctcatcaaacagaaggatttctggttcgtgaccatcatcgtcttcatggaagcaacctggtatgtctacatgtgtatatatatatatatatatatatatatatatgcagattaattataaggtcaattttaatttcaagcaatactcgctattccgcaaagttcatagaagggcttccctgtcggttcgtaacaaacagtctctctgctggttttcccactggcaggctgcatggcacggatcaggatcgtctgccttcacggggtaactgcacgagcgtgcagtcagcacacatccaccgtccgagccatccaacggctatcgcgtgacgtgtacccttaaacaaccagcccaggaaagcccacgctcacaagtgatagactgatagcggacacacctctggactccgataacatatgcgttcgttgtcgttatcgccggccgtcgtcgttcacggcggggactgacctgaagctcttcactgggatgcgccgccaccagagccaccgggagctgtagcttcctcgctgtccccttgagcgtcgtgcacgtactccactggtccatcttcttgctaggattggatatgcagcaattggaagcaattcaacatgcttgctgcctgtggaacttggaaaatatggatgcaccaagaccaagtagtagcataacacgattacagttacaatgagcagcaagcaaagcttgcgttctgaacttctgattcgatcgactatgcagcaagcaacgtattacgtaaagtacgcattcaatcagctggttttctacggaaacacaacgagaacacctttgtcatgcttgcctccggctgctgctgcgccgctgccgctacagacttgtcctcaacggaagatgggacggcggagattgaacacgacgtacatccgaggagacagcagtgaagcccagctctcgtagcggccaatggtggcgtatgccggtggaaaagcttcaggtcactcggctgacggcagcgcataccggcgtttgagctccgggccactccccaacgcatgcgggtacttcgtcgctgctacttgctgggttttcgtgggcttcgcgatggctggttctgttagctatggcgtgctgcctcgtgagccatcggatggtttggacggtggatgagtgctgaaggcacgcgcgtgcagtcgccccgtgaaggcagacgatcctgatccgcatggcactgatacaacagcgcaagcagtccggtggttgcagtgacctgagtagcaccttaaggtgctgagttcaaatcttcataggagtgaattttagattgggttgttggaggggataattccctaatttaaaaagctgcatatatctatatcttaaaagaattatgtgtcctgagtagcaccttaaggtgctgagttcaaatcttcataggagtgaattttagattggattgttagaggggataatttcctaatttaaaaagctgcatatatctatatcttaaaaaaattatgtggcactgatggtcagggctcataactgccggttctagcactgttcaaaaacacatttgatctcaacattttgcacgaatctcaacattgatctgagggttcacaaagcacgttgttagaattttcatcaacttattgcacgaatctcaacattgatctaaggattcacgaagcgcggtgttagaattttcattgacttttgcacaaatcccgcgctaggggaggggaggggagccggatcccgcactgggggaggccggccagccaccgtcggatccgtgcggtggttggctgccacccgcggaatcccgcgcctccaccatcagagggtgttagtgatatgcccgagaggcaatcatagagatgattgtatcacatactttgtttacatacattactggagaaccccacatctctcccggttcacaaccacctttactcccaggtagcgaacc

SEQ ID NO: 78483 - DNA, 21167 bp, Oryza sativa
  unsure (1)..(21167): unsure at all n locations
gtccaaatatttaatgtgttgtttttggcaaaaaaaattttgatctaaactaggcctcagtcagtttctctgtccgtttgatttcttctcatgcacgctgtatccatctgatctttgccgatagcttttaactttgttaatggcaccttcctcaggaaatcaatgacagtgcaatcaaatgtctagcacttgcatgcttttgcttttttttttcaatgtaatattttaatttagaacgtaatttttttgggacttacaatgtaatgtaaatagattgaatttacagtgtaaatacactaaatttataaatttaatttttaaaaattacaatataaatacctattaattttttatgaaaaatatatcgccataaatacaaatactcccgtgcgtatgtcgtatatgttattttgggacacaacgcagcccattccctctcgcgattttctcccagccactcgggctagcaagacctcgccgcgacgtcgccgcaaaccaccacctcgctgcgtacccctgttaatccacggcggcggtgttcagcccgccgtggaattctcggcgtccgccagtgtccccgttgcttcatcttctggtttttctcttctttctcgccagctgcagctagctagtcatccttgtgcactcaacctgtttgtggattttcctcctcgaagaacaaatgcagctgcttgccctgccgggatgtattttactctgcccgcgcatcgccgttcactgcatccagatgcggatgaaagcctgtgtggtttgtctgtgctgaggaggaggcaccgaggagccagaaggcttaggaatagcaaggtatgggatcagcactctaaaatataaattcatagttggtttgcaagagaagaagttgttttgttcggttattcaatatgcatcaacatgattctttttttcaactcagattaggaacatggagatgcagatgcttttatgggagtatatatcatttgggtgaaaccccccttgaattatcagatgaacatatcctaatgctctttccattattttccccatgcatattggtcggtgcaatatgttccttgtttggctgtttgcgtggatgactacatggaacctgtagcggcctagggatagtaaggatttattgagcagaaatgttccaaattttggttgtctttaggagccatgtttgatttcatgtccaaaattgacactatatgcatgtttcacatagccttgcaacttgttactccagaccgtattaacacttacatggtaaatgcaatgcttctaagcattgggttggtctagttatatatccttcacaaaaacatcgaagtcatgtggcacggttaagtaacaacacatacaagttctattataagttggctatataacctaaattaaatcaataatttaccctccacccattttaaaatctagtccctatatgatattcagtcaagctttttgtttatgctaagacagattttcctttacctaatataacccactttacttttaagatccataaacttttctgcaacaggtgtatccagataaacttccttgataagtgcattaccttacgattgtgtcataacgcatttcctaagacatttatcatttgtcggaagcaatgggaaaccaatttatatttgtattgtaaattatactcctattattgttattacatagctggtcacactctctgtattttccctgaaggatggaaagattttagtgctttgatacagagttttctttattacataataccagagacatctggtcaccgggcgagcaaaacaactgactgaagatatcctctaatatcataactctattcaatatgttaacatttttccaagtttcacatattctcaaggataaagctgcataatttctcaacactggaattatgataggaagcgaaggaattctacaaagaggattccattacctctctgatcctgttcagcttagcagcagcatgtttcatgtccattctttctgatgggttttcctttgaacatgagacaccgacttctattacagaagataagcaagttagtatctctgcatcggtgtcatactgttccacgtgcaacagtgctgggtcaatgatttctgatattttttcaggcaaggtcatctcagcatgtaagtgcagggtcaagccttctctgaacatattatcagttggggccttccctgtgaacatctcaagcagagtaatcccaaagctgtaggcatcaccaacaacagatgcttgcccacctgctccatattctgcaagaatagaaacatgaggacaagtcgttattattttcagagagatgataaaataatggtccagaatacaagacaaattagttgatcaagaaatgtgattactgaaatagtggtgctacctggagcaacatatcctatggttcctcttatcccaacagtgctgctgtccccagcactcaaaccagatttttctatggattcgccaaccagctttgcaagtccaaagtcagcaacataagcagtccagtcagcactaaggaggatgttgctaggcttcaaatcacaatgaatcactgtcgggcaactgttgttgtgaagatggtctattgcatcggcaacatcaacagcgatgtttaacagttgggcaatgctcaacttgtgtgtctgctcatggattcttgggtgcagccacctgtccaggctgtacttgggcatgaactcgaacactagagctcggaagtcattgcctctggaatccatactagagcagcaggtgataatcttgatcaagttccgatgtttcacattcctcagagcctcacattctgccatgaaacttcgggaagaactagcatgctgaagagtgaacactttgacagccacaacaacattcacagcagatggaagagacagatttcctctgtacactgatccatattttccagctcctattagatttgcaggtgcaaaaccatctgtagcttcaaatagttcgtggtatgaaactctaggatacttttcattcaacataaggtcacttgtagcattcttcctgtccgtttgttttctccctttgaacagaaagagtgcgacgcacagaagagatgagcatataacaattccagagacaagaagcagaatcctaagcagcatctgtttttgcaacttatgtggcttgacctcgcatggaggcaaattcagttctgcaatgcccccacaaagcgcataatttcctagtactgagaacccactcatgttggcaaacaaaccatgtgatggcacctcaccactgagatgattataggagaggtctagctctatcagggcacttgatttctcaagaaattgtggaatggttcctgataggttgttatgagccaggtatagctgctgcaaaccatgaatgttgctcagctgttgtgggatgctaccggacagtgcgtttctcgtcaaattcaagatgctcaagcctctcaaattaccaagtgatggagggatgctccctgtgaagtggttgctgtctagagctaagtatactaaacttgcacagtcgccaagtgttgttggtattttacctgataagttgtttcttgacagagacagcgttgtcgcgcgcctcaggttgccaacttttggaggaagagcaccagagagataattatcagaaagcaacagtgaatcagtcagtgaagggaggctgaagattacatcagggatagactcaactagcctgttagaggataaatccaggtttgttaacctctccatgcttccaaggcttttaggaatggagccatttagctgattgtttgacaagtcaagagtcagaagttgtgtgagattgccaatggaaaatggaatgcctcctgacatgttattcatgttcagccacaataccttcagattccgaagtctgccaatatcaccaggaatatcaccaaacagattattaccttggaattctaagtcctcaattcctttaaggctcccaatacctggaggaattatcccagagatttggttttttgccatgcttagccactggattgaccttgataaattagcaataaaacttggaagtattcccccaagggtgttgtcactaagatctatcacctgaagtcgggtgcagtttgtgaaatatctcaggaactcccaatccccagcatcattagcttgcagcttgttactccccatttgaacacttactgggcacagttttcctatctcaggaggtatcctcccttcaaagctattcctagcaagacccagtacttggatttcagtggcattagagagggaggcagggattgttccagagaagttgttgccaatgccgcccaaacggagcacttgaaggtttggtaggcgtgttcctgcatcgggtggcaatctgccgtgcagcttgtttgaactgaaaccaaggtattgaagagacgatatgttgaagaacagaggtggtagtgtgccagagaggctgttcctcgaggcttggatatattgcagatatctcaagccggaaaggccctctggtatggttccttccagctgattctgatagagtgctatttgtagaagcatggtaaggttgccgagcgatggagggacagttcctgtgagattattctcaccaaggtaaagaactttcagctgcaacaacgatcccagacagctcggaatcgccccatggagctcattggcctccacactgaggaacacaaggttggaacagttgcagagcccaacaggaaggtcaccactgaagtcgttgtatgctaactcaagatagtgcaggcgatgtagctgactggtgaagtacacatctccagagagtgtgttgttgaagagatcgaggctctgaagaaaagtgaggttgccaatgacaggagagatgcttcctgcgagacctaatgaactcagatttaaagaggttaccctgcccggatgccggcggctgcatgtcacgccaccccaccggcagaagtcggagccggtactgccattccatgagctcagtgagcccaactggtctgacactgacagcgccgccctgaattgcagtagtgcttctctgtcactgtactcgtcaggaagtgaggaagaaggcaccggccagagtgtgaggaggagcatcagcagtgggatgatacgacgaagaattggaatcgccatggtttccagtgtgcagcacaatacgagcaaaggtttcctttatatggtgggtggatgtaaacgctcgtttccagtgttagcagtgtaccaggtaccattgtactgtgaagttggttagcagttgggttggttgcgctaatagacctgatcaacgtcttaaagaacgacgaggacgagaagacctgcgagcattgactttacagcaacttttctttacgctaattggaggccctgctttaattttaggagaaaaaaatataaaagctggaaattcttgtgttgatcgggaaaattcgcacatcaaaatgtgaaaaatgaaagcattttgacagttgatgtagcaaacaagctgtcatgcatttgtacggttggattatgtccaaggttgctccacgagcgcaaagccggactcagatttgcatgcctaaatttttttcgagtccggtgatgctcacaacaaatctataaacaatgaacctcgaattgtatcagttccacgaagactgtcgaaggggtcatcagtgcgttaagcggtgtgcacacttatagcataggcttgttgatgaagttgtcacgggaaatcatcgttgccgcgaccccctatccatctcactccattactgttgtattgttccgtttgtagggtcacttttttagttcaattccattttacttaatgtctctacctcgtttcgacgtgctttgccatatcccgcttggctacgccgtctctcatcatgtcttgccatgcctcgtttggctttgccttatctcaccaagcaccatttgatttcgttgcttttcgccacgctccgctcttgtaacccgactcaataggccagacgaagggcctcatagcctgccaccaataatattaaaaaatattcccactatcatgaaatttcattatggtataataaatttacttttatattagaaatgaaaactacaagtttaatctatctatattatgaatataacaatttaggtcaaatcctaaccttttacatgccatttctaacatcatatattgattatgtcattatacataacttcacatacattgataactaaattatatcgatgattgtcatgataaataaaatgtacctaattatgagttctattctaagaaaacactccaatatgaaatcgtgataagtcacaacaacattattagatctatcatgaaaactactttcatgtattcatatttttagaatttattatgaacacattgcaagaaaacaagtagaaaaggtggatacaaagctttgcgataatttgatcacatagtaaacctttgtattaaagaggctatatattaaaacatttgattaatccatcttagggtatgtacaacggtctttattagtggactctctctattaccatgcaagtaaatttggtaacatggaagaaagagaggaaaaaagaaaaacatgattgctacccatgacaacggctcttaatcgactcttagcatttattagacgaaattttgtttcatggggtgaaaaaagggaaaaagagtaagaaaaaattatttctatacattaatggttagagaccatattgtcttaactgttttaagaggtttacaaggtgggtgttttttaaatgctattttttctgaagtactatgtgagaaagtaggtatcaaaacaatttgtctgagattttctttaatagaattatcgaatgatgagttgcacttaacgaaattttgctatagtagtacttgatgaaaacatacttaaatatttttttcatgtcatgtttggacaaaaacctttaatgaggtaccgtatattattaccacgtcatgattcaattttagaatgaacaacattacaaacaatattacgtttaggaaactagaccaagaccgtgtaagaccctggttccgaaatcggtaggattggacatgcatgtgcatattaccccacttacatttctatcccgtgtaaaatggttaatcgattgttgcagcaatttccatagcatatatgagcatcaacaacaccacttctgtggactgcaaacaggttagggagtcacgggttggaggccagctgaactatgatatcttccacaggaacctctaaacttaatattaatcagtgccatcacatttagttaaatttatcgtaaaatgcaataaaattgtgaatgatcaattggacactaatataaaccatgataaaatgctcctgggtcattacgaaattagtagagatatcaaaatttaaataattggttttatattatccaaagatctttgatccattgtagtcttattccccaaagttcatatatgtaaccaaggccttgtactctttacatgtagtcaatctttaaaggaacatgaccaaccacatgacatgggactaactaactatactacgaacattttacgagaacaccatactgaaagttcccctaaaaactatttcccgtccgcatcgctcccatcccaggggcgacacggacggcgcctcattctcctccgcctcagtccttgcggccggccggcttaccctccctcctcctcccctttgccttgccgccgcctaagcggctcgtcggcaaagccagccggccgcaaggactgcggcggcggggccctctctctccccaacgaggaagccagcgcgctgggacaccggggctgctcggtagcggcggttcacggcgccggaggcggcggccggggggttggtgcggcggatccggcgacgccggaggtggatctgcctcccccggtggtggatctggcctccccgcgaccaggggctgagcgacggcggccagaggaggcgacggatgcgcgccgccgaggacggatgtggcgacggcggcaaaggcccgcgggggtgaggccaaatccggtcctcccacgggcgacggcagcaaaggtctagggtggcaacggcggtggcggaggtccacgggcagcgagatttgtactcaatggaccctaatgtacatcccaaatgttcaagatttgtgaatataacccagctatgaactatcatgtaagcgtttgacattatataaatagggttaattggatccatgccattataaattttatggttttgaaatatgccattactatttacctaattgtaaccataccattacaatttctcaaatattggagctatgccactacatacattttcactgcattttctaatttttttaggaccaaactaccccttcttcttcttcttcttccatctcccatctcactccatatatatcttctctcctgttcatcgatctccttttccactgccaagctcaacctgctgctctaaccggcaaggaagcaaagatggtgctgttatggaggaagaaaagacccacgagcaggaagacgtagtcgagcagcacagttcagaggcatcgtcaagaacagaggaggaggggatacacgcgcttgacccgagttggaagccgaggagagagagagagagagagaggatattctcgccgccggcgagcaccgtcgtacccgtgccaccctcttcgcatgtatggaggaatccaatgcggcggcggcggcggccaaacggcgagacccccggcggcgtgctccctgccagctctgctggcaacggcggcagccctcagcctgctgcagctcttcatgagcttgtcagggtaagttggctggaatagaagacagagaaagaagaaagaagatatggctattttggtccaaaatttttataaaatacggtgaaatgatatttagtgcatgtctccaatatttgtgaaattgtaatggcatggttataattaggtaaatagtaatggcatatttcaaaaacataaaatttataatggcatagatccaattaatcctaaaaataggagtgaattacatcttgggctaggtattattaccaaaatttcagtttggactaggatgcaaccaatattttcactttgggctagggaatgtaacttttgtttcagtttagacctccctaatctctcaatctctatcttgtccgctcctagctcctcaccaacgcggctatattgaggtgaggaagggagaagcctatggtgagcaggtgaggtccatctgttcacaaccgatcaagctccatatgcctaagctgcatgtgccaaagctgacttttaagtcattacaaccgctgcccctacggccaacggcgggtagtggcgttgcgtcggcgacggaggaccttcgggggtggtgggggcggcggcgaccaagttgaggtggtggcccggaacgactgcagcacccgtcggcggccgcagccctaggggcatcggcagctcccgtcggtgctgacggccctaggggctatggcggaggacggcagcggctcacgtcgacgccggcggccctaggagctgcaatgccctgggacggcggtggctcccgtcggcaccggcgttcctaggggctgcggcggagaaacggcggcggttcacgttggcgccggtggccctggggccgcgagccccgggatggcagcggctcccgccgaggccagcaaccctagtgtcagggttatggatactacacacctaatagtaattgactaagctcggcaaagcccaccacatgccatgtcttatatggaaaaaacctcgtatatagaaggagttccggataaggaaggacaaatagagttctatatggaaacgacaagaactactcggatcgtatccatatttatctccctaattctacttggacaagagatcatctatggatataaatacaagccccctaggaggagaggggagacacccaccacaatctacgaagccacaagccaatatgctgccagatctcgacatcagagatgagcctagccataccccatccggtgcctacgggagctggcaagagggatctagcgttatctctgatctcgacgagtacggattcgaggaggaagactaccgtgttgttgactatgagttggttatctaactgctaagtcgacgacaactctctaggttatcccaaatattgtatttgtgtgattcagatgaataaagagcaacaccggcttcggccaacaggatgtagagctattacctgtaatataatgggcctgaacctttataaaaatctctgtctccatctcttttacctcaatctcgcatataccctggtaccaacgatccccataccatccaaataccgtagtcgcgatatcagacgtcgacatctaggggctgtggcggaggatggcggcggttcaggtcggcaccggcggcccaaggggcagcggcgccccaggacggtggtggcttgagcactttggatagaggaggcttaggaatccggcaaagtggaagtcgatcccgtctgttcgtgtttggttggctagttctgactaaatgatgaacgacgatgattgaaagtaggctaactgacggcgtgtggcgtcaactcacctgaaacggataaagatggcatttatggaggtttgcattgacagagcactaggggtgacggtgactagatgtcttttactcgtcaaatctggtcatttcatgagaatatggcgggaaggagggatgtgtcgaccaacgttgtttggttttctttttcttttttggttgtgtgttctcctacttgttgatgtgtgagtctaagtgttatatcattttggctttgtatattcttcgtggatatagaggtcggattaatgaaaatctattattaaaaaaaaagcagaggacaaaagaaaattgtcgagcaatcgaacccacgtctgcagaaattagcaccatatacaatccttacatttattcgaaatgcagaataacataacatacaataccctaaatttgttcgaatcacatggataactcacccgcacacaccgtcacacacacacatcacaaacttactttaattaggctgatgccccaaactattggctccttaagcaaaactacctgtaatcagtcccagtgacttgctcacaatactagaaatggactcttcatgctcaaaagcaccaacacccgaatggaacaacaaaaaattttcaatctttgttgccgtctctgctgtttctttaagtatgatgtccatttcgtgcttcttaaacaccacaatatacgccgggttcttttccatcatccaattcatttgctgaattacaacccttcttacccctggaaaatcagcagttggagacttgtacacagttaatatcatcttaagcttcagcacgaactcgtcaactgtaatattggcactcctgagtgcatcggtgaaaaccatttcatccccgttggtgcaaatttgcacggtgagcccaataaaggactccagtagtttgcctttgccctctgcagaatctattagctcttgcgcctgcacatgcacccacgagtttaaatacatctcgtttccacagcacgatgagacttttaaaggtgaactttcaatttaaaacaactgaagaaaagtttttgctagatccctacataaagatgggaaaattctttatggaagcccttgcaatctgttgttggaacatctggagtagaagaaatgatctcatatttaatggtgttcaagtaaactttggcaaatggaaatcagatttcaaagaggattttactctacataagcatagagtaaaggaagttgacaaaccaatttggcaatcatggattcaaaacatagtttaattcttgtctctttgttgtaacgctatccccctgtcttatagtctctttcttgtatagctcttcatgtatttattttcttttaataaagcgcagtaggagcctctcctactgtttttcccgtcaaaaagaaaaagatggaaaaatggagaatttatagtattcttacatgtgaagaatgatcatcagaagaatctgactcaatttttgactctgctaggtcgatcgtctctagtacctgtgacaatattgtagcttttataagaaccataaagtttatgcaataatgcaatttgttaaacagaagtaatatggctttcatttcagtaggagtacaaagatctggttacatcgaagaaatttataattacttcatctatatcataatttcaatctcaatgtataaaatcttggacccaaacatacctttggcagtgctttatcaattatcttgaacaactcagtgtattctgctccttggtaggccctaagattctgcaggagtttccctactcctatcctatgatctgcagactcatcagagagtacatgaacaatattttccatgtcttccaccattgtttctgccagtatggcctgaacattgctttctctcacaatactgagcacaatcttttctttaaaatgagtagtaagcaaaactaacgcttcagttgctaaagtttccatcatctttctagggatgggatcttgaacaacattcatttctcctgcgaggaaagagatgagcatccgaacaattaggcgagagtttctgatctcctttcttgcagtatcatccgctgctaagaatgcaaggattcctgttacttgaacaagcagatcagcttgttggctttcagtatggtcagttagcaactttttgatgacttccatgatgtgcaaatttccagacacttggcgccgaagctcctccccagcttcaccagcttgagccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaccgggccggcccatttttttttcttttcccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacggacggtaaccgcggtaaccgcgcggttaccggcggtttttcacaccctggcttgagcaaggccttaagtgagctatgaactatttcaaagtcaagtttacagtccaatctgccttctctggtgagttcaataatatttggaatcagatccttggcatctttcacttgtgtgcagttgtcctgatcatccacaagcttctcaagaatctgcacgccaagcagcttgaactctttcatcacagtgattcaggggcggatctacccattaggcggggtgggtcgaccgactcagctacgactcgtgttgccccacactttcaagaccaccttattcttttatagtagtcatggaccatcaaaattaggtataacaaggtataaacatccaacagattgagacacttatacgaataaactattaatacgatatgtgttgtgttcgattgctcttatcgagtgaacatctccgttctccgtcccatctatattttaaagctgcgtccgccactgcagtgattgggttgctggagctttcactgtttgtggcccccttgtttgtgctgagcagtgaggagattgcaggcaggataccaggaaagctctccacctggaggtcaggcgcgagctccagcaatacgcgtgcagcatgccctcttgtgtctgtatccatgtctatcttcaagctcagcatgtggactgccatctgaattgtgccaatggaaactcgaatcttcttcagcaccctctgtttgtacattttgcttctgagaaggtggtcgacaatacgaaatcctataagctggttctctattgagtcggaacttagcagctcgtttgaaaagctaaccaaatccatgctgaccgcaccacgaagatcaccactgacgcatttcagaagacattcctcaacatagcgagcaagagatagcacaccccaaaatcccagcttatatgtgaggccaactcgtagcatccgtttcaacgggtttgccaagatcgaaaccaggaaatagacaatgcactgggagagcgccaatccatagaagatgttcagggaccatctgatgttcttatggtcatcgttttgttgatagattggatcgacataatcttgccttttcaggcgcaacgaactgataaccatggtaccgatcactgcagccagctgtgcatatccaagggtggtctgatataggaccgccaagcaggagcgaccattgatgaaggccgaaaacaactccaaaaatatttttgtgtagtcgtcaggcttctcttcgtcgcttctatacctccgccagcttccgcgcccaagtacagcaattctgtcagccttgatgattgcttcaggaaggccaatgaagaattggtcctcgggtttggaagtgttgaaaaacctgccaagttaaatgtgattatgctaaactagtcaaaaactcgtggatttgcacgaactattaatttaacctatatttataaaaattaatactctcttcgttttatattataagtcgtttgacttttttttctctaagtttaattaaatttatagaaaaaattggcaatatctaaaatatcaaattagtttcaataaatctaacattgaatatatctattatctattctattatattattaaaacagctttgaaagaaggcaccacgttcactgtgggggctaaaaattaccacattaaacggagaaaaagaaaaaaaaagaaaagaagagtccaagtagaaatacaatcttaaaaatagctgaaattcggaattaaaataatcaatattgaaagaaggttccacataagaaaccaatacgagattaatcaaaattcgaaataaaaataaaataaaatccaaaattagaaaaaaaaagggagaatccaagtagaaatacaatctaaaaatagctgaaattcggaattaaaaataagcaatattgaaaaaagtttctatataagaacccaatacgagattaatcaaaattcgaaataaaaataaaataaaatctaaaattagaaaagaaaaggatagtccaagtaggaatacaattttaaaatagctgaaattcggaattaaaaataagaaatattaaaagaagagtccatataagaacccaatatgagattcattaaaattaggaataaaaataaaaataaaatccaaaattagaaaaaaaaaagaagagttcaagtaggaatacaatttaaaattagctgaaattcagaattaaaaataagcaatattgaaagaagaatccatataagaacccaatacaagattaattaaaattcagaagaaaaaaataatataatatccaaaattagaaaaattaaaagagagttcaagtaggaatacattttgaaacaactgaaatcgaaaataaaaaaaaaagaacacaatacgatattaattaaaatttgagaaaacaaataaattctgaaactaaaaaaataaaaataagatttcaattaggaatacaatttataaataactaaaatttgggataaaaataaagactatcgaaagaaaagactatctaagacacatgatgagataaattaagtaacatgcctataaaagagtagagtggtggcggttgatacgtcatataaaaattattaataaaacaccaaatagatcctaatgacgattaaaaggaggagggataaccggtaggccgtgaagcaaatgagaaaggtggttgccaggacttctaaaaagtaaaaaaagaaaaccccattgattatcatattcgatttttaaaatctcaatgattataaaaaggagaagcagcgagcgaggtgtataggagtatagttgcagagccgccaacggttgatgagacttctagaaaataaaaaataaattccaacgatagttatgttcgatttctagaatcacaatgacaataaagagtaataaagagtaggtggcggacgggctgtataggagcatagtggcatcgttttacaggacttctaaaaattataaaaaatgaaacccaacaagacaataaactctataaactacaatgtccattttttaaaggttcggaacttctaaaaagtaaaaaaaaacaatgataatcatgttcgattttaaatcttaatgacaataaagaagggaggcagcgggcgagccatagataagtacaatgtcaaagccgctgacggtttggcgggacttctagaaagtaaaaatgaacccaaacgataattatgttcgactttttaaatgtcaatgataataaagagaagagacagtggacaggccgtagatagtgaacatgccatagaggagtataatggcaacatttaacgggacaactagaaattataaaaacgaaacccaacgtgacaataaactctaaaaactataagatccaatttttaaatgttccaaggagaatgaatagaaatagtaatagatcgtgcaagcaaataaaggaggagatgacaaaaagggtagcaactggtgtgacttttaaaaactatataattagaaacacggggacgataagatttggtctttcaaagttttaagacaatgagatagctatttaataaatttaaagtaaaatcatacttaaaaaaatatatgattttgtttgggtgctagccgcgcatttgcgcgggccacccagctagttttaataatatatttgttttgcgttaaaaatactactatatttttttattatcttagtcaaacttaaaaaagtatatctagaaaaaaagtctaatgacttataagatgaatcgaacagagtattaatcaaacatctattgaatacttttcagtacattcgaattcgcatacaaaagaactctcttctcaatttgcggtccttgcggatcatcgaccgtggccatggctagttcacggtgccctccgtgccgccgacggcagcaggccgggacaaggacgtcctcatgtgtttgatcgttgattcggatcacggaggccggggagagaggtgcttcctcctcgtcctcgttctccatggccatgattcctcgcggcgggcggctggtggctcacgccggcatgcgcaggcgcagcctcactggacgagaaaaagacggggaggcgcaggaggacgggattcatgggtaggagaggggcaactggcggcggcccacaatatcggattcgtatctttatctacaatatcagatatctcgaccctctagttataaaagtcagtgcgatttatctctctcgacggttttactgacgtgacagtgttaacttgatcttcatcctacgtaatgcatatgtagcattagaataaaaaggtcatatgtggaacccatttatgaaacccactaacatgtggcccacatgtcatcctctctcttcaacccttcttcctcctcccttatctctctctttctcctcccttcggccatggcgcggnncccgaacggaagggcttatgcaagaacggacggcctactcgccaccttcaaccccatgaccgggaagaagtacgagctgggatactgcaccagctccgacgagccggagccacgggcgcatcgttgctcgtggcatgggtgggttctcggaaaggagggcgacgacgaggttttcttgctaaacccaacgaaagggcgcatcatgcatctcccgccaatgacgagagggcccttcttcggcagcatatctttcacctccgtgctgggatcccctgattaatttaatggtggtgtgcgccagcgagtggcaaggcatcgagacaacgagggtgaagacaggcgtcagggagacgaggactggacagcgaaagacttcgaccacaacccgccgtttccactgtcttttcacaaccctctcctgttcccgttcgacgacgagtgttcatgttcaacccgagcaacatgacatggagttttattgagaagccggagccactctacgacgagacggacatagaatggaacgagagctgctatctcttggagtggacaggccagctcatcgccatcttcaccgcgcttattcaggggctcgccacggccgaagggaaaaggaaagagagataagggagagatgagaggaaggaggaagaagtgttaaaagagaggatgatacgtggccctataatattctttttgacggataaatgggtcacacatattcttttaattttaatgtcacataaacgccacgtaaaatgaagactaagtcaacactatcggtttcaatagctcggggagatatccacttgtggtttagggatatgaatatgattcgaccgttaagagagagtccaactgcacttattctggttattattgagacattgagctcggctgttgtgggccttgtgggctgtcaggttgtggccgaatcaggccgaatggcctatcgggctgctattgctttgctatggttttgtgggctgtacctcgttttcctcgggatatttctgccgagccaggttaagagagttttcaagttactttctcatagtacttattatttttttaataataatacttattgttttggataacactattataaaactttaaaaactttaactataaataacatctgaaatatttgtttttcaaatatagtaaacatatatatgtatattggtctcaaaaagtgctacaacaaaatcatatatttattgatatctctatatatattgtaataaaaaaacatgtattaccagcccataggaagtactcactactaaaaaacgattttcatgtacagggacccatttaaattgcaaacggattataactggctgcgtatgtgaaaattgtcctctattttcgtgtgcggctccttaagaggaccgcacggaaaaattgatttttgcatgcgcacatcttaaatggaccatgcacaaaagtgagcctattttcacaagcggacctattaaaaggtccacacgcaaaaatacccctccctcttttccctcttactcactttaaattttctcctctttctctcctctcctctctatctctttctcttctctcctctcctctttttcctctcctttctacgcggcctcactcctctcctctcctctctcctgacagcgacagcggcagcggcgggtgtaggcaacggcggcggcgatggcaacagtgggtgtaggcgacgacgacagaagggatgagctacggcgcgcggcggtgtcctccacgctctaccgcgcacggtgggccccacagttaggatacgcgtaggctacgatagcataaatcaaaattttctatcgcgtaaatcaggaaccatgcaagtattagatcatagattgttaccactcgacgcgctgcgcagcggaagaagacgctgagaagtcgaaggaactctcgcgaagtagcgcgtgtcgatgtagaggaagtagtcgatcgcaccggctcgaccttctcctcctcgtgcgttctcctcgccgtactcccacgccgatcagcaccgcaaaccagtggcgcctctaccggtatccacacgtacagggacggaacgccacgcgcagatatgctagcacccgcgcgcggctagggttttgctcggggagggaagtgacggctagggtttctcacgtgatgcaatacctccgccggtcacacccctcacgaatatgtaggatccatcactcgggcctccaaggcccgtatgacttctattcggatcctatccgaattaagcttatattggatatccatccaatccccttattttcaggccattaattgtgcgaccctgtaggttcatgtatactcagctgtaacccgaaaaccctttttcgatccacgtgtcaatagcggcccccagcagaacgtattgacccaccgggcatacataaaaatcatatcggctgaacctctagtgtatacttgtataaacccctttgcctcacaatattgattaagctcaaggctagatatgtgccatcctctaatagctcaattattcactcgaacctgttaatagattatataacttgtgattgactcctcaatcacctttggcatggccatgcacttccataatctacaacatcgaggggcccagacatatctctccataggaggggcaaatcccatcttgattattcatatcccactacatgtttcatagcatacccgaaaactacttttataactacccaattacggagtagcgtttagcagtccctaagtaagctactacacatgttgagaatcatgataatctcagatctaagaattcaacaccaacactaaatgagatcaccgatgacacaacacatatggctcttgtagtgtctcatgttgggtctatccaacaacatgttcaccaacatgtgtccacattattaatttggtatctctataccatgatccatgagacatgatcatcaattaatacatgtgctgatcatctaaacatatttgttccgcatatgatatttgatcagggatcctttagaaatagcaacacataacataaagagtctcatgaaagaatcacatattcattaaccaataataagttatctatttcaaggaacaatgtcggataaatatcactactggagaaatgatctttggagggtcgagcgatttccacaatagtcccggttctaataagaaccgggactaaagattgtttttagtcccggttaaaaaaattgatctttactcccggttggtgttatcaaccaggactaaagatgatctttagtcccggttcatcctctgtcagaagcctgacagggggccgaggatctttagtcccggttgataataccaaccgggactaaagattaccactttagtcccggttggtactatcaaccgggagtaaagatcatttagataccaaccgggactaaagatttaccttt

SEQ ID NO: 78484 - DNA, 11099 bp, Oryza sativa
cgaaatttcagggaccatattagcttattcaccccaaatcattagtcgaccatgggatatttgtttcgttataaatccattgaagttcatattttggcaattaaccatattttgactaaacagacaattgacaagaagatcggtgagttttctaactgccatattgtttattctggaatcgatttccagaaggttagttttcccttatcattttctaatctgttgcatttaagtaatatcactataatatttgcaatagatgaatctgctggtgggtaaaaaatgctcttatctttggtagaaggagcattttagttgatatcattgtgaaatatgccttgtgtatgtcacatgttataaacatgtatacctctatcatgtgccaagaatgcattacaaaaatattgatgtttacttgcaactctttttaatggaataactacttatcaggtcagtaaattttgaggcatacctttgttctaattaatgaggaatacatccaatgtgcataatgttaagtaacgacgtcatgtagggaaatatgggtattttagtttactaaaatctgaaaaagcatacctttaatttgtggtgctttatgcagagacaaattaaggtgctataacctcttgctctgcatcttactccaccgccaggtctgctaccctattgttccagggacatatttgcttgacacttaacagtatatatagatgcatgttaaattattttaccttcaacatagattggacatgtgcacgctactcatatgtttgtattagatgatttgccaggccgaaacgtataatactagctgaccatgtgtttattaaaatgcttcagatatatcattaatttattttccatcatttagcttcttctttcagtaaatgtgatcataccaagagatatcgagatcgtttaagctgaaaatcccttattaaaaaatgatcattggtttcatcatatttattttatttcaatgatatgtttgcttatgtttcattcatggattggaatttgattttcaaaactaattgttttcaagctgaagcctttaatcaatcaagacgatctggatgaatgatcccgcttcagtttggagatatatgaaataattgcagatttataattatacattcttattacttctaaaacttagtattctttgtaaatggagatgacaacaatgttgtatttttctgaattctttgttatggttctacttggtgaatttctatattttctttaattttcattttgtatggaaataaaaatgaggcgtcttctccatttcaattatttattcatgtaacatggatttcgtctgcattgtttactctgaatctctgattgaacgctctaaggtgttgtctattttttattttcaacatgaatgaagttgcaatgaagcttacagttttctttgttttatctttgaaacaaaaaatggaccttattggacacaattttcactgccaaatattaggttaaagcaagatgtaatgcatacatattgattgttcacctatatatattaagttgaagcatgatataatacagagaacgtgcattgcacgtgcatgattactagtcatcaataaagcatggattgatccaaccaccactacctctccattcttgtcaccagcattttcttcatgtgtgtcacatctctctatctccccctctcgactatcaacctccatggtagtcaagaatttcttaagaaattggtcaagatatttacttttataatagggctcaaactctcgaaatgtcgcatccatactcacaaacaatctcctcccaatgggatcccaacatttataccccttctgacttgaagcgtagtcaacaaacacacattttgttgcatgaggatccaacttgccaccaaaaggtcgatgatctcgcacaaagcatacacaaccaaacacttttggagggaccttgaactctcgcttacccaataaaagttcggtaggtgacttcataccaagtatcctagatggcatgcgattgataagatatgcaactgttattacagcctcactccataaatactttggcacattcatttggaatattagagatcttgcaacttctagcaaatgtcgattcttcctctcaactacaccattttgaggaggggttacagggcaagtgaataatccctttatctgagacatatgacacaaattcattattgatatattctgttccattattaggccaaataatcctaacttttgcatcaaattgagtagtcactaatttatggaagtcctagaagcatcgaaagacctcactcttgtgcttaagcatataaatccaagtcatacgagtatgacaatcaataaaggtgacaaaccacttgaaactactcacaaaagtaactgggcatggtccccaaatatcagaatgtattaatatgaatggttcacagttatgaaggctaattccaacatatgtaaagtgagtatgtttgctaagctcacaagcatcacacaccagtctatgcttatccactctaataaataggtctggatacaacttactcaaaatcttaaaagatggatatcctaactgacaatgaagcaaaatgatctcctaccactgcagttagtcccagctcctcatgattgatgtaccacaacccatcacgcctgtaacgccccgattttcgttcaggattaaaaatcatttaataatgcatttcctagaaattaaataaaaatttaagcaatttatttgagtgaattaatgggagaattaaaattttcccttaaaaatcattggccgggaatattttgcaatattctttgtgccctaaaatactctctgaaatttcccgtgaattttcggagctcaagaaataatttaaatagcacaaagttcatttaaccaattagaataaaaagaaaagaaaataatcttccccttccttcctttcgggctcggcccaaattcctcccctcctccttcctaggccgggcttcccttcctcggcccgctcggctctctctcttcctcaagtctacatttcctccctagcccgttttcccctccccctctctccgacaggtgggccccacatgtcatctcctacctccagctccatccccaaccgccgccatggccgccaaatcctcccacgtcaccgcctctcccgcgcgactccctctcccgcgcgtgcgtggacgcggtcgtcgcccacgtccgcgccgtttccccccactctccccgcaaaatccggccacgtcgccgcctcccgcctctctctctcctcccacatcgccggccggtttctacctctctcgggctcgatcccgcctcccctcccctataaaaacattccccgcacctccctctccatttcccccctctcccgagccctcccgtgcacgaaaaccaccccgccaccgttgcacctcccgccgccgctcgccgacgaccctccagccggtcgccacagccgctcccaccaccgtcgttccgcgcgaccgccaccagcggcttcgccgcgtcgtgccacaccccggcgtccgctccatttcccctccccgcctccgaagcaccatcgccacgcgcaccacctccttccaccgaagccgccgactccagccgccgcttggcgccgctcctagccaccccaagtcgcgctgtcgccgccgctcgcttcgcagcgccgaggagcacctcggccgccgcttttcacggccgggatcccgccggaacacggttcccctcgcgccggtgagcatccgccgcccattctcccctccgaccagcgattcatgccgctgggagccctctctccccctcctaacctctcccccatcctccccaggtccttccagccgccgtctgccggttcccgctcgcggaacgccgccgggccgccgttccgccttcatcccgaggagcgccgacgccgagctcccccccccccccgcctttccccgcccctcatcgccgcgtccttggtgagctcctcctctccctccttgcctccctcctctgtctcccgtgcgcgctgtcgcgccggtggccgccgccggcgaccaccaggccgtgcgccgctgccattaggtcggccggccggcttgccgccgccccgctcgcctgggccgcccggatccccttgccgcgcctcaccgccgctttctcgcatgcaccggccgtcgccgcaggaggccgcgccgccgcgagccgtcgctcggccgggctggcctgagccgtgcccgtgctcaaccgcgccacccagtggtcccggtccacggtggaccgattcccttgacccgctgacgtgtggggcccgcctgtcggcgccggcctctttgatgacgtcagcgcttaagctttttcctttgagaaaataaataataattgcgcaataaatcgagtttaattctagaaattcatttaaatggctcaaaacttctaaaattcatacctaattcattcgaactccgaattgagccattcaacttgcaaaattcatctaaaattgagctctacatgtttgttttgtttttatgtactattttcttggtttttattagagtttttcctcgttttgcatgccagcgtgtagaatccgtcatttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggtttttctagtcgcacccatggcaattaaggaccggttcgcgggatgccctggaagaacttatcgtacttaccacaagccagcgtgggcaacggctggacttatagtgtagctttcctctagctgacgcatccaggcaagggtgggcgtgatagagcggggcaggccctgcgacggcctctgtcgcttccggattcacctaggcacgagaggggactgcccgtcgcccgctagggacgggggtgaaacctgaggtgtggtgtgcttggctagagggggttatgtgaagggtcctgtcacggcctctttccggtatgtcatggtggcatgtcggcgcacggtaacgtgtcgtggggctgtgtcttgtgggtacagttgtacacctctgatcagagtaaaactattcgaatagccgtgcccgcggttatgggcggtcgaccagattcaccgtgattagtctcatacttaataaatcgacccaatacactgtagttcaggtgggttgattgggcctgttcaacgtggtgtagcgttgatcagtggagatttaatgttactctaattactcaacagttttactgtttcgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagacgaagttagaggaccaaggctcagaccctagttgagttttgcctgtggagtggagctgaagccctgctaggatcgcctttttccgctgctgctgctttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctatatttctgggcgtgacaaagtggtatcagagccaacttgactgtaggttgagccaaacggtcaaaccctaaggacaaactttctgaaaaccctatttgcaaaatgtctcctctcgcccttcggcatttccttgtgaaatggtttttaaaattctcctccctgtccctctaattcttttagctgtcaaacctgaaggacaagccatcagctttgtgcatgtttggaagtcaagtcaagctaagcctcaagcttcgtgcaaagagcgagaagatctgtccagagtcatcgttccgcgatgatcaataggagttttcccggagatgacctaaacccaatctttcccagaagagtagtttcgttagcttctagatcgtgtgttgtttgcttgtgtgtaggggtatggcttgcatcattggtagggatgcaaccatactaggttgtttgcttaagcaacttaaaccataaaaatctactcacaacagatcactaggtaagtggtttagtacctcatctctagtaaccccacccatttccccctctctctggtgcctgcagcagatggtcagcatgagggacaatttcatcgaatcaggaccctgtcagtttcatggggcaactcagtgcaattctaatagtattccacatcagcctcttgaagatcagcctcaaccccaagtcatggctaatcaaactcaaacagtggaagagttgttacaacagatgcgacgtcggtaccaaatataccagatgcaacggcaatgtcaggagtcgcgtcaatgtcaccaaccgcaggtgcaagtccagatgccagcccagaacccgaatcagagtcagagtcaggagttcccaatattggcaccgaagacccctgtcaaaatgctgtccagatccccgaagataacgacagccaagtcatcgtcagaccaaaggaaagtaagtgctacctgttatgactgtggtgagcaaggtcattatgtaaggaactgtccatggaaggtgttcgccaggtcgcctcactctagtcccaatcctccttccagtccccttctcctggaaaagacatgagttctcatcaaatgcaacaatgcacttgaattggtcaatagccgagctaaccgagagaaggttaactggaatggaaggaacatgcagaacaaaagataaatttattgatgtgcactcaaccgaccctataccatgaatagatttggatgtaccatcagcaatttggatagttttggagtggacataaggggtgtatgatgtgaaagtattatggaatcatgtggtatgctttgatgttcctgagtctatgatccaatctataggatgtctatatgtagatgcaagtgcttgtgcctgagtacctttgcctgcttgggtatggctagcgaagttaccgaagtaagtggtggtgttagaggtttcattggtcttgttcttctaccattcctcccactgtgtaacctgtttacccgttagggatatagctttaccatcctccatagctgcattagcctgaggtgcacctcggcctctaccatgatctccaatgcgacctccacggtcacctcctctaccaccatggcttcctccaaagccaccatgatttccaccaaatccaccataccatcctcgcattgatcccctaccaccactgtttcggggagtgggacaattgcagctcacatgacccacttggccacaattgtagcattccctatcatcagctacaatgtatgctgatcccataggatttgtacccctcatcaattttaacctcatttcctcctgtaccatggctgaaatggcctcttccatagtaggcaaagtagcctggtgaaacatagctgctcttctatcctcaaactcattgttcagccccttcaagaaatgaatgactcttcatcgttgcagccatttatttccaatcacaatatcttcatcatgcttcagttgcaggggatcataatgatctaaatctgcccataactgttgcaactcgctagcatactcttgaactgttctcccttcttgtttcaaattctctaccttgttttgagcctcaaccatcatcattacacttccctcttctgagtacatgctgctcaatgttttccatacaactgctgcattttgaatggtttctagcatccgagcaatagatggagccaccgaattcctcaaccatgacaccacggttgaatttgtagtattccacatcctccaagctgaactttccttatcagcaggctctttataatcctcctgcaaaaaatgatccaccccttttgccctcaacattagttgggccctccttgaccaactcaaacaattcttacttccttccaatctcaattcatttggcatcaattctagtttcaattcggctgatcctccacctctagtacctatcattcccaactttactagatcctccaacaaatctttcatctcatcctttatgacaagggatgatgaagcaatcactacttctttttcctgacttcccacaacaccttccccttgcatggtaggatccatttcttcctcacaacagagtattgaaccggaccaggcttcaggcccctctatcaccaaaaacaaaagacactcacctcaaactaacacttctgacagccttccctgctgaccacacatcccaaaagccacacagagcagcagcagcaactttctcctctcctccaccacacaaatcattagcagcagccgcctctcctcccccacacaaatcaacagcagtagccaccgcctcctttcgtccacgcgttgtgagggcgcacaaccccctctagccccccaggatgatgagccttggctatgactatggatgaagggaagggaagggattgggtggtggagtgaggctaggatttggctctgataccatcttgctcgatttggggaaattttcaaggtgtgttgcttctcctacacaccccctcctctattctattctctgaacattttacaaataggtcctagtcacaacacatatttataccaacaaaatccttatgtgtatactgtgttagtcccagatcaacactagcacgcacggtaacaaaagataatataacaaccacatcacaattttattaataaaaaggaattaaatataattttgagttgggtcttaagaccaggtagggcttgttaatctccctcaatcccctccccacccccccacccccaatttgtccatgaggattaaacgaacaaggcctaagtgtgtttagattgaagcaattggcaaaaaacgaagagcattcttgtggacacgagaggatacatgggacaaagtttgcctgccgaacgacaaaggtcgttcggggggataaaagacctgaagcttcagaatgaggcactgctcatcaagagatcgttccagctgcatcaatctgattcatcatgggcaaactggatctggagcaaatatggtgaaacctcaattgtgaaagaactctacctagctactccattggcgatcaatgcagaacctacttgaagctctgcagacactttcaactgttcgactaggggatggcacatgcacttctgccttcactgccactttgcgcgcctatcctgggaagccattggaacccgctcgtcaatacaggaggtgctctcaattactgcctgaagccaacgccaagactgcggaagagtgcactttcaggtgttttacctcatctgcatttgggttctgtggaacaattgacatgacgtcatctttagaaattcgaccttgtccatgggcaatgccatgaggaggtgcattgatgaggctggcctatgggccgagcgattgaaaagaaatgatagatgagtctatgtatgaaaaaaacttgttttcttcccctctccacactctcaacaggatgtaacccgacaatgttgcctttgttttctcctcccgtgacttagttcaaaaaaaatctgcaggttttggagttcatttgttatttctcttctggatttcacttaattcaaaatatttgttttaatctttttccttcctgggcgacacaatgctggtcagtttccacgccaacaaactatcacccatctctcatctcactgagattgtgccgcacctgtcagggccactattgttcattcctgatgaggaatctgcatacgtgccgcaggatcaaaattcgaaagcccagatgctctagaattctggattccagtggaggatggttcatgttgagtttattgtttgcagctatgcttgaaaataaattgatttttaaataactaagccagcatcaaccctagataccaatgtgatctcctttctgcccttatttaaaaggcattgttgatgaacgtgttatttgcatcaaatagataaacagaatattcaggtccaacacacttttattaactaattccgcaattagtttgatttaaaagtaagatatggcaggaagaaagtgcagaaaatgtacctttgcagctgaccttgacaactgatgttgggaaattcaacaagttaatcattttcctccagtgtgtaacgatggaattgcactcactgcccaacagtgaaaacaaaagtgagatcatatcaagaaactatcacttctgtacaaaggagagtaggacatggccccaaaatggaattgtcttaagagtaacaactttcagatgccatccactttaatgataaaaaatgggatcgacgaagaatgatcccagcaatataatcttcatggaacttgcaaactccaaatccatggagctaaatgcatacttcgctttaataccttaataacagaaggaaaatcagtagtttgaaaataattatttgtttctaaagataacagtacaatagagaaactgaccatatttggactggtgaggagcaatgcttggcattcacaattctctattgcaaatttcaggcatctcaattatatatcagaaaagcctgtagtattaaacagaaattatggctacaatagttcaatgctacatgccatttgttgatttcaaatatgctaacaatgccagcagggtttgaataattgtacata

SEQ ID NO: 78485 - DNA, 1149 bp, Oryza sativa
  unsure (1)..(1149): unsure at all n locations
tttagaatccaaancgaaaagaaaaaagagaacatgttgattatagaaaaattaggaggaacctagaattagagtcttatggccaaggacactattgctgatttactaccctctataagaaacgcgaacatgaataaaaaaggaacaagtcatcccaactcgtattagctatcgaaaagccgtacttacttgagtttcccgctttccataacgaatcccccgctgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggattggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacatagagaaaagaattgatagctaaagtttgcttttagtagtttagtcaccaatcaaaaaagtagctaggctgaagccgaagcacattccctagcgtactagcgtacgagagaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccaataagcttcttttagttagccaagcgggtcatgtggatgggtcaagagatgcgtacaatccgtcacaacgaagcgctcacccttccgctggggtggtttggtgaatgaattacanacatgtattagaaaaaatttacttttgggggaaagaggataacctccattgaaagagagcggtattattgttaggggg

SEQ ID NO: 78486 - DNA, 1199 bp, Oryza sativa
gggttactttattcccggccatttggggaatttggaggaaactttccacaggaacagtgttcccttttcgccaggcttttggtaccttaaaattccaattattctaaagttggtccaactcgtgttcattataaggcccgcagggtgttgaattccgcgaatatcccgaagtagaggccccctaggtggggtttattattatagggtgacagggttatattattcccattccattattatttgttcatacaaaggttaaaaggcaggttaaataaagcagtgccacggcgggattttaattaagcgataatgcaattttttaatcaacaatattttaccaactgggattccaatatgttcaagatatatgtgacttgccttgctcaagaagaacgggcttcgggaactttgggcagcgaccgcaaaacacggcttcgggaacctcgggaacgacgaaaggttcgcgaagcacacaaacaaagctacaagcgtataaagaagcaataacatcacataaaaccaaagcacagggttctttaggttataacaaacattaggagacttgaacgggtcgattcggagctcgtatgcccagaatatgatcatccgaagtttaatgctgttatatggagatttgcgaattattataattaagctttgctattataaaacaggtgtaagcgctagcctggaaaagacaggaaggctgcgctgttgacatgcggaccccacatgtcaacctaaaggaccgcggtagaccgaatacacagagacggtccacgggtcgacggaagcggaccccgtgtgtcaaccgaggcgagtggccaacaaacggactccactagacaccacacggcctgcacacgtggaaaccacgcggctaccgagcgggcacactaacacggtcaccacgcgcacaagcgaacgtctgccgacgccgatacacgggtaccggggccgacaaccgcacaatggcacgggcgacaccgaaaggacgaggacagggcagcgagggagagggaaccttaccaccacgcgacgaggcgtgggagcgacaacgacgaacgggcgcggcggagacagacgggcacaacggagacgaacggcgaggggacggcttcggcggcgatccttggacgaaagcgagctgcggccggcacgaggcttgacgacgcggagccgaggacgaacacgaggac

SEQ ID NO: 78487 - DNA, 6534 bp, Oryza sativa
caactaccaaaatctctccaaaacatacccttagagcttttataaaaccgtgggctctcttatctatcgtagagctagagcttcaagatgccaatatttgatgtatggaagatgttaatagggatgggaagaacaccggtggctcgagaaagacatagttagtagaattttttttcagagataatgaatattttgtaaataaatgaaagcatttggcttctgcacagagttcactcagttgaaacaccatgaagcatgcaaaaggaaaaaaaaaaagcaatacggggaaacttccctactgacttgccccggtgaaggctttcacctctatgggcctgttatgtttagagaaaaaagagagtaaaggattcgaatcggtaaagattaattcctctagtgtcatttgctttggaggaatgaaatatactagaactagagataaattttctttcctacaagtcatagagaaaaaattataggaaattttctattcaaaaattcttttaaatttattttgtatgcatttctgttcctatagattgaaattcgtacaaaccaaataagccctaaatctctagttgagaacatggaatcaaaggatggtggtggcctctctcttttagcctccccatcccgctcaccaccatcaccttctttgccgccagagccaagcccttccatccgccgttccggccatctccttagctctctgcaccggccaacacctttctcgagtgagccaagctcaggaacacattcaaccgccggcgtcaccacctcccaaccaccggagcactggtgccccgctcctcttttccctctgctctatatgcgaagaaagaaggaaaaaagagaaaatgggaggatggacgaataaaatgaatctgacgggtgggtcccatgtgtaaacgtgaggaagatggaaaatatgatgacgatgacatggttctaattttgtaaaatttgagtggcacgcttacgaatagacgaattgtaatgacatttttctgaatagccacatttgcaatggcatggatcgaattaaccctaagaattattccaaaggagacttttttatttatacaatgtaaatcctccaaaaagaaattctctattttcccttagggcatcaccaatatttactacttctacctaatttgtgaataagggcaaaccttgcgccagtgcatattagttgttgtagtagctaaaatggtgaaataacaaaagtaggttctaaggtgatcccacagccactagctatgagagagggtgaatttttatttatttatttgttcattatgacaaggtaataagcatattatctatggccgagtttagttccaaaatttttctttaaacttttaacttttctatcagatcaaaacttttctacacacacaaactttcaactttcaaccaaacttctaattttaacatgaactaaacacactctatataaccgggctgtaataggtattttattgttactcccgattgtggatgcgcgcttggttctctctagtcaagtctcccaccatcagatgatcagacgcgccaaaacgacgcagcacgggcagcaacccccgccacaagccacattttgttccaccactcgccagcaacgtcccgccgctgcgatggcgacaccgctccagtccagtctccccctctccagctggtggtggccgcattcaccgacggacgacgggagtaccccaccggcgccgcaccacggccacgtgacctcgctcgccgacgacgcatacagtagtactcctactcccgtcgtaggaggagagtagccgtagccgtagatacctcgacggtctactacaccctagagcccctacgactactactagaggctactagccgtagaagagaaaggcgacgcgtgacgcccaatcggaagcctcccccaccccatctataggcggccaggccagtagatatagggtgcagcttttatcgcgcttctgctgctgcagtctgcagacggcggccgcagcagaagctgccctccgcccccacaagaagtctcgatcccccccacactgctcccaacgccaacgcacagaggaatttcgagccacttcaattccacgcagaccacctctttcactcttctcttccctctcgctttctttcctcttgaaaaagatagcgagagagagagagagagaacaagcagcggctatagctaggggggagagagacgaaaggaggagaggctagggggtagaggctagtaagcctagtatagaggggtttctttcttttttgcttgggagagagattcttttatagtgggaggagaaagggagggaggaggagtactaggctctactagcgccgtagctctactggtgatcgaagtggtgcgcagcagcagcagcatcttcgcggtattctcgcgcttttctcggaagctggtttttacccggtcggaggagagaggtgagcaagcgtggcgtcgtcggcggggcggcgcttccagtccgactccggcgcgttcgcgggctgggtcgcggcggccggcgggggtggcggccgaggggacgacctgtcgctcgggttcaatgctgcagccgcggcggctgcggcgccggcggccgcgtcggcggcatcgctctggggacctgtcgccgccgcgtcgtcgcgccaggcggcggcgctcaactacgggttagccgccgcgggcggtggtgacgtcgggatggtgctcgtcgcccccgccgcgtcgtatcatcaccacagagccgccgccgccgcggcggcggcggcggctgcggcggccgcggcagagcccgtgttcccgctgctcgggacggggcagtgcgcgctcgacgctgacactgccaagtcgtcgggcgctgccgcggcggcgggggtgccgcccgggagcgccagcgccatccacttctggcagtcgcagccgacgacggccgccggagctggtggtggctccgccgacaagaagccgctccccatgctggactacggcggcatcggcggcccgggaggctccggcgcggccacgtgccacgactgcggcaaccaggcgaagaaggactgcgtccaccaccggtgccggacgtgctgcaagagccgcggcttcgactgccccacccacgtcaggagcacctgggtccccgccgcgcgccgccgcgagcgccagcagctcgccggcgccgcctcctcccctcccacttcctccgccttccccgccgcgaccaccgcctcggccaagaagccacgcctcctcggctcccagaccaccaccaccacctcccgcacctccacctccaacgccaccactcctcgcagcttcgacacctcctccagccaccaaggtaagtgagcacacgcccgcggcgcatggcggcgatggcgcgccgccacacgaacagaattccaggaagcctaaccatttttgcctcgtcgctcgtgaattcctcgcagtcgcgtcgttcagggacgccctgccgcgccacgtgcgcgcgccggcggtgttccggtgcgtgcgggtgacgtccgtggacgacggcgacgacgagttcgcgtaccaggcggcggtgaccatcaacggccacatgttcagggggttcctgtacgaccagggcgccgacgacggccgcggcggcatggcatccaccagcaacgacgagtccagccacggcgccggcgccgccgtgcccagcatctccgacctgcacctcggcagcgcctcggcggcggtgccaccgcacctgtacagcggcggcagcggcgggccgctgatcctcggcgggttgggctacggcaacaccatgaactgaaaaactaatcgtgcaacaagatcgagtaagcatgaggtacccattgattactataaaatctcctgcttttcttttcattgagtagcttagtttatggagtagtactgtcattgctactgatagtggcagaattctcgtttcttgttaatgttgctgttgctgcaatggagcaagctatgtagtcttgttattagaagctgggaaattaaaaaaggttcaagcatttacaggttaatttgtgcgctcatttgcataagatattgccttgccgtgaatatgtgattactggaatatttatcttttgttacattgggaattgcttatgaggttatggaagggttttttttaattaaccataatggagtagaatcatttcgagttcatgtgtttataaagttgttttggagcaatcattccgagtacattttgggatggccgatacaatggagaatggagcggaaaagtttgactctttgatgctctcttatctatcgtttccatgccatcactagactgtcttgcgtgttttagctgccaaatgcaggcctcgtttaccatattgagttgcttgccccttttccagttttatgtccaagaggttggtaggaacagggatggaaggcatggattctttacttggccgtggtgtgtgctgttaagcatcttatccatgcattggaacttgtagccaagagacgaatgtgcaatgcatgtgcttgataagacctcttctcttctctttgcactaaaataatcttgattagaattggctaattttggtcatggcatggaagccaataatccactagccatgcctggttgctgcatgttctatatagggcaatgcttaaaagagaccatggaacttgtactagccaagagatcaatgtgaaatgcatccgctgataagacccatccgtctctttgtattttaataatctgattagaaaattaccaacatgatcatggagttgaaggcaataatccatctattagtaggagtaccatatttggttgcttatgctacgtgaacttctcctaatcttttgtttccaacccggaatattattattccccttccggatcccatcaaagatgaaaagatgtgaaaagaaagaaaggaggtgttgatgaacagccttccactggtcgcagaaagatagccatgtgtatttaatcatttgttttgggttggagtaattttagttgctgttttctacacctactcatgtcttgtccaatgagtgagtttggtcggttttgcttgagctactgtggcatcaaatctttgtgtcaattatcagtgcacctacatgatgatcagtctatatatatcttgtcatcatcaaagctgttgttatcttatgtgactaatcaaagcgtttggtccatgccgtcgttctgaatactgcctaactttcgggagcacggacactgttcagggtgcttctttatttgatgcagtgtactgtagatttggtgtacctcttcaactacgcaacggttgcgttaagttctactcctagcttgactaacggcaaaactgtttacttgttcagttaggacaccatgctcatcttggttactactacgggataatttgattatttccactcttgtgatctcatagttcagcactaatatatacaattgctatttattacggagtatatagcctgattagcctatattccagttattctcgtattatttgaaatgataggacaatcaataatcataagtgacaatcatgttaattttcttgttgaatgctatatattgcgtagcaccactgaaatatgcccatatttgcttgctgtgaagacagttgcacgtaccgttcaacaacccagtgatttatgtttcttgcatatggtagaaggatctcttcgaaaaatcaacagatgcaagaaactgcatgctttggcttgtttgtgaggtttatttttgttcaatagttatttctccaatattcaaagaccgcctgatgctttggctgtttaagtgaattctttattgaaaatcccttaataatggttggatatacattattgatagatattattgctgctttgttattctttgtgttttctgaatttccagtgcagtatgaatggtggtaattatgggagtcttatcactgcctcaaagggaatgttctaaaattgaaacttatgtttctgtgctgcttaccagtgatatgctgttcaggattttgttttctttctgacagttgaaacggtttacatatgctatcctaggtaattagcccttttgtttaccatgatagcatggtttaatttgatgtatgccagtatgattactcagattagttgcctaatatgccttcctcatgctgttgtgtttgatgagagaagctgctgttagttggttaatgctttatatcatttccctgaatcatatgcaagaaccaatcaagtgaatttcgttcttttttgctctaacctgatgagtaagctaagcttctggtagatcacattctttattttttacactgatagtactccctctgtcccctaatataagggattttgacattttgtttgcactgtttgaccatttgtcttattgaaaaaattttggagttattttttttttgactttattatccaaattactttaagcacaactttttgttttttatatttgcacaaatttgttgaataagacgagtgatcaaacagtgcaagca

SEQ ID NO: 78488 - DNA, 2154 bp, Oryza sativa
  unsure (1)..(2154): unsure at all n locations
ccacgagtgaaaccctgagagcgctttgaganggcaatgnngagagcttgtgctctagatttcagtggaagttgggataagaatctaccctatgcagattttttatacaacaacagggatcaagctagtctacagatggctccgtacgaagcactgcttggtcgaaagtgccccactgcggtcttgtgggatcaaacgggagaacgtcaggttttcggaacggatatcctaagggaagcagaagaaaaggttaagatcattcaagaaagattgcgagtggctcaatctcgacataagagttatgcccgacaatcgccgtagagatttgagttttgaagaaggagactatgtgtatcttcgtgtcacgccttttcgaggagttcattctttttcataccaaagaaaaaattggcaccgcgttttggtgggaccttataagattgtcagtaaaagaggagaggttgcttatcagttggagttacctcaatctttgcaggaatccataatgtgtccatgtgtcacaattgaaaaagtgtttaagggtacctaccaaagaagctaatattgagcagatagaagtccaagaggatttgacttatgttgagaaaccaatccgtatcctggaaacaagtgagagaagaaccaggaatcgagttatccgtttttgcaaagtcccgtggagtaatcactcggaagaagaatcaacttgggaacgagaagatgaattgaagttagctcatccgcacctgtttgccagttcttccgaatctcgaggacgagattctgtttaaggggggtaggtttgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaagaaataatttaaattgaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcgccgccgccgagccgccgccgctgtttccttccaatccggccgctcctttccttctccggccgaatcaatagaggggaaatgatctccgggatctcctctaccttttctcctttggaatcttcggctaaatcggtttggaaatcgatggattcgagttcgaatcggatcggctttcctctctccaagccgcgagtttccttcgccgttgccgtcgccgtgggccttcgccgccgcctccgagcccctttaaaaggacccccggtgtctcctctacccgtcgcagctctcgccttcgcctctcgtcgccggaagagctctagcgccgtgtgccctagcttcgccgtcgccgccgccgcttcagccgtgctccgccgtcgctccagctgtcgccgtcgctcgggaagaccgccgccgtcatcgccaagtcgccgccgtcctcgtccgccccttcgcagccgtcggaacccgccggagcttcgtcgccgtcgacaacccgaaggtagccgccgcttccttctcgtcgccgtcgccgtccgttgcttctccgccgtcgttttggtcgtcggtgagttcgccgtgccgtccgctacccgttggtgtcctccgttcgtgccgtagcgccgccgttcgccggtgagcgtgcgccgcccgagccgtctgcctcgccgagccgccgccgccgtcggtgacgtcatcgctggcgtcatcaaggccgtccgccgtgaaccgccgtggacccgatcgatctcggccgtccatcttgaatcgggtagatctcgggcgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaatccgatttaatctt

SEQ ID NO: 78489 - DNA, 5596 bp, Oryza sativa
  unsure (1)..(5596): unsure at all n locations
caaatgtcaatgcaaatgtttcatcatcattactttaattcttcaataatatttaattaaaaattattaaaatactatatgtgaaaggaattttaattacaaatccacatagagagtattatttttttaagtactttctaactatcggttgagtaatttatttttcatattcaaacaaattttacatcatttttaattgcttagaccctgtttgtttctcatactaggagaggataaaattttggattatcgtggcacgcttttcaaactgttaaacgatgcgtttcgtgcaaaaactttctatatgaaagttgttctaaaatatcagattaatccatttttgaagttcgtaataattaaaaatttatttaatcacatattattaccacctcgttttgcgtgaaatacttaatctttatttatctttagaagattcaaacaccacctatctatgcgtagacgccttttacacacatttgggtagaaaatgcggctataggcattagtcttctattggttagactaatattgattacgaaaaagtaataattataggtaaaactttatgcatgtgtagtcttagccgatctaaaagtactctgaataaaaatattaaaactaaatttaaaactaagtatcaaaatttaaattctgactacggtttaagtagaagatgatagcaagtacgaagccaatactatttgaagactgcataccggggtgaggacttgcgtcgcgagtcgagacaagccactcaatcgcacaacagcgagcgtaccaaacaagttgggtcaagaaacatgacgtggagcgagttgagacttcttctccaggactactaatttgcgcatacacactagcagatgaattcacgcacgtgctcccaactacgttataacaagtgtcgggttagggttaggttttcgggactggggtggaggagggtggctatggaaaggggaagtgggggatcaagcttagagggatggcctaggaggcaacaatttgacgatgtgtggcggacaagggcggttggtgaggtggcggtgacgccattagagccgcgaggtcagcagcgggttgtgggctgatgatatcgatgagggcaaagtaaggcgaataggagggaaaggaggccgctctggaacattgacaccttttggcgctggtgaggctggagatgatggtggagatagagctaacttggttgctggaggaagaaagaggaggcttgccaaatagaggctttcgtcgctggaagaaggttgctcaattccgtccctcttctccatcggaggaagcttgctgtaaagagaagggggtttgtcagagggcctccaccatcgctagagggaggcgacagcgtcatcgcttcctcattcgcttgcacacgtgcacgggtgaagacggagagaaagaaatggataagatatatatagagagaggagatacgatggagtggttggtggccatgggccgtgggagcgtgcgtgacatgcgtggccctcttcttctcttccctttactgtgaataaacaggtcaataggttgagaaggggaaaaatggttaattagatccatgccactttaagtatgctgattcagaaaaataccaccattattcgtgatatctgttgcgtgccactggaattttgtaagattgaaacatgccattgccgtcacgttttctttcattgcctcgttagatccgtcaacctacttggcttctccgtctccgacatcgacaccaatcaccaccagtagcagcaacaaccgtctctggcaccgccgccaactaccaccaggagtagcagcaacaacaacaccaacgcgcgcaatccgcctaagtgagaagctgtcggtgacctcccgacggagaggatgagatgttcatgcgttgcagcctgagtgaggaaatagagaggggagatctattttctcaccattgcctcttcctcccccatccaccgaacctcgccgccacgccacccctctatgtcgactgtgcgccgttgctgccttaaccaccccgccgatggctctggtacaccggacagaccaccacaccatgcatgtaggcaacatgttgtctccctcatctgtcagcttccatgtgtgatgccattggtgagctcgcgtgagggctcccgtcctgacgatgcagcttccacaacctctaattccatcgtcgatgaggtcaccgctaccttgccctttagccacttgcattgcgcacccatgggccgcctgccaccgcatcctctatccaccgggggagatgtagagcgagatgttgaaaagagaagaggcgagggtggaggaggaagatggagctaacatgtaagtctcatatgtaggggtattttaatttatattataacagaaaatgtgatggcgatggcatggtcaatggtacgcaatagatatcacaaatagtagttgtatttttctgaatcagcacatttgcagtggcatggatttaatttttaaaaatacgtcctggctgggctgggttgggctggtctggtccccgcggatccggccgcaatccagcctcaacccggcccaaccaaacaagggcctaatcaatttccccggcgcggcaactactactatatagcccaagtctgttggtttcccatccgcgcgaaaattgcaagcgcaccgcctcccccttctcctcttccctagtctactttagggtttcctccctcaccgtcgccggcggcgacggccaccagacgcgcgcatccggcgcggccggcgtcaccgcctcccagccccctcgtgttgctcgcgtctccggcgaccgtcgctttgccttgtactccggcgcctgcgtcggctactaacttgggtgactaggcagcaataaggtgacctataatgcgcgcttctttttccaaattgtgttcttagttgagcaaaaattacaaattgtgttcttgcttgccctgtctgtgatctgtgtaaggcaagctagcagtagcatttgccggtggcgtgtctacgttatgcttactacgttaccgggtcccaaggcccccgagtaaattattcaatactagctaaattataccatgttaacttatactatattagtcaataattagataattagtatgtatcttatctttcataatttttgttctaggctcgtcatgtactagctacttgacctattagtttttgtcattgggcgggaaagatatatagttgaaccccgagcaattggggcttcttctgtgaattgattcatctctcacacatggttctccactattccctgtctattggttcttcatggttatagagctggttggatattactggtgttacttgcttttctttttttaaaaaaattatctactgcaaatttgtaaattaccatgacaagccgacgttatttatcttagataaataattgatttgaactttgctttcatcgttgctcagttaacctttggtagcttcttctattgtgaatcaggtatcatgcagctccagttaaaatggcattatattagtctatagattcatttgcagtaaggatttttttcctcttttgcttgcgaagatcatttatatgacaccttaattatgttcaaagcttactgggtattactagctggtctggccctactcagttttacgtgtacctagctatatacgtaatgtgccagaaaatcagtttgtgatttgactagctagttgcttctgccaaaagaaaaaaaaccaaaaccaaattaaagatcgaactttcatggtaatgtttactcagtatttgggtcttgtcctttctgatccaaggttggaaagatgtctaaacgaaggggcaattgctcgagctcaaatgaagagaagaaaacttgcacaaatagtagaaagaaaggtgagtccgttcttgaatgttgattcacttccgccatttcttacatgtatttacacagctctaaatgtgttgcttttgaagaggaatctggtagcttaattgattatagtgaaggtgcctagagtggactcagtcaagaagtcatttcaaacttatctgaaactgttgtctcagtggcttcattcaatggtgagtgcctatacaaattagttttccatatatgtatctgatcatcagttctaaacattgaagatattatcttgtgcaggagatcagacgcatttttcaggcacaggcatagttgtcagaaccaaagatgaagtaactacaagtattctaacttcagcaaatgtgattagatgttttgatgatgacagcaagatcaatccgtttttggatgttggtacccctaattttctctgcactctgtaacttacctgtttaagatatgataataatctgcaggtgtgcnttgcataatcactgcaagattcgagtttctgcttcanaaatnaacaaacgtgtcatcgggtgnaatggnacactttgactttaacttacaatatgctgtttgtggtgatcaaatatttacttggtntgcgagctgcgtcttttgatcacgaagtgcgatttgggtccaaagtaaggtagtagctgtagggcgttccttcacntcaggcaaattgatggcgttatctgggatagtgactgatgggccaacagattatcctgaacaccttatgatctccacatgtanaatcactaaggtgcactgctgatatctcttctttcttctcggtattgtggaaattaataattgtctcatgatatgagtagcagaatttatcactagttcactacatacactgtactatatcgtttggggccttaaacatttcattctcttcatgtagttttttcattcaatatggttttatttttgtgcttatcttagctcagtgtgacagtatattttcttccaggatatggctggaggaccactcattgatttggatgggaactttgttggcatgaactttttttcggaggagaggactccattcctaccaaggaacaaaatttaccgaagcttggtgcgatcttgcacactttggtatgcctcgtactttcattcagatcctccaaacagtcaaacacttgccaagccagattgagctagaaatagtttagggggttaagtgctcccgcaaaatagtagttcgagggattaaagtggacctttttcatttttatttgacagcctatcacataatagcgatttggttttgcacatagtactatgttattataactctgctagataaagcaatatattactatgttttgcacgccctatagctgatttccataatatgcttcttatggatggaagtgttaatcttgatagtatttttgattagctatatgcaatccattctttttggggatcagcagctctgtgtatttgcactataagagtatactacattctgctgcagggttgaaatcgacgatgaatgcacaagcataattgaaagatgcagatctaagatgatacacaacaattttgttggtgagttcatcagttgaagcacaatcactctttgaaactgctaaattgtttattgtcagaaatctatcttcattaatgtatattattaatccttggttgtagtttcctctcctgtgggtaaagcttaactt

SEQ ID NO: 78490 - DNA, 2883 bp, Oryza sativa
  unsure (1)..(2883): unsure at all n locations
taaatctactcgatgcatcgtatatacactcctatcatgcacatgcgtctgccagcaacgaactcgatcaattggcgtctatgtagctatcatactgtagcacgagcattaattatatactccgttcaatagattgcttattaatattatgcctgccaacccatctcgcacgcggtacataatacattactcccccatcttattctgagcgcagccatgagttttcgtattcaaatttaatcatccgtcttattttgaaagatttgtaaaaaaaatttaaaaaacataagttctgcataaaagtactattcatgttttatcatctaataacaacaaaaatactaataaaaaaattcaaataagacggatgatcaaagttaggcacggaaactcatggttgcgcttaaaatgagacggagtgagtatatatttgtgatcgacgatgatacaaggtacaaataaacagtgcccgtctcattgcatcccggtagtaggttcatctccttttcatttttcgatcttaattatcttgacgtgatgggtgttgtatcaatgcaaactacatatgcttattgtttggccaaatatgcagggggtcattagcctttaaaaggcatctttcttcgttccaaaatatatttcttcctctcctcctagcagatttacgatgatgaggatgcactagagggtttgtggctgcctgatttaggtgcaacgagctcgaggcaaggttgatagtcagcagccaccagcagctctttctgtccacttggaaggcgcagatgcagagggcgcaagctgcatgcatggccatacccacattgtgttttttgaaagagcttaagactctaaaaaggagctaattggtagccaactttcaataatctagaaaagctgggttttcctagtttcttaattatagttaattttctagatgctatagttacatattctcataatctggataaaaatatgcactatttgaggaagttggagattctgggagaagctatacatctgctagaagctcgtcttagcgtcctaggagagctagatcatctccaaggttctgcttgatgcttcaatagttctgcctagtgaagttgttgattgatgcaaatttgtttgtggttgtgtgatccgcttgatgtgcaaatcttttgatacgtgtgtatggagttcaacatgtgtatgatgttgttgaacttgtatatgcaatttgtttgatgttgaagttgtgatctgtttttgttgttgctgatttggatgcaaggcttgtgattcattgttgcattaggaataactatcgtacaggagtataacaattttctttaggggttgaaattaacatcaatgtcggtaaaaaaaaaaaaccgacagtgatggctaaggctattactgttgccttcatactactagctagttcaaaaaccatcagcaatgtcatgtttgaaccgacaataataggatttttttaagttgtgatcaatcattaattaatactagatattaagattgatttgtgaaaataatggcattgatagttttgtgaaaaacacatttatatgttttttaataaatgtttaaatataactagaaaaggaaataaccagatatattcgttggagacctaatgtccaaaacgtaaaaaaaaaaatggcgactactgttaatgagctatggatagcctggagatgatgagataaatcagccagcctttttttctggctagtcatgtatagaggccaacatgtcatgatgatggtccatggaacaacaatgcaaacagtcaatagaatcctttancacattcatcatgtacatactgaatagtgagaatacttccatatactctctccgttataaaatataagacgcaaaaatcggataggatatattctagctaatactacgaatcgatcgaatctaaatagagaattgtccatattttaatattaaaacatgtttcatccgattctaaattcttatattttgagacgaaggtagacgaaagtatagtactactagtagtatatatattatttactgacagttatttttatattgccggtgggtgtatacgtaatatttgtggatgatgaaaatcctatgtctagattgtgtcaggagtgtgtattctatgtttttctttttctactttataaatatgataacataaattaattactggtaaaagtctgtataaatgctactggtgatgtgtctctcaacgtacctctatcatagaaaaaaaaatccaatttctaaggggtgatgtgtctctcaacgtaactctatgatagaaaaaaaatctaatttttaagcacaaatctagacaaatatttatctacattcatccgtaattttttaaaggaagggggtaaatggtcatcgatagggtgcaaaaggaacaaaattattaattactcctgcctcaacatatgcacgtactaggcagtacgctagcgtagtgagaagggtgagcaataacttactccctccgcttaaagaaaaacaatcataacaatatctagaattgtagttagagattgaggtattataggacggaggatgtaaggtcgctagctttatattaatggattactttgaagatagtactagctagggtagctatagcttttgcatatcctctacgatcgctggcacgtcaatgtcgggtccatttgcaaatgatactggagaagagagatctgcatgaaacttaaaatttcctaagctagcaaccagtgtgtaaactaaattatgcacgatagcttaaattagtacatgcatgttttgttagacaaatacttcttttgtctcaaaaaaccaacttctggttataaatctagatatagcatatgtttaaattcaaagcattta

SEQ ID NO: 78491 - DNA, 4947 bp, Oryza sativa
  unsure (1)..(4947): unsure at all n locations
tccttgnttgattcgntgcttaggacccttgtaanncanttaccgatctcataaactcagtattccattcatcccagcagtaccaaaatgtccaagacctcaaagaaaagttctggtgggtcagcatgagaaaggaaatagctgaattcgtagcactctgtgacgtctgtcagcgagtaaaggcagaacaccaaaggccagcaggtttgctacagccacttcagattccagaatggaagtgggaagaaatcggaatggatttcatcaccggtttgcccaggacatcatcggggcatgattctatttgggtagtcgttgaccgactcaccaaagtggctcactttattccggtgcacactacctactcagggaagaaattagcagaactctatctagcaagaatcatgtgtttacatggtgtacctaagaagatcgtgtctgatcgaggaagccaattcacttcaaagttctggcagaaattgcaagaagaattgggaacccgtctaaacttcagcacagcctaccatccgcagactgatggtccgaccgagcgagtcaaccaaatattggaggatatgttaagagcttgtgcgcttgactttggtggagcatgggacaaaagcttgccgtatgctgagttctcctacaacaacagttaccaggctagtctgcaaatggcaccgtttgaagcactgtatggacgaaggtgtcgtactccgctcttctgggatcagacaggggaacgccagttgtttggtacagaagctttaaatgaggcagaagaaaaagttagagctgtcagggaaagattgagaatcgcgcaatctcggcagaaaagctatgcagacaaccgccgaagggagctcgttttccaagcaggggattatgtgtatctccgtgtcactccgctcaggggagtacactgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgcggagaagccaactcgtatcctcgaaaccagcgagagaaggaccagaaacaaagtaataagattctgcaaggttcagtggagccaccactcagaggaagaagccacttgggaaagagaagatgagttgaaggccacccacccgcacctcttcgccagctcttccgaatctcgaggtcgagattccgtttaaggggggtaggtttgtcacgccctgaagtttccccctctccttgctttaaaaattggctaaataaatcgtccgaagaaattatcttaattatcctagagctaattccctaattaataaatgcaattaataatcggaaatgcatggtggaatttttcttgagttccccatgctccaatgcattaacaagatttttagtggaattttcagagccttggaaataattttaaccaattaaaaatgagcaagcgcaatattttaatcccaggaaaaatcctttttcctttttttttcctttttcccttttcttttcctctttttctttcttgggccgtcggcccgatccagctcgcccagccgtgttcggcctccttccttgggccggcccgtttccccttccccctctcttcgggacgctgacaggtggggcccacctgtcaggtcgtccccttcctccagctgccgccccacgccggcaaccgccgctgccgccccacctgattcgctcctcccgcgcccacgccacgccgttcccgcgtcctccccacgacgccgcccacgccctgtcgctcctgccccgcgcacgcgctcgagagggcggcactctgtctctctctccaccccacgtcgccggcggtttcggccacctccccggccacgtccgcccccttccgcacctataaatcgctcccccgagtcccctctctcgtttcccccatttaccgtcctctcccacatcccctaccgcacccgcgccgtcacacccgagctccgccaccgccgcccatctccggtcgcgcgccgccgccactatagccactgccgcgccgcgcagtcgccgccgtcgcgctcaccgagcccgcccgcacctcggccgccgcttcgttgccgcgaatcaccgccggagctccgattccttcgtgagctcaccattgtttccatctccggccggccattttgggtcgtcgcggtcgtcctctccatccctaactcctctcctccccttctttgggtgttgccgccgccctccgcgcgtgagccgtcgtcttcggccgccgccgtcgccttcggccatgcgccgccgcctttcggccgtcgccgccgcttcccgcaccgtcggtcaccgccgtcggtggccgtgcctcgccgccgcctcgccttggtcggccggtcggccttgaggccgagccgagcccggccggcgcctcccttgcctcccctttgagccaccgcctggtggggcccacctgccaggcgccacctccctccctttggagccgctgacccgtggggcccacgtgccggcgccccccctttggctgacgtcagccctgggctttattgcgcaataaagtgattaaggctttttctttattagtaaaaacacagtttatcttctaaaattcataagtaattcatccgagctccgtttaagtccattcaagtctcagtaaatcaagaaaaatgcaaagaatccattaaaaatagttttgtttcctgtttcagtagtcttatagcatgttttgcttgtgtgctttgtttgtcgcgtagatttcggccgtttcgtcgatccgcggtttctcgaagacgttactgaggtctcatcagtgcgagagcaaggcaagtcatgcaatacgtttgatcatattgtacccaatttacaaatatcccgcatttctattaaatgttgcattcttttacaatatcatgtgggatgggtcctactactcagccatatattgtttaccttatgccattgacaacttgggtattaaaatgactagatgttggtttaggaaatgcttagccatgcttagttctactagtacacaaaaagggaatcacattaaagcatagactttgattattggcaatagctttggattggtgccaccgcaagggtgttggttaattaaaatacactgaatggtgggctgtgggtgcatggttttgctggtcgcacccatggcaattagggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcactgcggcgcaagaggggaccgcctactgccttttgaggggtgggggtgaaaccttagcgtggtgtggatggttaggggagggttatgtggagggtcttgtcacgatttccccctttgcagtatcatggtgatacttctgggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttaacttaatgaacgggtgtagttcaggtggttggttgggcctgttgcaacgtggtgtaacgttgaacagtgtttggttaatattgataattgctacaaactgtttactgctttcaactactgcttttaaatgctatctttatgcaaaagaacccctagcctcctttggttatatcctgcatcatacctcctcttccggtatgacttgctgagtacagtgggtagtactcagtcttgctctcttttctcccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgcagcatttgtaatcttttctatttttgtaagacgtggatctgtatgtcaacaattgtcgtttgtgtaccctggctggtcctggatagggatttaatgcacattcagcttagaaattctagttcgagaatttctgggcgtgacaccgcggggtggtcgtcgtcgtcgcgcccgacctcgccgccaccgcgctggatccaccgcgcctgacctcgctgctgccgcttgccgccgtcgtcgtcgccgcggggaggtcgtcgtcgccgctgtcgacgggtggtaccgcgactacggtatttggatggtatagggatcgtcgataccaaggtatatgcgagattgatgtaaaagagatggagacatggatttttatacaggttcangcaccttatctaacaggtaatagccctacattctattgggccgaaaccgtgttgctctttattatctggatcacacaagtagaatatttggngaaaacctatctagnttgtcgtcaacttggtggcaggnataaccaacacgtagtcaacgacaaggtagtctttcttctcgagcatgaacttctcgagatcagagatagcgctagaatcctnttagccggccncgtaggcaccggatgccgtatgtttaggctaatctctgaattcagaacctgcggtgtgggtggcttaagatatggtggggctgatggcctgtggcttcgtttttctcctgggggcttgttattaaccacagggtgccctgtgcaaagaattggagaccattgtaccaaccgaagcctggaattatataaacttatggcctcctttcc

SEQ ID NO: 78492 - DNA, 3555 bp, Oryza sativa
  unsure (1)..(3555): unsure at all n locations
gcttcgtcttcgtgcatgtcgaagagcatgtcaaggaggtccttctcgtcgtcctcgccgtcggtcgccgcttgccggcgtagcttcctcttggcttccctcgccgtcagtatccgctccatcatggcgtcgaacttgcggtgcaccgcatcgatgcgcttgccgagcccctgcacgtcccagtacttgaagacgccgatgtagtcctgcaggttgaacgtgccggtgagctccgccgtctcggcgaccacgctccgcatctcctccgcgtcgttgtcgtcgccggtccaccgccggcccatcaccatgcgggagacgatgtcgccggtgaggcccatgagcgcggcgtcgacgtcgacgcgctcgccgccgtcggcgctcgcgcggagcgagccgacgaggcgcgccacctcctcgcggcggacgtggcggagccggtcgagcgttcgtccggcgaggagctcgtgcacgcacgcgcgcttcatgaagcgccagtagggcccgtacgccgagaaggagaagtcctggccgccgtaggtgaggcggtggacggcggcgggcttggggcggtcgaggaacgcggcctcgtgggtcttgagcacctcgcgggcggcgtccggcgagcaggcggcgacgcaggggacggagccgaggcggaggaagaggagcgggccgtggcgcgcggcgaggcggtggagcgcctggtgcggcagcggcgcgagcaggtggaggtggcccaggatgggcagcccgaacgggctcggcgggaggcgcaggccgctgctccgcggtggcggcggcggcggcggagcgcgtaaagaacaatcaggcccgcgacgaagaggaggagaggcttgaagagacctcgagctaccagctgatgatccatggcgacgaagagcttggttaatttgactactcactgtgtcactcagcttagctagctatgcctatgctacctctgttggttctcacttggttatatgcttaagcagttaagcttaatgcttgtgggttatgcacatgctgatgttaaatggatgtcatctgtgtagggatgaaaatggagcggatacggacggatattgatcataccatattcgttttcatattttttgccgaatacggaaacgaatatgaatagctcgaacacggactatctcgaatacgaataagaatcgaatatgatcggacacgaatacggaaacaattttttctcggaacacgaaaactaattcaacttctaatagaaacaaatatcaagatatataattagctcattttatataaaatgtagtataatttataaatatttttgaaattttcaataatattaataatatggactagtgttaagagatgaactactattaaaatctaaaaaggtatattgaaggtcatagagttataaagaaatgtggtgtgtcttgtggcttatgcggatatccgaatagcactgttcaccggatatccgaattattatccgtatccgacgaaaaccctgataccatattcgtatctgtatccgagaaaaaatatcagtattcgtatccgaactatctgagaattatccgatccgaaaggtatccgtattcgtttttatccggagcggacggaaactatccgtccgttttcatccctacattggtaagcaatttgtctaaactacttattccttgcttgtttttttttcatttcaataaatagcaaacatttgaggacttaacattgcccactagtatgtacaaaaccatatatatatataagtattttgattttgtcacataaaaatggcagtgatagatccatcgtaacaaaaaaaatccgatattgtagtgactatacaaaatgaaaatgtgttctaaggctgtgttcgcatgtcatggatgggaacttttttcctccgcacggaaaacagagtggtctattagtgcgtgattaattaagtattagctatttttttctaaaaatagattaatttaagttttttaagcaactttcatatataaacacaggggttgggaacaaggggttgcanacacagcctaagaccatatatataaatntggtggtgacctgaaaaattgttttaaactcttgaggaaatatcccctcgtttgtctaaaaacaatccgaatagttatgaaaattctaaaaaaaatttaacgacaatcatgcagcaatatatatacaactatacaaatttttatgtccaaactcaactcacatattgagatattaaaagggacaaattcaacagacgaatagtaatggtattatttatacctaatttttctctctctcaatgtgtaggtcaaatttaaacttgatttttggtggaatattatgtgtatgaacaagagataatttgacaataaaccattacataatcgatatgctgtcttgctaaaaataagattcccttttatatatcaagcgttggatatagaattctagtgaaaatttcacctctttaacgtttcacgccataaacctgatgctaaaactgaacacatgaatattgatcacgagagcgccaaaacaatatttttttcttttgtaatttcatatagccaagggatcaaaatggattgaattttcctgggtttctaaatctcgctggtggttggaattcgtttttgaatttcttgaaaacaattcgaaaacatccctaaaactctaatttcaagctgccctgaaaaaaagatattccctccattttatattataattaagttgtttgactattttcttagtcaaacttctttaaattttaacaagtttgtagaaaattatagtgatattttccatacaaaataaatatattatcaaaatatattcaattttaaatttaatgaaactaatttagtattatagttgttgttttctttataaacttatcaaacctaaagagttttgaaaaaaaaaagatcgaaagaattataatataaaatggagggagtatatcataaagagctctgctataaatacgataaatatcttactattagtgtcggtgcccttctaatctctaatacatgcaacaaatatagggtccacaatgtttccatggccaatcaattatcatgcatgacactagatcgtaccaaaatcgtaacaagtttatcttacgtacatcaatttcctatcataaaaccgaccggcgtcggaaccataaacccttggcctttaacgacaaacgcctccaaacaataaccggtacagtaacttattagtccattcccatgatgttcattttttctttcgttgaatcaatcggcaggagaactaccaggacactttactttttttttattattattgttattatcgggatctgccctgtgatctgcgagaatcaatccagaaatcaagacaaatagacaatggaagctcagtacgatcccctccactgtgtttgatcaggttaatagtatggaccgggcaacattggataatggcgacatcttcttctgttcagagtatctagccatgcccggccggcatggccggcaggtgtgaaatagtcgttgattgagctagctacatatggaa

SEQ ID NO: 78493 - DNA, 2088 bp, Oryza sativa
cggccgggttgtgggggaaccacacatttccggttatttctccccccccatttttatataaaacagggtttaaattgagggttttgggtggccccttccacaatgtgtgaaccttaaaaaggttttgaataaatataaaaatccaaacatttttttcttcttcccacggttctttaaagtgctttttttaaaaaaaaccccctcaccctctttggtataaaccggaaaaaacctcctcttcgggtaaactttgctaagacagggggaaagaccacagttgtggtctcttttcccccacacaaaagttaaagttctcctagtggaactgtttgttccaatttgttttcgtccctcccgccaagattccctgtaaagtgaattgcccctttctaaatcagctttccggttaagctcgcttttatcttttccgcgccattggtaatcttttcaattttggtaaaccgtggatctgtatgtcaacaattgtcgtttgtgtaccctggctggtcctggacagggatttaatgcacattcagctttagaaattctggttcgagaatttctgggcgtgacaagttagcatcagagccgaccttgaccgtagggcaagccaactagaaaacctaggagccctctgaaccctttttcatatgcatatgcctttttcacttggattttgtttcgggaaaatttggggtttgcctctttggttggtgggaaaaaaaatcttggtcgttcattcggatcggatctttaaaattagctcagtctagggttttagtaaaattttatttggagtttattcgacagtcagtcgggaatctattgggggttatgcattaggtcgtgtctatgttcgatggggcaatgttatgcgcatcattttccatgcaactagtctatgcattaatttattgtttagtcagttgcattagtgtcttttgtctcggttcgtggaaaaggttgttccatgcataaaaatcaccatgctaggttatttatttgagtcatttgttgctttgtttaatttggatttgagcatgaattggttcctatcccttgtctactttagatgtcagtcctatccctcgattgcaagcgccccccgagcttcagagtcgccgcccttagctttatcgtcttcttagtctgtttgcttgctagttttcgtgtttaggtttgttgcttgagggttagtcggtggtcgatatcatgtgtcagtggtatgactgcctcaattaggagttgcgtgcctctttttcagtgttttaatcaagattaagataattgcacttaaattcataagcaagattagtttctgagcctcctgtttttctttcttttctcatatttctacctatccccctcagatggtgaagacaaggaatggttcccgtgactccaacaacgccagtggcagcgaagagctgatcgatggagcacgtgccaacagtgcatctggcaacagtccgtccccaccgcccgagaacccaacaattgctcaggtgttggacaatcagactcagatgatgacaatgatgatgcaacagatgcagcaacagtaccatcaggtgttgcagcagcaagcacagcagcagtagcagaacctgtagtttggtccctccacctcctcagtccaaactattagaatttcttcgtgttaagccgcccaccttctcaagcaccaccaacccaatcgaggccaacgactggcttcgtgctattgagaagaagctgaatcttttgcaatgcaacgagcaagagaaggttgcttttgctacacaccagctgcaaggtcccgcttctgtttggtgggacaactacatggcgacccgtccggctggggcagaggttacttggacagagttttgtcatagtttcaataaagcacaagttcccgagggaattgtggcacaaaagaagagagagttccattccctgcaacaaggaaccagaacagttatagagtatttgcaagagttcaaccggctcgcgcgctacgcccctgaagacgtgcgtaccgatgccgagaggcaggagaagtttataaaaccccaatcaagccgctccaagaggggactgctctgc

SEQ ID NO: 78494 - DNA, 5844 bp, Oryza sativa
gttgtacaaagtactccactcttatatggaggagcaatagtaaagtagatgtttcaactactagggtatatgatatctgttaaatgaatttctgcatgcaagttgtggaattgtccttagatagttttggggtaaatagtgccaagagatgactgggtggtaactggtaatgacctctgatatgagtagagactagagatgagaattaacttgtttactgtttctttgcttgaaatttaatgcatgcagaaaatattgtaccgtgtcctgattctgaaccatacaaaatattaacttgcttattactagagactagagatgagaattgcaatccatgcatgtactgtgtcctgattctaaactacagaaaattttctatgaagaaaatgctgattgcttcgatgtttatgcctaacttgcaactattggctatttttgttacagccttatatgctcattatgaatttgtagtatgaacttgttaccgtgatactattttcttggatttcttttgagttactgcatctctatatgtgacttggtgtaaatgacatgtggacctggactcacttggtcattgagataatgagggactgcatagatattcagtggtgtatatggaataatccttgtctttggcatgccaatgatccaacattactagatacagctgctagggaaatttaagattggtttaacataaattgctgatttatccaaaaatttagattgtagatagtattaccttcataacaaacaagcaatgctctccagtatgtgtgaagttcattacgtctagaacttattacatacctattgccttttgttctatagaaaccaagttcttgttaatataccagttggtacttttactgtttttcttttttaagaagttattacactagttcaccatgtcaggaaatttctttacactgatgttttctctggattattccctttgttccagagaggtgtgatagatgagaagataaaaaagaaagaggagatggaacaatttgaggtaaactcatttgcatcatatattgatgtacatagagcaccttttcttgttgaactaagatttcagatactgctgtcagctgcatgaaaaatagttgttacctttccttttttttcatctgtaggtcgagcttaaagcaatgcgcgaggccgcagaatggaggcggctacaaggtaagtttgtgcagcgtctagttatcaacaaaaacaccaaaagccataaacacagaaaaaatacatgtatttttaggcttttagcaagaagattaactattccattttctttatggggcatacattattgggcgtgaagaaccaaatgtactgctccaaatatgaatccctataatgggccattgacaacacttatgtctaatttttaattatagggtataattgattatagctttgttgtaaggtttagattatagggctgagaaaattctagatatccttctaactgttcattcctctttgataatcttgtgaacttcactgatgttggactgttggtcttccgtggtttgatttgatacatgcagttattgagggcctatacactttcataacccgtaattttttgtgaggtcctagccgtctggtcatcatcttctgtttgttcagcatttgagtatttgatttttgcaatttaaagagttgaatattgttgtagactgggttatagggtaagggtccaaagagggcccagttcttttcttcaagggtaagggtctgaagactgggttatagggcacttgtcctctaataacgccagcaaggcttctccctgttatgcaaaagaaagcccatttcttttcttcaacttccttgttttctgttagcacgcttttcaacctgttaaatggtgtgttttttgcaaaaagtttctatatagaagttgtttaaaaatatatatttttttctatttttcaagtttataataattaatacttaattaatcatgtgctaatgagctttctcgttccgcgtgagcaaaaagtctctccaaacggagggaacaaacgcaggcttagcctcaggcttagagctaaagtctctccaaatgaattttgggattcattacttgattgataatatagtacaaggggtgccttcatatatagggaggaatgacttgacatccagtctcaaatattatagaaactaaatctaataatttactaacaaacttcatctccttcataacaattctggtccgagcaagttcttgataagaactgaagatggaagcatagttagaagaactatcatgatggcatatttgttgttattttgtttacaggtgtatctcttgagggtgatgatgaacttctggcagttccaaaacaggcacaggcacctaaaagagatgaatggatgaccacattgcctcctgaaagaaaagtaattgagtaaaatatactcattttactgttttatctccttctgaaaggaaaaaaaaagaaagtggttattttattgtgttctcttacatgtatgtttaactctccttttcagcctggagtaccaatgcattcgactacgtcatttagtatgaatggtaaagaaggacgtggtgatacaagtgtctggacagatactcctcttgaaagagctcaaaaagcacaacagaagtaagagttttgacactagctttcacatcatgatatcacacctttatcaatcaatattttgcatacctgctagtttagcaaatattggtgttgccttgtagagggcattaattggcatcctgtgcatgttactgagatggagagaacatagtgtcaactgtcaacacttcctaggggttagaaacttttttggccaaaaattgctacctaggctatttaaggaaaaggcgaaagcggattgagctcctgatatcaaggggctcatctgtttaaggacagggagggtactttaaaagattgaacaaagtgtatttaacccttgaactgttcagatacatccactttaccccctaaactagaaaactgtctatgggtccacattacaagactctttcttatcttctttcctttcctctctcactattctctgtcatttgttttcctctgcccaaatagtcctgttccgtgctggctcagtctactggtgctggcagtggcagtttctcgaagcctccccttatcatgtggttagctgtggttgcctgtgggtcccctttggctggccatggtaatcatggtctaccctactctgcacgatgatttctccagctgcacattgttcatgggaggagagatgggtgaccgggcttttctgaggtagggggattagcagtgtttagtgccttcaattcggatcaggtgatattggaggtttgcatagcaggtggggttgggggtaaggaatgaagaagctttatcagttgaattaattcctcatttaaataatgatttatcttttctttttttcactgagacatgccaaattataggctacaccacttttgatagtagctaaactacctcgaatggtcatctgctacataaggtgatggaattcatttattatggtatgaagtggacaatttcactcgtgctagtggccaaggctagtctttggcccttatattctatttggtgcggccattagcttttcaaatgatgtttccttgaaccttgaaatcttgaatgcagcatttggtaaaaagcatcttttttgaggtgattttttcttaaataggtatggttgaacttaggaagaagtgaaaacaggagagcccgtctttctaatgataattttgtttttgctattcagtacgatgccctttatgcactatgaatgcaatgatctacatggaataatattatcgtgcttgtcacagctacttagaagcctacaacaaagcaaaggcaattgcagatgcagatgaagaaaagattaaaacctcagacgcttcattggtggatacatacaattcctccaagcgatcagtatctctcgtgcaaaagcatcgagaaagcaaaaaggagaaaaagaagcagaagcagcgggataaagaagaatgggaaggaaaccacccatggaagccttgggaccgtgagaaggacctgactgctgggcggcaaaatgtcaatttagatcctgagaacatggcacaaggattgtcgtcccgattttcgtccggagccgttcagaggaacttcctctgagccattttgagatgatcggctaatcacagatgaaacatcaccatgttggtcaccagtacgctggtatgtatttgctgtaaggttgcataggatgcttgttagttatgatgttaagatgatccatgttataagtgtaacgtatgttagatgggttgggttcgcatgtccatttcccagaaatgaattattgcattatcgagagagagctctagctacctatctctactgaacgactgtgcataccggttgttttgaactgtatatgaacttttccagacagtttaatggtacctggtacttaatggtacatccttaaggatagaaaaagtacctcctcaaggatggaaaaagagctccatctgaaatgtcgtaagcaatgatattgatgctgtcatgtggcacaagcaaatggaacacttctgctaagacatggatagtaaacccatttattcatttattttggtatttgcaatttgcaaaagatccatatttaataatttggttgtagcatttatctatttatacctatgctaattgtacacctcacgttaactaaaaagtttgtacccttgaatttttttttttgggagaaagtgtacccttgattagatgagttatacaatcatgaccatacattgtacagtccttcaacgcggtgggtcaatctatgtttaattttgtagcctgtttctaaagcccatctattctattttatcttcaatagaatttatagacaaagaggtaaagagataagggacgactaagcttggctcagttccttagtaagaaaatagaccccccttactttgcaatctgattcaattaacaccgtggccttcttttgtattccgtttattaaagtcatttgactttttttaaaagttttttaggtttgatcaagggtatataaaaaaattagcaatatctataacatcaaattagttccattaaatttatcattaaatatgtttgataatatgtttgtttgtattgaaaatgttagtatattcatctataaatttagttaaacttaaaagatgtttgactaagaaaaaaaacaaacgacttataatatgaaacaacgcgaataagtaggtttccacgtgattgccacactagccaaaatggccagtggacacatctgtatccaaacaaataattagagagacaaggggcaatcaggtctgttgccttccttgagcgaccactgcgctgccaactcatcttattcacaaatgttaattaggtccctgtcattcactccaacttggctaacatgttatcactcacagcaataccaccctgcaaaaccaagtctggatcagatatgatgttattttatcagatatttttttgacagagtagttgtttgggagctcatggatttgagcaaagctcaaagaattgtttcaacattttccatatatgttatctgcaagttgtgttagcaggaccattttggtgttattaactgagaaaaaccagtacatatattagtaaaaaatagcttcaattctcggctgggcaagttgtttgattctcagaaagcaacgacaggaacgctactgtttattaatttgtaaagtaacccaatgctaaatcaaatgattgctgacactgaataaaataaggctgcaggaat

SEQ ID NO: 78495 - DNA, 10685 bp, Oryza sativa
aatggatttataacgaaacaaatatcccatggtcgactaatgatttggggtgaatagctaatatggtccctgaaatttcgcttcgggctcagtttagtccttgaggtttcaaatcgtccaaacaaatcctctaaattaattatttgggttaatatagtccttggacccacaaaaagtgccatgtgagcatgccaagtcatcctcgtatgcaccgatatgaatgaaatgaccattctacctttatataccatatataaaagaaaacaaatgtttcacacatgtatgatcgttttagaattgtcccttatgattgctgtagccaagcactgatcgtataaattattgtcggccaccctccgcaacaatgttgggcctgggttggcctattatttttttgtttgcatcttttctttcttttctatatggtatataagggtaaaattgtcattttatttatactacagcatgcgacgatgacttggcatgctcacgtggtattctttatgggttcaagaactatattaacccaaatgataaatttggaggacttgtttggacgatttgaaacctcaaggactaaactgagcttaaagcgaaacttcagggaccatattagctattcacccaatgatttgcatggtaaataatcaagcactcagggcacatgaaaaggcataattcccccttatgtttaggaagctaatagcctttacatcacctgtctttgacagcaaatcatttttgccagataaacatatggcaacttttgatcaaatttgcactgcatcaatattcctccatcagtctttaatgtacctagaaccaacgactattgagttcaacattgtcaaaataaaatccttctgcagcctactacgctcatagtcaaacataatgtagtgttatcaatattaaattgttatacacattttcttcgtgtgttactgacttgctttacacttcaaggaaatcataaatcaacacttcaagaattattgttatcaacaaacgattatgtacaaatactgttgctgaacatacgcctaaggggactaacttacagctgaaactgaattgttaggacataggaggtatattaaactattaaaggaagaaagcatataaaaaagagcaaagccaaatagtcaaacctgcttaagagaatagcctatctacataaaatgagtaagcccattagcacagcatgttgcttcagttgatatattaacagtgttctgtagccttttaacttgctcatcagctatatttgtacaaaatactatttcttcaaacttctagctacaatttcagaacctaaattaggacataagcttatgcagcaaaaaaaggaacatctttggcatggtgcacggcatgacataatcgcaataagcaatttccagataacagaagtacatatgtacatcctattaacataaccaagctaaacatttcaggcaactaccaaatattttcagacaataatacttcttaatctacatagagagtaaacctcgttaatgctcatgcataaaaaaaatgagatcacatctacatagacatagataattagatatggcagggatagttaacaatcaagcatgaagtaaaatcacccgtggaacaacatagatcatcaaatgacccttcaaaaaaaatccagatccttcatttttttttcaccaagattcacttaatccctcaaaataaaaacaaagaacacttgtattaaggtaaaggttaggtttacctgaaaatcatattttgacagtgagaaaaaggttaggtttacctgatttagagtgtacaaagaaaatatagcgactcctagcacatcaaagcttcaaggcaaaattagtgagcggtgcatgaagaaagggaacagaagaataaatccgtgagtctaccaccatgattaagcaagaaggggaaatattacaacgtcagcaacattatgctgacaaataggacaccaagtagaaagcccctctagcagtaacattacacagttacatagctatatacagaggttagccattcacagaggagaaaatcccagcggcctcctaagtcagtaaaacttaggaacaacaattatatacagaattactgatggagcaaacacatttgacatagttgcatttttagtaacaccattcttaagagctgaaacattatatcggttttttaaatatatttgagttttccgatcagatcaaattatatgttttgtagaggcatggtactaatgctggatgtgcattgttgaatacaagacacattatggattgcacagtttcatttcctgcaccacccaaatatcatttcagcatattactgctgggcatacatattttaatttaaaaaacactcggaaggggttaccaattacagatgttgaaactgtctatttcttagagttagattcctcattccttcattgcctgctctcgtgattcctttgaatcttgtctccattttgtccaatgcttatggacatgtatatctccctgtcaatgacacacttcttcatgattcggcggcacttatattagtagtatcagcaacagtagcagcggaagttatgttccaaattagagggaagaacactttatcatttcagtttcagtagcagggagaaaaatcacctggtcttctagacgatgttcatcagtttgctgctcttccagtgggtagtctactgggcgtcgggtaggataatcattggtaccgttgaagacctgcaaacagcggtacatgctgcggatggaggttttctcgctgcgggtgatggagggagaggaaggggcggcaaagagtatgtgcggcggtgaccgatggtgccataggcgtgcgacctccaaggaatgggaagagccgcggagcaaacggcaggcgacggcgtcggtggtgtggcgagcgacagcgtcagtttttgggttgctggcatgatcgatcgagcgcgcggtggcggccatggtggtgctttagtcctcgatctgtgtggcacgacaatagtgaggagggtgacgcatcggttgcgggcagcgccggcggcacccatacccatcggccaccactacctcgcggtatcatcggcggattttccctcgaaatgcggggatgattgcacatggcagcggcagcggctggggacgacctcagctccggcgggcgcaacggtggagcgcggcggcggcggaagacctaggctccggtgggggcagcggtggagtgcggtggcggcggggacacgcgaggagggaggatgtgcggagcgaggaggagcaaatagagcggaggccggagtcttcgtgcggtggcgagagcgcaggcgaacattgcggtagatggataggatgaaatcgcggtcgcggtgaagagggtgaaatcacgggtggatggtagggattagggattagggcaatgcggatgcagatggatggttgggattcatccggtgatttggccggtaggattggagaggggcagctcctcctttttatattagtatagatgtgagtaaagaggtagggcaaactgttgaagctacacaagacgaagttaaagaaatggatcttcataaggaggatggagaagtagttgttgagacaattccatgtcctatggagtgagccgaaatggtgaaacaaaaggatgtactagtttatcaaaggaggcggttttgatagtcggtgggagaaaagcaaaatgttagtgaaagatcaggttgaagagttaccaaacctagagtgctcagtcccagaatcctctcagaccctctctcctcggtctccttggctcctcttgagataattggtaacacttctccaagtcttgaactagtagaattacctattgcatagtgtagagagattagatccaatgctagtagacctcctgtatgtcttggttttgagcatcttagttctatgcgtgacattgcaaacgatatatcatattcctatatttcaccaacatacaaaacattcattgtatcattacatattgtgcccattctgaaggattggaagcgtgcaaagcaaaatccaaggtggaaagatgcaatgaaagaaaagcttaatgcccttgcaaaaaataaggcttgggaacttgtgagacttccaccaggtgggggggaagggtggcttcccagcggaggtttgcattggtggtgtgtgtgtgtgggggggggggagtcggagctgcttgtcaagggtggcaagctcggcaatgataaccttcttttgctttcgtcttgacagcgctgtggcagcatgggttgttgtagttggcagggagagagagctagggcgaagaccctgctcgatcttgggctagagccaacgatgtcgacgcttgtgggcgcagttatccttcttgaaggtgtcattactttgctctccccttttattcgggtgaaaaccttattccaatgttcgggcggacgttgtttggcattgcgacgctatcttcctccttggaggcttcgtcttgaagaccctgcgctagttatctgtggtatgttgataggaagtcagagctcctcttctgagctcggcaaatatgacctatgtcttgtccttcagttgtgctgtcgcaagtttgttagtttgtttttcatgtgggttttgtccggttttcctctttaaaccgtgcttatgttaggattttgggcccagttttccatcaaaagctgggccaaatctcttcttcttaaatgaaaacaggcactcctggttctctatgaggttttcttcaaaaatatatataggtaattgatctggtctcgatacaggtagttgatctgtaacagctcaagacaattagtctgtgttgtattgtacgatggtggtgtgagaaaacttatcacagggtttgcattaagttcacctcaaaatttacagataacttaaatggaattgatgctgcataaattttcttcagaacaaagtaaatttggtgaaatggtgtaacggttttataattggagtgcattttcctaacattgtgcggagtacagttatagttaaattataatatgcttaacacggtgttacttgttttagaaaggtttatgttgtttatttaacagatatatctctttcactcttttgggtaagttcagattaagcttttgtagaagtaggaagctgcccatatgctcatctgagcattttgcaaaacggcgattcaattttttttatctgtaatttgtgtataccgtgcatatcagatgtttgaagggtgcacttgtgtcaccttttattttgttcatggagcttttaataatagtatggggaaaatttgatgattcatcagtccttaagactggtacttgaccctttgccagttgccacttcaagagttcaagtcgtagatatgaccgctctaaatgatccaagaactaagcaattgtggtaaggttccgttgttttttcatgttcccttctgcatatttaattaatagtatatggtatggagcttcgttaataacttctgtaatgttatgtttacagatacacaaatgctatgcaactgggtgttttgttcttggtaaagtttcacttcctaatacagtatataccactgatccgtaccactgataacacaaattcatcctacagtaaacttctcatatgttatttcttttttgtaattgaacgaaaaatccgttgctggcttgcttcagtgcttgcatcgtactattaagttgcagaacacaaacttagtttattctcaaatataaagatgcatggttaccatgtcgatctgcatgacatccatttaacacactgcttacattgttcggtctgtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccgtcctatataaggtgggcaggaggccctctagggggcatatatgacacaacctgatcgtcagatcaatacacacccggcggattcaaatccccaaacaggagtagggtattacctctcattgagagggcctgaacctgtctaaatcctttgtctctgcatccatccacttttaggtctcgtgcgctaccccgttttattattgccgaatccatgtttcgacagttggcgcgccaggtaggggctgcgtcgagcttcctatcaatttcatgagtcgccgacttcgttttcgctttgggagttttcacttcctttccgtcgaccacttcttcaagctcctcttctctgacttgatccaaatcagtcaggggaaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcaccgctgagtggtgcctccgcctacacggctggcctattatgccgccgctgttgggcgtctacgacttcaccgccggcctgcctccgtcaccgccgagtggtgcctccgcctacacggctggcctattatgccgccgctgttgggcgtctacgacttcaccgccggcctgcctccgtcgccgccgagtggtgcctccgcctacacggctggcctattatgccgtcgctgttgggcgtctacgacttcaccgccggcctgcctccgtcgccgccgactggtgtcctcgcctatatggttggttggtcacaccaccgttcatgggcgtccacgtcttcaccgccggcctgcctccgtcgccgccgagtggtgccttcgcctacacggctggcctattatgccgccgctgttgggcgtctacgtcttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctatacgattggttggtcacaccaccgttcatgggcgtccacgtcttcaccgctggcctgcctctgccgccactgactggtgtttttgcctatacggttggcggactccgccgctgttaatgggcttcatcatctacaccactggcttggttccactggcgccgactggtgtttttgtcaccattgatggactgcttcgttcccacatcggctacttttgctgtcaccgagggaatattacaaagctaagtcatcatttattttattctttatatgatattttgccttttcctttgcctcactacctcaactggttcgccgttgactagtgagtcgggggctatagatgttatatcgtattttttaaacaattttcataatatttatcttgattgcttgcgacataatctgagtacaaaagtacctatcaagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatgtttatatcagatattactcatcctatatgtttgttctgcaggatccagatccagatatgcataaaagggattcagggctttaagcttatctcttacgctccaggaatggatcagtcagaacaccaccaccggctcgcctcgaccgccgccgactggtgtttccgcctgcacggctggcctattatgccgccgttgttgggcgtctacgtcttcaccgaccggcttgccttcgccgcggccgactggtgtttccgcctgcacggctggcctttatgccgccgttgttgggcatctacgtcttcaccgaccggcttgccttcgccgcggccgactggtgtttccgcctgcacggctggcctttatgccgccgttgttgggcgtctacgtcttcaccgaccggcttgcctcgtccgccgccgactggtgcttccgcctgcacggctggcctattatgctgccgttgttgggcgtctacgtcttcaccgaccggccgccttcgccgccgccgactggtgtttccgccttcacggctggcctttatgccgccgttgttgggcgtctacgtcttcaccgaccggccgcctcgccgccgccgactggtgtttccgcctgcacggctggcctattatgccgccgttgttgggcgtctacgtcttcaccgaccggccgcctcgtccgccgccgactggtgcttccgcctgcacggctggcctattatgccgccgctgttgggcgtctacatcttcaccgaccggccgccgcatccgccgctgactggtgtcaccgcctgcacggctggcctgttatgacgccaactgatgctatctttttcacggctggctacatcaccgtcaccgctaataggcatcatcttcaacacaagctgtctacgtctgctgctgactagtgccctcacctctacgtctggtttagacagctaccactactgatgaacatcctcgtcttccgtcgccgactggttatgctgtcgccgactggtgcttttatcttcacaactgcgcgtcttcactaccggtttgcttctgttgccgccgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaaatatttcagtttggacgagctggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctgatgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcacgggtctattttatatgctcaaagactggtctatttattattccccgtaagggttatcaactgaatacttgcgccagtcgggattcaattgttatatctattttggagtatcccataagggataatcactcagatcagaagctattcatatgagctacgcttggtctatattacccggaagatttattactcgggagcatgttacatgcgtcatcctttaaagggtgtcgaaggcatattttttggcctaggcctaatatgtctgcaacccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagta

SEQ ID NO: 78496 - DNA, 36898 bp, Oryza sativa
gtagtttagaatcaggacacagtacatgcatggattgcaattctcatctctagtctctagtaataagcaagttaatattttgtatggttcagaatcaggacacggtacaatattttctgcatgcattaaatttcaagcaaagaaacagtaaacaagttaattctcatctctagtctctactcatatcagaggtcattaccagttaccacccagtcatctcttggcactatttaccccaaaactatctaaggacaattccacaacttgcatgcagaaattcatttaacagatatcatataccctagtagttgaaacatctactttactattgctcctccatataagagtggagtactttgtacaacttcacaaatgagatcttcacaggatgataaagctgaagggtatgatataaaaattaagtaccttttcagggtcctgtaagtctttgaaagcattattcaatttcacaaatgcctcctgagctgaaggatgaggacatttgtcaggatgcactagaagagataacttccagtacctgccatgcaggataagagatcagcaagaacaattaaagaaactttctgaacaacagaatgcagcatgatgaaatatattacacatgaattacaaaataaaagtatgcaatagcctttataaaatatttctatgctgcaagttattgtgtgtaataaatgctactataaattttgctgttccctcgatacatgagctacagccagcaaacaaatattacgtgaatacctcaagatacaataattagaaaaatgctaataaaacaatatatcaccacaaacataagaagaagccttaggttcaatgtcaatttacttcatgtgtaagaaacactactgcaaatttcaggtgaggtcaatggaatggtgctatttcacatgaaactgcatctactatcaggttctttagtgagaatcttaaagttttattcacagaaaggtcattttgagtgcatggtataactgcatgtgtaaatttgttctgggcaggttagaggttagggccctcatgcagtcaggcatagccaaggagaccctacccaagtggcatgacagcgcgcatggagacaagcacaccgcacaccactaggggaagggataagatggagagataaaagacacatggattcatttcttaatgaaaagagatacaaccccatcgttacatagaagggatgacctttgtgaaacttatctctgaaattaagaaatatataacaatttacagtcaaaaacatgtcagcgcataggattgaggcccgactgaggacgatgaaaactttgtagcccagggctgtatgccagcagaaattagacctaagtagtaagactgctagaaattgaatctccatataagttttccgttctttctgaatgttgggcccatttcatgaccactgttctgaaacaaattttacaaggccgcatacagggactttgtgcccaatctaatgtattaaatcatcttcaaaagaactaatgctacaagtagaaaatattgatatgataggtgttgcattcaccagaaatgactaaaacaaaaatattcttgaagccttgacatcattttttgaaagcataatgtgcaacatttgcatcttgctacagacataaaaaacgtcattgcactatgcaattgtgtggatatctgtactttaaatttgtgcttgtgacctgtaccatattttcagtgactactttgtaggcctatgaaatatgtgcatttcttcgcagtgtatactgtatatgtatgcatgtcattcgcaaattacacaactgcaaacaagaaaagcaaatgcatacaaattactaccttttcttgatgttatcagatgacatcttccaattgatgcccacaacatcatatggcgagttctcatccgccgccaatattcgagtaacctacaaccaattcaaaaaaatacaataaatagttgaatgtagcccagaaaatgaaaagcagttagttgcattgcgactttcaagcaaaaacaagtacttttggcttggagtctgaccaacctaatggaacatcaattacaattatccaaaagacaaatgagtattatacaacgaaaatgggcatacagaatatagcctaacaagaaagttagaattcacattaacaaacactgtatgtacgttcatgtgcatgtttattacagtttcataaacaccggaaaaaatctcgtaagcagttcaatcaaagatgtttcaagtagcaaacaccatatagtgccatgtgagtagagcataatttgttgcatgattatcaccagaatgaagtataaataattcaccatttaagtagattatatgatcattactgattgaatattaataaacaaatgctctggcatagagatggtaaggactgaggaccagtttttggaaaccccgcaggttactggccagtaaaccaaaaccggacttgtgccagttttgatttaagactccataactctgcatttgattctgatttcaactgaagcttattgctgctcatatgatatgtctcacacttcaaaccttgaaaaaaggaggcataaactcaaaatggctccataaaatatggctagctattccctggatgtgttgccatataccaggcaagtaggcaacaatgagcaaccacaaccagcttgagtgcggttctcatggcaatttttgtttctaatggttaagggcaggtattaccaataagctggtgtaacccggcaggaaatcggtcaagattggtctagcaatttctattaatggtgactacatcactgattgaagggccaacacaaaccactgccacactataataatagtatatcatgtgctactaacttaaaagcctataagaacgaacccacttattggtccagacaactgcaaaacatatttggtcagctacatgaagcaggaagcaaacaagaccacacaagataatctaaagtagtatattaaattttgaatctgtagaagtgttccaaaactaagggtgaaggttcaaaacatcgtgttatcactgaaaatgtacctcttcaaatcgctcagcttcatttgcagatgctgcttcagcgaccatggcaggcggtggggggcctatgagaaaaccatcatcagcttcaacttcagcatccctggagaaagaaaatgcaatcagttaatattaggagaataaacaatgaataactatattaacaattttctcgcatatcaactgagttacttttggcatcacatagctgccaatgtccatgcactgtcagttcttgacaaaatggcaaaataaggaagagataaacacaaaactgtaccgggatctaagagcctctgtcatttcagcagctgcagctagtaactcgcgtgatggcatagcaggaccaattaccctggagagggcacaaccttgtgttaagacaataaattgagttaatagataagcatctttttgtgttggatgacatttgaatgacaaataggaatttactaagaacattcagccgcattgaagaccgactaaatatcatatcgactggacaaggaattccataaaagcaacatatccgtgcaaaggataaaaatgatactagtaactaagaagcagcatgaaagagaatactgggacaccagcggttaataaggctaacacgtaactcatgcatttgcataatcatcatatggaacagacaataacagccataaagaacactggcatatccaccagaagtagaaaaattgtcagaatcctttggtactaaccatgtggcatcagtaatgactattgataacagtgatattgccaatgccttaaacattaccacctaaaatatgggcatgatatgtcattctggtgttaagtgttaacacaaggagcaaataaataaatgcacaatggacagttcaatacctattgggtatagaaagactaacacacaaccttctctcattacctatgaattaaatcatatataaatcaggtaaaaattatctgcgtgaaatatatcacaattgtatattctttttaaaagagggcaatgatggtggcagtgaatctgctaccacctcaccaagtatagtattttttttttatttaccacctactccataatgttctctaccaactagcccatgtactttaatgttataaaataacccctctacatatatgattctatcatatttcaccttacaatatagcatctacaggtacaaaattgtcccaaaaaaatcactattaatttgttttaatccgtagcaaagcatgggcatttggctagtatttgtaaaaatatcaatattctatacacatctactgtcattgtgaaaagaataaggagactaataaattatctgccaggaaaaagggcagcagctagatatttaaatgtctatgcatcaaaagatgctagagctactgctatttctcaaggaaactaatgctcttgaacactaccatcaagtggaatgcatgctgcgacaagaccacttagtaaattactaacttagtaaataccaatacttggttcttaacaagcggcctactataattagctttaaactatcaagtatcaataacattataaagatgagacattatagcagagcaatggtggaacaaaaaataattctatctgaaataataacattttctagcagaacaatggagcaaaatatagcaaatatttccaaacacataatattttcaattgtgacgaaaagaaaagctacagcaaagagccatttgttttctcgcatagattctagaacgcaggtaatttacctccgtttagggggttgttcatcagcatcatttttcgctggctcttcaggagtgctatcatttttattttgcacatcaaaattggatgatggttgttcctgtctagttggtgacgctggatttttattttcattatcagccagttcaccgctagctactaatgctgatccaacaacatcaagggtgggtacactctttggtggcaacaagtaagccccatttgagctttctctcagtttaagtgatctgaaaagtttctttaggcgcttcaccaatggcttgtcagaaattccagaaatatcaatgccttcaccattatctatcatttgaagaagctgcaaattaatagaaattcttattaatgtactattccatggggcaattagaaacggtccataggataggaaataacagtatagctggaactctgggagtgccacaaatatcattcataaactgataagacaaatgacttagcatgttcaaaatcaacaagaggtgtggatatactagttttggcatgatactaagaagcattaagggagttaagtagatctgctaatcagtaatcacaacgtattagaacaagtaactgaggacaaaccaagccaatatgacaacagacgatgagaatcaaacatgtaattagtaggttggagggtaggacaatggcattccccctattcatgtatttgatggctatagatacttaaacaaggcaatatatcaaaaaagaaaattgcattggacttaacaaggcataactgaatggagaatatggccatagttggtcctagtagttattagacatgtagttcagccagttcatcttcactgttatgactgcttaagatggacaaatagcactgaaacttcacacagttcagctaggaactcttcatggaaaaagaggtatgcctcgagcaaagcaatgaattttcatgcgatgcaattgtacgggtctgtcgacaacttaacccatactccaaaggaaattctcgtcggaaatttaaaaatgcgatagggaacgaaccctacctgacggagctccccggcgacggcggggaaatcaccgaggatgtcgcggacgatctcccgcgcctcctccgccctatccggctcctccgagcccgatcccgacgactccgacgcatcgccgccgcgcctcccgcgctcctcgtcccgccgcctccgccggcgccgccgttcatcgtcgtcgtcgcgcgagcggcgggaccggccgctgctcttgtggtggtggtggcgatgccggcgtgacgaggaggaggccttcctccgcttgctgccgctgctgcggctgcggctgcggcggtcggggctgcggctgggggaggaggcggaggatggggaaggggaggaggcggagtcggggtcggggtcggaggaggcgtcgcgggatctcctgctgctgcggccgcggccgcggcggcgcttgccttccttctccgcctcgtcgcccctccccatcttctccgacggtcggacggacctctaccttggggaagaaaggcttcttgtgaatttgtctgttacggggactggaagcctggaagggcataacctgaatggagaatattactgcctaaaccaacccttccgaaatttgataataccaaatttttttttggcaagttgatagtataaccaaagtttggttgaatagagggggttgaataggcgatttaaaactaaatgacacctaattaaaattaacctaagttgctaggcttggtgagggtcaactttaactaagcaactaagttatgttttgcaaacctagggtgatagtggctcaattatatctctacgaaagtaaatcacaatcctatgtcaatgtttagcaatcctagggtgatatgatctcaagtatgtctctagaaatgtaaattgcataaatgtaaatgcaacaatcaaataagacaaggagacaggagatttttcaccgaggttcggaaactcgccggtttcctactccccgttgaggcgagcccaactccaccgctcaaccacgaagccaccgcacgctcccttcgtcaaggggtgggcaaggcaggagccggcccacggagaggactacccaaacctcgatcactagggtagttcttccttcactccgaaggtggtgaactccaaaccactcacaaaccggcgtcgggcctcctccacaatcttctcggagaggtcacagggcaactcctccacaagccgtctaggaggcggcaacctccaagagtaacaagcgatgacccggcgtggagatgatcaatcaagtgccacactaactctacaaatggaagcaatgcacttgactcttggctaatcaaccctctaacacactagatggatgaacacaaagctcaagtgggtgtgagagaggtgcaaggggtgtatgcaattgaattgggtgccaagagagcccccttgctgctggagggggagtatttatactcccaccaaccaaaactagccgttgggggcgaaatcccccaactttgtgctctgctggtctgaccggaggtatgtggccggtcaaaccgtgctactctgcaacggctagaaaactagccgttgtagtgctgtcagagggccccatcggcctggccggtcagaccggcattgagtgggcggtcagaccggcctcagctcggtctgaccgaatacggctccgtcggctctgtatcggccaccccgagcaacaccatcccggcctccagggggccggtctaaccgcgcatgtgccgccggtcagactggccttatgcgccggttagaccgccgtctttcggccggtcagaccggccagggcacgccggtcagaccgccactatgtggccggtctgactgtccctggtcatgccgaaaccagtgaaatcccaagtgattgtgtgtgtgtgatgaaaagcgagcacaagtctaaatgcataatgacctaatgtggcaattaaaatcatctctttgctagatcattacccctcttaatagtacggcgaaactaaaaaataaactagcaaatttgatcgccctacacctcgatcaattttaaaactaaaaaactagttttaccgttttcttttcttcgcttcgcaccatcaaattttgatccatcgatagtcatctatgcgcacacatgacgtggacctaacttaaaatattatctcaataacaacggttagtccacaattagcgcttgtcattaattaccaaaattaacaacgggggcctagatgcttcaaccccgcgccatctacctcagccatgagttccactcatgacctagggcgatctaccaatcgtcgagtattgccacaaggtgaaaacggatgctgatgctctccacgacgtcggccatgccaagcagatgttttcctttacgactattccccaggctgcctcgtcttttgatttgcttctacaaggactctccaccatggtagctctgtcctccttgggtgtcgagtatctgtgacctccttcggttgcttcatctgctgaggtcgagccaccgatattggatgacaccaccgacaccaatttcttccagcccatgaccaggctttggacttcatcggcttcggcacctcatcttgctggctcatcacctagcgtcactgctagcgacaatttgtccatgggtaggcaagacaatctgtatatgagcggatctccattcggctactgctgtgcctatctctgtggatccatagggtttagaaagagtgccaccagcaggccataatgggcgaaggccggatactggtggtgcagcccaatgcctcccgactcaggtggggtgctaggctggaccctagcgtagaaatctcaggttgggctccggtataggcactgaagtaaatgtccaagtctatttcttgccgtaggctttctaccgattctagaaaatcttttaaacgatgaccatttactttaaaactgttaccttcgttgtccatagcgtaaccgctctatgcgatgaagtgtcgatgacggtgtatggttgcagccacttgcttcgtagtttcccatgccccaaaaattcttgtaaaaagttaatattacagagcaaatcaggaggtttaagatcctgcaggagtttatcctcgatttttttaatgtatagttaataatatttccctcttttttctataaagctatataattctaaatatttctagttgaatgattgatctatatcacaaactgttttcgcttgaagctatagcatcttattatttatcttctcccaagaagccatgaaagccatattttctcaatattctctcctcttgaaaaaatagattaagttataagaaagagtacgttacaaaaatgctaattcctccgtttcacattgtaagtcattctagcatttctcacattcatattgatgttaatgaatctagacattatgaatgtgagaaatggtagaataacttacattgtgaaacggaaagagtatgaagttgttcaatttaacgatattaagttcagcagttcaaaactccaaatcaatctcatcaatcctaaacagagcctttctgtagctcagtttatgaaattccccggtgactaatactaagtaattacccagcaagcttacaaatgactgctaagaaacttgcatttcgatcacttcttcacaggaagagcaaaaacaaaacgcgaacacacgaaagcacgcgttaagtgcaaaaatctacatccttaacaccggtagcttctccctgtcagttcttgatatatatgaacaacactatagccactattcatgtattacatatacttgtcttgttctcctacagggatacataaaaaacaatccccatcaacacaactactgctagaaagaactgggctctatccatcctcacatcttctacatgttgcagaaggtatatgccagaggcagcacgtgttctattcacaaactaacaacaaatgttcagcatattccacatgatcacatcacgcagcatgcacatgcccattttgctcatctgtaaccacattatctatgccattgtgctccttgctgtcagagtcattctcaatttctgactgagctttcttcagctttctaaggcggacactagtctgcttgatgcggcctttacctgggtcagacactaagagcaggcgggacataacataggacaaaagctcctccctatgggagaatgtgaaatccaagtgggcgtactcgaattcattgtaggaaacctctacaccagccttgcgcatcagcttatagtgcttctttaccatggatggtgagataactctgtctctttgcccagcgactaaatctactgggatgtcaatcagaccataatgagctcccaggtccaagggttctggtgttccatatgcttccatatttgctactggacttccatagtcatacatttggaacctttttgccctctttatttgtgcaaggtgaagtgcaacatggaatgatacaccaggcatgtcatccatgttgtagtgtggcaacccgagcactcccacccaatttgaactgtcaccgccaactacatagcccataagagtttggacaaggccgcccaaagctggatagttgttgaaatccctggccaatttgttcagtagcatccggaagaaacgtgttggtatgtaaaggccaggtataaatggagctagtactggtccaacaaacaaaatgagcttttctaccatgctgaacaccacattagaatcctcatgaaagccagcaggagatagcaagaccaatcttgataacctgtggggcttctgcgcaatccttgatgtcaccacatacattaacatcaccgcaccacccaagctgtggcagacagcacaaagcttgtatggttgattgtctctttcatcgtcctgtgaagcctgcacttccaaattttttatcttatcgttttgatcttctgtttcctcacttatgtgaggtctacttttgccaagttctgaagttttaatcttgtgaatttcttcaacaattgctggcatatctttggttccatgttcattaacagaatatttccagtacctagcatggatagacaaaaacaaataagacatgaaaaaaatacagagaccaaaatgacataacctacaatagatttcctgcatgcagtaaaaaacctgatatgctttgctagtattactgcattacttacttgtaggaagaaatatttttatcaacatgctccctggagactaaaccacgcagatttccaagaaaaacatcataacctgcattcacccataaaggatttttagcattcactccatacatctgcagtatattatatccagttttaaatactgaccttgatcatatgctgcaaatgcaggtgagccaacaacaccattcgatacccaactgcaagagaaacgacatggaatcaggggaaaccaaactgtatgcttcagataaactacatagaaactggatagatacaaaactatttgaagtttatttgactaaccactactgcatattttcattttactgaaaaacattaacagtacgatcttcaacaacacagtaacatagtgtgctcatacttttgtatgtgtgaattgatcattcgattataaacaaacattagcgctttgatgtcaaagttctttaaggaactaatataactgcagaaacagattctcagagtggatattgtgacattcagcttacgacattatcagtcaggagcaactacattataaatcccaagtctgatatgatgatcaatagcaagattgtggatcatcgaattttattagggatggcagcgggctgggtcgggcacgggcagagtgattccatgcctgacccaagacccatgtgcccacgcccgacccacgcccgcaaagtctatcgggtaaaatctcatgcacgtgcccatgcccgtcgggcacaggcatgcccgacgggtgcccaactggtgcatcaagggtgaggaagaggtagttgtggaggtggtcgcagccggtgaggaagacctggaggtggagccatggaggcacggtggcgaccggtgaggaagaggtggaggtggagacggtagcggctggtcagatctggcaacggagaggagagcccatggcgaccggatccatagaccaggtgacggagagacgacgacaatggcaggcgagcagcgatagagagatgagggcggtaggagtcacgtagtcacgctaggactcagcaaccaaaagccagcaacaagcaaaccattgactacacagcgtgagcacaccaagcgagggaaggaggggggaaacgggaggcactgcgctggtctcacggtctcacctggtaggggctcaccgccggcgtggtcgtcgacttgataatgatgccgctgccgctaccagcatgcataatctcgcagccgccaccgccgacgacaccttgcctcgccatcgcccgcctccggcctcctccacctcctcgccgcgcttcccttctctctctccccctaatccatgacttgctttggcttcatctactttgcctctcgcttttgctgccacagcagctggccgcgtttccgctcacctcgcttcgcttctccctctctgcttgacgcgttgacgcgttggcggtgatgagagagacacacacacacacacagagagagagagagagagagagagaggagttgggtttcgggggccggtgggtggtggggttaccgcctggtggaagctggctagtggcgtgcaacatgtggttggtttccctgaaacttggctatacatatgtccattgctaatgggccaaatgggccaaaaggaaggggaatgagaatgaaggtatgtgccaaaatcaataatacatataccgggttggacatgggttacccgcgggtaaaaaatgagaccctgctgctacccaccacattgtcgggtctcgggtgggcatgcccacaagcaaaatattacacccatgcccatgcccattgggccaggtatccgcggatacccggacccatggggaaaattgccatccctaaattttatggtctgctgagtcattagtaatttagtataaaagcgaacagcaaaggcagcacctgaaatttttctagaatagcatcaacttcaatatcaaaacctactataccagctcatatttctcaatatcaactattcattactggagtaaaaagccatcaccttatcgcatcaactacagtcagggtccaattcgcatacaaatcatattatccaactagtcaaggacaagctaactcagggcaacctctttcctatcaattggcttgtttttacagtctattaagtgggaaggtaatgccaatataaatacataaatagagaaaaaaggaacaacagcaacagatcaaacggcatacaactaacaaattaaaatacatttataaagaaccaacaccaaacatgtaagaaattagaaacgccatcatgactaagcatttgattgtgactcaccccattgatgagtccagtattccatgttgcagcaataccaccttctgtgaatcacgcctaaaaattggatgcttcatatctcaatctccgtaacacaactgttgagaaatatattaacatgcaataattataattcataccttggaattctctccagcagtaggacatatccatctgaagtaacaacttttatagcctcaaaagggtacctgaaaaagatgtgatgagattaacaatttgacaatgaacactgatgcaaaaggatttaatgcaaaataaaccgaactgactgaacagaaaatagagatcgtacaagactctagattcataaacaattataggaattcgcacattaaccaaaacatggtccagattcatttgacacgagaaaaattacgcacttgactgataaaacctaaaaaataatgggtaacacatcttgaaattcaagcatagctcaagcgtcaaggataactagatctattagaataacaccaacgcaagcccttagcaacaatttgacacaaagcaaatataacgaaaagcagaaaatcactggaaaggacatacccacaaatttgtggcaaatgcaactgagtaaacagtactaaaacaccttaaaatgctaaaaatgctcattcaggattatgcatccattaagtttgaacaatatacatacatgtttacgattctattactaaaccatactaacatataggtcgatcacctacccaagctcagtgataacatcttcacatgtccgagaatccgtgttcaaaggatggcgatatatagtcttcctttcagttggggctggattgtcactgccaacattagctgttggtacatcaacaacagggctactgctgccatgaatccagcaaaataatttcttccacacctcagaaggagaaagaacataatgcgcgcctttatgaacaatgtcaaacactgattcgatgaaaatctcaattgcaagatggaggtcctaaatttgaaagaaaaaaaaagagatcagggtgtgactaagtggacatagaaaccactaaatgaatttcttcagggaaataggttaaacaataatcacaactttgtcatgccataagatagacaaactaagggtccacttttataaaagtagtacctcaacaactccacgcctcctgtcagttgttcgttggagaacttgatccttaatgtgaagccctctcctagaacggaagttcctagaaatatggggactttctgggggtttattagatgtctgcatgatccgaaatttgatagcgttgaacagaatcaccagcaaagagacaagaaatctggcaggccaaagaatccatgaaattgcatatctaataggtcttctcaagcggcgatcacgcctactgaaactgcttgtatgtgataatcgtgaactttgggacaatggagatgaaggacatataaaatcttcgttttcatcatccccagggatcgagtcagtaactgattcaccatcagaatcgacagagagttcatgaataaactcattgaacgatgaaaccccactgatatcagaacaaataagtgtagtcatcagaaagagagagaaaaattttcatcacagaaatagatgtggaatctgttacattaaccatacataagtcataatattaataatacaaaacaaaacttcataaagctaaaatggtaggcgtaagatctcatgcaggtgaaaataatccggtccatattgttcagtcattacatattatggtacaaattttattcaaaattctaaagacccattggtacttatcacatttttccagcaaacaaagagaagctttcattgggcagagcccctcctaagcatacattggcacaaaccaaatgcaaaatggcaagcagcacatacagaaattcaagattattgaattcacttcatgttaatgatcactcactatcttgtcctcctcggttacaatagaacattccttaaccatgccaaaaagctactccctccattccataatataaggcacaaccactttttgaagatgctccataatataaggcatgcatgcatgtaggcaattaactatgaccccttctacattaaattattacttttttaaatcctccactctcatattctctaattctattggatacatgcattgtatttattaggatgatccaaactacaagatgataataattattttcttggtctttgggttaggggtggttatgccttatattttggaattgagggagtattatataggcctacaaatgcacgactgagaaattgctttgtagaaaaagctatgaaggttttgcagggacaaaaataaactgcgtggatttgttgcttgtagatggggaaaaaaatagtgagttaccaacttgtgtccaaaaccacagagaaaaaaatggcaggagacaggagtgcaattaatatcacaagttgtaaatatctagcataattaagtcaatgaaaataagataacctttccatccaacgaggaagacgtgggccacggaatgatggtctaagttcccagccactgatgccttctaacatgttggccttccctggtaatagagtcaacaggagtgctgatattccatttatcaaccttgcaatattgttcagtgattcatatgtgaatgtcttcacagatctggccaaacaaatgcaagaattcaatagtgcatctcattcatacagaaaggctaaaataagagcaacttaactggcatcttataaacttcacagtagagatagcatgcatggtttttgtttttttattgaagcatgaaaactatccataaacaagtacaagcaagtaaaccccagaccacaaatgcacttagcaaagacataaatactacattgaaaaaagaacaacttagaaagcctgggacactcatagacaaaatgtcagaaatttgcattctaaggtacaagtcagcaatcagcccatatttgtccaaggctttcagctcttggaatcatctacaaagaaagattaaaaaaaaacaaggccagaactggtctttatggttcaaattccacatccatacttatgtgtgagaccaagaagaggttaacaaacagcatagcagccaacgatggggcaaagcggtgttgagtaggaagttcacacttaacaacggtgtcaagcgaaatggccccatgtcattgagatccttattaactgaaatctcagtgatcttaggccctgttctttttcagctacttcatcaagttatatggtggattatttgctccatgtctctaaaaatacctttaattttcaaaagaaactttcttctaatgcattcttacaccacttgttgtacggtacttattaagtttatttctaaaaatatttaatttatccctacaatcaagtacataatccgtttaataatctgtttcaaactgggacctttgtgcagccggcataattcagtaattcacaattctacacacaaggtatcatggtactactactaaaaaattagtgcttagccaatagcgacgccatatttttctgcccaccccttaccctcccctccctcctctcagcatctcctcgtttaacattttgacattgaacctaatccaacaaattctcgtttcatggctattctggagagatgaatgagctataaaaatccccgacatctaacctcagcgctcaatccaaaatccctagcatgaaatcctaccctaccgaggcaccgaccactccccctaacgcgccacccccacccatgacccatgacccacctcggctcgccgatcctccgcaccctagccaaccattcatcaaaacacccgcaaacaaaacgaagtaagcaagccccccaccgcggggaggtagggatcgaggggagagagaggggcggatgggtgggtgtgctcactccttgatgacggcgatgacgttgtcgacgaactcctgcagcattatcgcccgccgattcgcgaacgggagccgcggattcggggcgccacggcgtcttctggaagcttcggcgaagcgcgagggcgagggcgaggcgcggaaggctgaagaaatccggagggaaggcgacgatggcgcacagcgaacggggacggagacggcgaagccaaaggaaggaggggggcttgggcggtttgggcccacctatttccgtagccgcatcgtgtggaaagaaaaaattaaagtggggaataacctggtccgcggaatacaccggccgcgtggatgtgagcatgacatgtgggccatgctgggagatcatggcccacgtgccgggtgtctcatcgggtcttgttgcgtgacgtggaaggttagtttatcccgcggagcactgttcgaccccctgtatgctacgacaaagggggctttgattgggatagctttgtgaccgacaggtgggtccaggaactctgtgggctcaaatgtcaggcaggcgatctcatctgggttagccgcagcggggtgtgttttctttttatacttttctttctttttttaggagcatataaaaggtttcgtgcggagcgaagcgtgggataatgccgtggtggtgacgtgtcgccgtctgttgtttctctaccatgcgtgcgaacacgtgccgatgtcttggagcggtctctgtttgaggttaggcccggctcttgctatgacatcattcatcatcatcaatcatttttctcaatttctaattttttttaaactcctaaacctttgtgttacataatggattttcattaatacggcctctatattcacgaaggatatacacaactaaaaagatacaagagcccttagattcaaacctcatcaaagagaacattcaaccaaaaagaaaaacctatgacctcggcacattcttgcttcccgacatcttctcctgaaacagtcaaaatcgacgagtggaagttgtttggtcatcactgattggtaataaaaacttccaagaatgtgccactcgttcttaaataaaacattgattatgagaattagggagatgccaactgattggtgcaaactttgtgtgtggagatggtgcctgtaaaaagatggggctcacaagctaaattgagaacctttcacaagctaatttgagaaccttttcctttaggatatcgtctaaattgagaaccttttcctttaggatatctttaggatatcgtctaaattgagaaccttttcctttaggatatcgtgctacagaatatatgtatcacttctttgttttgctacagaaggtggagcagtttttatcttcttagtttttgtttatatgtatttataacaattattctattctagatcaattatttgtgtagatcaattatttacacctcttgcatagaaaccaccaaatacagcatatgggattctttattgcctcatgatttttgtttatctatgccaacatttacagacgcccaagccctcaatgctgggctccgtgcagacgtgagccggcacaattgtctgcttctccatgtgctccccagatagattgggtatccacatcaagaataggtaattcagaaaacataagacacaattatacttcaatttaattatactatgttatttaattatgctatattatgtttattcttcatctttcaatcagtttctaaccagtgaagtccttatttacgggaaattgtcaagtaatctctattgtacgtgttcttgatcgaaggatatagtggtgcatgtgtattcagtggtagtactctcaaacaaaaatattgagcatttgatgtacatcagaattgtactaagaagaacaaaattgtgtgccataatgaatccaagaatttaaatttgatttatttggaaaaaaattgcttacaacagtctacgtataaaatctaattgtactaccatcattatggttttttaaataataaaaatgttctcccttgcagtttggcaagtttaatttaagcaatttgtccaatttaattcatatactgatttttacgtgcattgcacgtggacgattactggcaggaagaaaagccagaccgggcaccgaaccagccaagcgcttggttcatcggtccagttggacttctcaaggtcaatgagatataaattttactaaacttgctaattgtcatactaaagatttatcttctctggcatgcaggtatttacattactagctatatttgtttgttttactttgtttgttgttctgggggctcattgtcatctcaagttcatgcagttttgtaacattgctttctggtccctgcgacaacgtgcgaggacaaacttgatttttatgtttactagtgagcgtgcacgtgcaaagcacatcttgcacgtcgatatatatatactctctcaggaattcatcttggctctagctgctgggcgcgtggctccagcgacaagttggaggcgatagcaacggtgattcacgacccatggcgcagctcaccctctgcctttgatcatgatccatcctgttcacaaataatcgcacaagttatatagctactaatgcaatgaacaaagatatctaaaggaacaatagattcttgcagtgtgtgctatagtccttccataatttgtccaactcatatggcccaaagcaaagtatttgttcaaaatatatgtagttctgtgaaatttactctgaataaaattatgtcgactaccttcaaatgttttgcatgcctcttgttcaagcaaaattgggtgatgtaataagaaagtaggtctcaagcaccatagatgcttcatgcttgcctgcaaaatagcaattgacataagattggagtatttcctgtgcgaaatctgttgtctaccaaagaattggcagtagcccttatgtgaagaaataaacacactgatcttaaatataagaaaacaaaaatattgattttcagttgcttatccagtgtgtagcagcatggacagttactgaggatgacaaaaagcattggttggcaggaaactacaaatgcattgcaagcaaccaacagaagtgctcaattcatagcaaatacagcccatacattgaaatgttaaaaaaaacagcgtggtctgttaaaccggcctgcatttgtaataaaatcaagtttggactatcaaagtacatgttgaacagtaagagattcatatttcacaccacacatttatataggctcctagaacaaattcatatatcgaataaatcaatcaaaatagattatgcatgcaaaattaattccaattgtcactgaatttagctgggtggcataatttttacagtactatattcactaattccaagcattcaaatttgtacaggaccatctataattttgttttgaacatgtaacagcttcgtggattgcaaaaaacagaaaatgtgcagcacaaaaccaagttagtttcataaaaaaaaagttcaatgattaggagtagatgagaaaaccaatcttaaaacgtgaatataattgcagggaatgaaattgtgtatattgaaaatgcaaggaaaacaccgattaacttgatcattacctttatgtcttgttctaactccatcactaacagcatccccttcactgatcaaaacagttgatgagcacatccaagacccatagaaggcctgctccaacagagaagaatataagcacaatagagctatgtgttcatcagtaaaaaaaaaaaagtaatgcaatgcatcacgtgaattgctacctacaatagtgtctcaaatcaaagctttgtcactgcacagtagaaattaacgtaggcggcatgcatttttatcaggaaggctgaaatgaagggaaatagacagctccaagcctccaaccaatctgaaaatgcatcatttaccataagtagtgatctatggccatgtggtttgtcaacatgatttcttttgggcagcatcataggaggcataactctctttgttctaaataaacatgatgcctataaatgtatatctccagaaattttaggaacaaacatgttaccattcagtatcacggttcctgaacaggcttgggtagcaccaaagccagcataatttgtgatatctcttatgggcacccttcataatttgtgaacctacacagacatgtactcttattttgggagtacataattcacatgtcatggtgaattttttttttctcatggttaagtttggacccaatgggatctatgcaacctgatagagatgtagtcgcctccttcttacgttgtttatacttacagttcttttgaagcctagcttgtttctgttctgtagagagtgaagcatacctctccctttcatgctttctcctaacctcggcagcagttaagtttgattatgcagtgcgcctcttcctaaaacatgtggcatggaaaagtaaaatcaaaccattatgtgataaaaatgtgttgtggccagaaaaatattaattatagcaagatagtgaagataaaacttcagaaagaacatacttgactgtgttgaaaattctgctgtggcgttcgcattgtttttcactgtattaagatgccgcctcatggttgcttacggttgtagcactgtgaaagtcagacactgaaatagcatagagcatataccatgtaaatcaccgtctgaaataacataaagcatgtaagtcagaaactgaaataacctccagacataccaatttactgaaagtgactgtcttgattcattctatgtcgatcagttaaggaagctaattggagttcggtgtttgcgttaatcttgaatgtgaccaactgagcatggactgacatagatggatgaatttgtgcgaacaaagaagtcagcactgtgctcaccgtagggcgaggcggcgagggcgggacggacctgaaagcgcagtgccggcgcgagcagacctcgcctctccttcctctcagtcgcgtagagagcagggaagcagggtcaccgacgagcggagggctggctagctgtcaaacttgtcaaacttcatatccattcttacagggaagcagggtcaccggcgaggaggctcaggcggtaagcggagacggagggctggcagcggggtagggagtgcgcctaagccggcggcggcgcccggctgtcctgtagtcggaggcggcggagggttggcggcgggcgcgcgccctgagccggcggctgtccggcggtcggagacggcagagggctggcggcggcgggctggtgcgcgcgaggaagagaagagcggcggcgggctggcgcaggaaaggaaaaattgtttttttttgttactttgaccgatcggtaaccgctgtttagaggtggtagaacggacagatccaaaccttgatatgagctgttggatatacagactaagggttagaaaagatatttaatgaactggtatttttatattagtagattaatttaactaaatatcccaattgcacgcaaataatctaattgcgaaattaggactatgtggcaaactcgatgctggatcctggatggggggtggacacgatgtattgtaccgaactatcgatcaagacactacaatcacataatatttgtcctctgaaatatttaacaataatgctagacaattttgatcggattaaccaagtaaagttggcctctataacggttgggcgatagcaaaagatcatagcaaagccagtagcaatttgtactagcaataaattaggttgacataaggaggaacatattactagttatatcatttgcaattgtctgaatctcagtatgttggttggaccaatcatatattttattgagataggtaactgacccgaaaccccctcggagaaccgtatattagaatttcatctcgtccaactcaagcggaaacacaaatttttaatggataaaaaaagtttcaaaacttaacttcattggattgggtcgatttgccttgaagatatggtttgcctgtgttgatgtacccaattttaaattttagaatcactttagaggggattttccgtcttttttgtcatttaaccttatagaacactaagaatttttttaagaagggatagaacactaagaattactcgtatgtttttttttactttaatcatgtgttttcaacgtataaaccgcaacccaaacaaatctgaaacaatcacgcacttagttaaccctctttacaggaagagagtttattcaacatgctcatatcacaggatttctattagcatcaagcaccggtacacaaactcattactagtatatttatctgatctcctttcatcagtatcactacggcaagtcaatttggtggtaggcgtggtgggcgcgggaatgcccgtatcgcagcatagatcagctcctctcggccaactggagcaggagtgggcagtgcagacgctggataagggaaaatgcagttctttgcatgagattcggaaatagtaatataaactgaattttgctgagaaccagaagctgagaaacaggttagtatagagcaaaccttgaacgtcagcagattggagtacagcggtacccatcagtggcgggcccaggatttagaggttgggtattcgaaataggtaggggtaaaacaaaattctttttacttctagaagtccaataattaattggtataatattacacattactaattgtataatattatagcatatggccataactttataaattgatagaattgatcataagtccaaattctttaacatatataagtactaattgttcgacatatgaaagtggcaacatatataacatgtaaaggatagaaaatggtaaaatgataaaaaaaaacttacaatttagaggagaacttttcaatgcttgatattttaaaaatgagtgatgatgtcctcatcctttaacttgtacaaaaaattctcttccaataaatgtagattgttgctcatcttgcttcttgtttttatatagttcatcgaagaaaacaccctctctaaattctctaaattcctaacaacagctcatatatagcctcatactatcatcatatatataaatttaacacactgaaaattaaatattatggttctaagttatctaaattcctaatatttacagctttatactatcaatctgtcaataaatatacacttaacagttaacactctgaaaaataaagaagacaggaactgaggaagttgaatccttcggtgctagtgaactattgaactactatagaacaaatcaatgaaacaagccgtcgccaccggaaaacataactactattgaactacctagaacaaatcaatgcaatgaatcaatgaatcaagcccctcacgcaatccatgccaggccggcaagccgtggtcgttcggctgccgcatcgcgtacctgtgtggtggcctggtggactggcggcctgcacgcctggccgagccccaacgccgcacggccgcagccgtcgacgcgccgcctgcacgcctcggcgcctcctgccgccgacgcagccgcgcacgccgcagccggaagcctctgccgcagccgccgacgagcacgctgcagactagactgcagtcgccgccgcccgacgcgctgcctaggctcctacccgccttggcgccgccttccgccgacgcagcaggaagtcgccgccgccgcactgccgcacgtcctcgccgccacaccgcgcacgtcctcggtcctctggttagggtttggccgatttgggaattagggctttggtttgctgtgcctaggcgaggaggggaaatgaactagttgtggcccaaactgattgtgggctgagatgaaaggggagggaagtgggaaatttaggcccaatagagaagaaacgatgaaacagggcccaaaatgagtagttttagcctttttctttaatttcttgaatacatatacgaggtatagagtacatatacttattttttttgtctaaaaatcttgggtatacgtctgaatacccttgaatcaatagtgggcccgcccctggtacccatcgttgggttgatcgtaggtccatctcttgctactgcaggagatgcaaggctgctaacaaaaaccactaaaataatgaagaatgctttgaacgccatcgtcactcgtctattgtttttctcagcttatgacagaaagcttcctatggtcctccaatttatagttggcaaggaatgtttcagcagcctaattctggtaataaacaaaccagcaaaaatcctattcgataaggttttgcagttttgctttaacccaaacagaaactatgattgtggctcgatggtatcaacatctcctaggctgcctaactcaatagtcccttgaaacacatgtttttcttttattagaatataattatatgatattttattgtaaagatttaattacaacgaatataatggtacaatcatattacaaattggataaatagtgtaaaagaaaaaaaatatttaaagcaagaaagaggaaaatataataacaagcaacctagagtattatatgactgtgtgttgcaactggtgaatgctaattcaatcttattgttgttactagcaaaaatgctcgtgtgttgcaacgggtgaaaaaaattctaacgataatatactttttcatgcataatcatgtcaatgacaatatttatattttaatgagcgacatgtttttttataaacgatgtattttttttcttgcgcgattttctcaaaccatttttcaaaaatggcgtatttttttctaacaatttttttcctagcatgttctttttgcttttttttactggcgacgaaaaccatatttttctctttttttgcttttcttttttcgtgtgtttttttatgttttttctgacaattattttctcacgcgcgttttttgcttgtttttttcgaatgttcttttttgccttttccaatacaggaaaatatatgacgaaataaaagacgtgtagtagatgacaaaaaatcgatggatcctacccggctcaagcgtccatcaatttagcgttttttctgacagatttttcggactgatttgtttttttaatagacgatgtttttttttggcacggttttttcaaaccattttttagaaatggcgtgttttttctgatagttttttcatcgcatgtttttttaaatttttttaccgacgatggaaataatttttctcgcgcgtttatttattttttatggaagatagaaaacctgtttagcgtgttttttttgcgtttttttctgacttttctcacacgtttctttgaaccgtttttattttgttgtgcattttctctttttaaatagttagattagattagacatagcgaagagatatatactgattagaaatcggaatttgtttctccctttccatttttttttctcgcgcatattttttattttacatgaaccatttttttcttcttagagaatgggacgaacttttttagatgttttttcaaaaatttttcgcctttataggaatcgaacttttttttaaaggtatcagatctcgcttttttttcaccatttttttgccttttataggaattggatctacggttttttttgccacttaggagaaacggagttttgttgttgttgtttttctttctttttctttattttcttttttttgtgcggtttttctttttctttttatgcagctttctgcctttgttctttcccttttatttttttaataaaaaacgaccttaagtatcttattgcaagattatagggacttagatataaatataaaaattatagggactcaaatacaaaagtacagactcaaaatttaaaatcatataaaaataaaatgctctcgaccgataggttccgtttttgcaaacagatcttcaatccgacacatcaattttattttttgtttttaagggtgaattggatctatagtgggacttgtttttccctttctgagagggaattggtaggagtcggactttatttatttatttttcgctattttttttaataagtagatagatagatagatagatagatagataacagaagttagggattagagattagatctgttcccttttgtgattaggaatttagattgtttatttatttttttagaaataaaaagaaaaaaagatctcgggagatggggaggagattttttttccgcctccgattcgcttttgtttttttgttgccacgtttttctttttaggatctctcttttttttaagttagacggacgacggaaacatcataattttttttttgcgggggaagacaggggttttattaaacttcagaataaggattacaatcctgagccagttgctcagcaacacacaccggcgcctgcaggcgcaagaccactgcctccctattccgaatggctagctgagcaagctcatgagccaccttattagcacccctgcgaatcagagccgtacgagcttcaggagcagcacgcatacccgctctcacttccctgattagtggccaaatctgggacctattagccgctgccaacctcagatagctatcaacaccggcacaatccgtttctagaatgcatggctccttgacccactcatttgcaagccatattccttccctgcacgcagctgcttcggcaaattcggccgatgcgcagttcctgatcagcttctaggaagtgagtaaaacattcccctcactgttccgaataacaatgccgacgctaccagtgctagtctgcggaacatagtccacgtttattttcacccatcccatagctggtgcctgccacacacctgccacttgggttctttcccggcacccattcacatcactttgtcttccctccgacactgtttttcctttctcattttcctgcattgcactgctagacgggcacaaggaatcccaaagattcagaaggaaagctgtagatcccttcaccgtcgcttgcccagaaccgaaaacacagtcattgcgcaggtaccatgctcgccataggacaaggagaaactgcgcccgctccttttcgctcagcttatcgagtcccccaagaagccaccccggacctagcttcgacagggaacgctcatccggtaacctccagctcgcccgaagagtttctcggagggcccttggctaggtacatgaaatcaccgcatgaaactcatcttcctccccatggccgcagatagtacaggtcgcatctgcttgcagctttcgtttacacctgttctgctgggtagccagataatttcgggctagacgccaggcgaaaatacggacctttggtggcacaggcgtactccaaattcttcgccaaatggagcgatcactgtccgcttctctactactgccttctccatccggatggaacttgttcaaccacgctaaacgataagcagacctcactgagaaaatcccagatttttcgtagtgccaagctaggaaatcctcatcctggtatggcgacaaattgatttcaagatctcttccacatcaagtgggtgacagacgtgcatgatcagatcaacgtcccagctcttttccccttgtttcagcagctgcgagacccagcgaagacggcagcgtccgctccttcccataagcatgagagaggaggctcggggaatccatttatcccgccaaatcctgaccttggtcccatcaccaattcgccatataagtcctgtcttcagcaattgcagcccatgttcaatccctttccatgtcggagacacttcagctgggaagaccgcatctactagctcacaattagggaaatacttagcctttaaaacccacacacataaactatcagggaattgaattagcctccatgcctggcgggcaagcaaggcctgattgaagagcttcatatcgcggaaccccagacctcccattcctttaggccgagtaatattttaccaagcacaccagtggatcttccttttattctcctcatcaccccaccagaaatctcgaatcatcatcgtataagcctcgcaggtagaagctggcagcttgaacactcccatcaaatatgtcggtatagcttgcaccaccgacttaattagaacatctttagcccctgatgacatatgtttctcagcccagctatccattctttttgccagtctctcttcagtaggtttaaatcgtcccgcatgcattctaccttccggtgttggaagtccgagatacttactttcaaacgccggtgtttccacttgcagaatctccttcaccacttccacagtcgcatcagggcaacttctcccaaccaagagagagcattttccgggacttaagagctggccagtacaggcttggaagcaggttagggcattctggactacagtagcttgttgcaggcaggcacggaagaagagcaggctatcgtctgcaaacaacaaatgtgagataccagggctccgacggcatactttaagctccgttaagcgccctgcctccacctcccggttaagcacagatgacaaaccctcagccacaaacaggaaaaggtatggggacagaggatccccttgtctcaacccgcgagtaggggagaaggcctctagaagagacccattgaaattcacagagaacttaacagtcgttacacattccattatccaatcaacccattgtctgcagaagccaaccttcaagagagctctttccaggaagtcccaatctactcgatcatatgccttgctgaggtcaagtttgtaagcacagaagctattatccgggctgttgttcctttggatagcgtggatgctttcaaaggcaattaacacattatccgtaatcattctttcaggaataaatgcactctgggtggatgaaatgatatccgatagcaaaggacgaagtctattaaccaaacacttagagattaccttgtagatcacattacacaggcttattggacggaactcctttagattttctggctgtttcacctttggaataaggacaatggatgtgttatttacctcatctggcatagcacaatctgcaaaaaactttctaactgctgccattatctcccctttaagcgtgtcccaatttctttgaaagaaacgagctgggaagccatcaggtcctggggccttgataggaccgatctgaaacaacgcatctgagatttcctcatcggaaaagggcttgcataactccaagttcatgggttcgtcaaccagctcttgagcagatccaccacttctgctggggtaacggaatgatctttcgtgtacaacttctggaaaaaagctgtagccatttgttctaattgttccttgttctccacatacttgctatcttcatcttttaaacggatgattttattcttcttagctctccatgccgcatgtctatgaaaatatttagtattgcggtcaccctccttcagccaagaaatccttgatcgttggagccacatcatctcttctcgatataggagctcgtccatccgtctataaatcgtactgatttcgtcggaatgatcagctgaaggatccagcaagagagcttcaaccttctgacgaagatctttcagttcctttgagaccgaatcgaaaacctttatgctccactcacgtagggaggacataaccttcctcagcttcacagccacttcacctagatctgctgccaacaaatcctgctgctaggcgagttttataacttcactgagagactcctccctctcccacatgatctcataacggaagacattcgtcggggtagacgatcgctttgttagacacaacaggatagggcaatgatcagacctgggagacacaaggtgcaacaattttgcttctgagaagtgattcgaccagcttggggaggcgacagcccggtccaacctcactttcacattcctatcccctctctgtccattatcatatgtccaagggcgacccaagaagcctatgtcatgcagatcacaatgagatagtacctctctaaaatccatcatctgtttttctggtctccttctcgccgagaactgctcgaaagaccaaagagtttcattgaaatcgcccatcatcaaccacagggcatttgagactggttttatgcgacggatcagctcccacataagatgcctatccgtggtcttcggctcaccgtaaacaaaggtacatctccataaaaaaccatctcccggatttctgattagcacatcaatatacatgttactcatcgacaagagatcaacggttatagtctcatcccaaaacagcgctataccaccacccgatccttcccctttcattgataggaagtgtttcaatcctagcctccatctcagttgctgcagcttcccctcatcctgacgagtttcagatagaaacactaacttggggctgtagtaacgcactagacgtataagttcatgaactgttcgagggcgccccaaccctcaacagttcgaaaccatcacattcattgctcctggtggggctcatcctgagcgcccaccaggtctggcaccaatgcttccttcagcattgcatgtgcctcactagaatcctcacttgtatccttagcatccggctgtaccatgtgattaaaaggctcaatatcactagcagacagtttgatattcatttttctcggtttcccaatgtcccttctcctgataaagaccctggcgctactcgatttttcaacctcacgagaaggcagtccctgcatcttttttattaaccagtctggggacttccttctgacctatgtctgcgctcctccagcttttgccgaatctacctcatcagctttatcatccgatagaccatagtcagaactcatagaaactctctctctactgcaaggcccacgagcaaccaaattcagactgggaccaatatcttccacctgcatctgctgcacacttttgcccaaaatctcatctgctccacacatatcatcctttactaactcagtaacagcttcgtcatccttccgaacccccaagtttgcgggcgtaccacctcgagcacgacttacctgcgaattcctagatgaactggactcagaaaggactttatccttctgaggtccaacaaaatttagccctctgactactcttggtgctgatgaagaacccatctactgcacacgattcctcaacggtgaagcacgcagctccttccgatatctcacaggattatcagacattccttcctctggacactccctttcagcatggccaatgcgcctgcatgagaagcagaagaacgatacgttttcatactttattgggcacgatataatacctcttcctttgattctcatcttaatgcaggtttttagagcattagcaagtgaaaactgcactttgactcgcaaaaagttaaacatcgccccttgcacttcaatcaccgcacccagtttctcgcccaaaaacctgtggtcatcattacctccgagagatcgaagaacctgacccagaggggaatagagtcaatgacaacctctaacggtctcacaataccatcatagggaactactatcaatgcatcccccttgtgcttccaagggcccccattaataaccctcttcaaatcagcttcacagccgaactcaatcaagaatttgttttctcctaagtctcgggttcttcttgtctcatgtaaaccccatgccgtactcatctcctcaaacaaacccttcacattgtaccgttgccctgaatagaacctcgccagtgccagccacttaacctcctattcctgttctaactctcccagatcaacataaaaaagatcctcctccgcctcatccacagaatccagattttcgccaaaaagcacaatcgccttgttaagcccggaagcctgacttgcagaaccagcccccaaacctttcaaagtttggtcaatagttgcacccagctcgccggccagcaatccgatctcatcgttctcgccaacccccgttcttccatctatcagccccctaacttgcacatctttgccagcgtccatcgctcgttcgcagatcatgcagatccacccgtcaacggcttcgggtgggtagatccctcaccgggttccccttgatcaccctcaccgtcaacaagaggaagagcacgtgaagaggagacgaatcgacaggcagaagaaaccagtaccccaaccttggctagggtttcagcagaccagcaacccgaggacaaaggcacgacctcggaaggaagagtccggactaaaaatagatcacagccaatccgcccccgattacaacgtggcggtataaatccagcgaatcacaacagaaactcctcaattaccttaatctccacgtaaaatcgcagagaccagaacggagatgatcagatgagattcaatggcgaaaccctagaattgcctaagaatcgcctcccgtaatcttcggagccataactaataaaaatcatctagggtctcattcatcataaattttttaagtagtaacagatatgatttagttagggtgaaatacaatgtggaaatttgcttcatattttttttagaaaatcatgagttataattaggagtctaactttcatctcaagttagcatgtaatttttttctaaaaagatttcttatacgactccttttgtatttctaaaagccaacgaacttaaaatctgacttaaacacggatttgtagtttcaagaatgaacgtttaaaaactgactcaaatacaaatgacgtattaaatactgtcaaaaatatctttaatttttataacagtagagaagagatacagatgaggaccgatttcttttctctaaatcgggctacggatgcagagcaatctcgactagaccctcccctgagaaaacggccttgggctgatcggaggccaccattagggcaatagggcgtcgctgaagtatctcaggccgctctccgccgccctaattctccaatcggggaggtaaagatcaactttcccccttttttttgttctggttttctcccttcaattccgtctttcagagccactcctctcaacaaatcctcacacatcgtatattttttgtttgatatacgacggacaagcgttcaatttcagtttctttctctggctctctaaattactggtcaattgatccacaagagtagggattgtagtactctttggtgaatctgtcaggctggttctcgattggttggtgagactaccatttccctctgatctatgaactcctttattttgagtaccacttgcatcatagtgcattgttagtgttcgaaaattctctctctcccccaaattttcaacaaagtcttagttagtaccaacctcttggcttctctttgccccgctaattgatcaatatgttgtattgggcttgtcctaattctctctcaggaacaaacaatgttcctagtatttttttggaaaaaactactgtcttggcgcattcgtccaaccacactacagattgaattggctggccatcctttgtgcaatattttatcttccgcaaatatctttgcttgaagcatgagcattactgtggtgaagcattagcattagcattagcctttactctccaaatcggactaaggggctggggatgcaaccctgaaactgtatccagtatgaagatttcgctacaaggctattaatgtagaatggacagttggaccttctttgtttcactcattctacaaaaaacaatgtagggtcgatatgatattaatggatctaagcgtcttaacaccattacaattttggaaaaaaaaagggaattgccatactattaaaattttctgttactgaaaagtttagaaaaagaaaatagaaataccaaataacagggtacccaacttgcattagaaactgtctcatctattaactgagcaaaaaaaaaagcgaaaacactaaaactatataacttttgaatattttgtcttaatcctccaaatacgtgtggtcaatcttgtatcttttgaagtatttgccatactagaaatatgatatgagatacattgattcaaacttcttctgggaacacctattgagagggttggaagttgtacactcattgttacggtaatttacttttatacttttctgtaggaaatgctctttctgcctaacccaaaagtgaacgacactgttcaaaactaaaaattggtttgcaagcacgtagtactaactaaccatactgcgtttttcagtcgtctcctggctcatgctttaagttgtgtgcaattcaattattagaaatgcattgaggtactacttgcaacagacttattcttttgttaactattatattatttttaaacaattacagggacttgggccaagttcaatggtcactaaggccgctctatatataccatatttgaattatttgttgtgcttattgttaagaatgaatttcatagctacattgatgatatttagtgtgtaatgttcttgaacagataaataagaacgcttcaaggtggaagcagcaatgctggtacaagttatcttgacatagatgaaatggtgaagtcttaaaaattgaactattacctatctatagaatgttcacatgtgagggtgagtaaatcatgcaaaatctccagagttccagaacacattcggaagatggatcatggggcttatgagccaattatgttatcaattggtccataccaccatggattgtcgtacttgctagcctttgagaaggaaaaatggaattgccttgatctttttcttaaactgaatcgtgaaataaagttggaggactacctaaatttggtcaaagatttagaggaggaagcacgggcatgctatgaagacattgacatgcaacatgacaaatttctgcagatgctactccttgattcttgcctttttgttcaccatttcagaggtttagagggaatacttccatccactttgggtgcaaatatatgtagtgctgacagttcggacattataatggaaagaacaatacacaaaagcactacaagtcaaggtaattttggtgagcaatgcagcagggataactctatctgcacacagagagaacttgtccttgctggttcaagtcgggaagttactagtcaaggaactgactttgatcacactgaggaacttgaatcttctcaatgtaataattggcaaattggaacctggtttgacagctgtattgaacaagacctgatgctactagagaaccaaattcctttctttattgttaggaggatatatgaactttttgctggaaatgagaggcctatttcatttctcacagacaaagtagctcaatcgttggagaacttcatacaataccatccaagagcaatccaggaagcacatcggcctaaagatttccatcatatgctgcatttgttccagatgtacctcaagcctagtaaaaagctggttgagggttcacaatacctggagagaggaagatattttcattctttcgctaatatatgctataggtatttgaaaattggacgtaagcttgccgatagcaatcacgatatgtcaccagatcctttgcttaactgctttcaggatcaccatccacgtattcgtggccgtcgggcagtgcaataccatcaagctggagttcaattcaagaaaaagtcatttgataggaataatccccattctctgttagatattagctttga

SEQ ID NO: 78497 - DNA, 1192 bp, Oryza sativa
  unsure (1)..(1192): unsure at all n locations
tgatttatcgagaaggattctctgtcgtacactctgctggctaaacctttccggacctgacccttgtatctttctgacccatgtatggaatgatttcttagtcaacttccgagaggcattgaaatgatttctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaattggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctagatatgcgctatttaataatttttgatcccgaacgaaaattagggtgtgacaaagagagaccaagaaagatgggaacggtggggagtgaagggatgagcggtggggagagtgaagcgataaggataaggtggagagagatggcagtttttatatgtcgtgtttttaataggattaattggattaatgccattgcaaacatgtcatatataaaaaaaatgccagtattattcgtgaaacatagtgcgtgccattgaaatttttgaaaatttgaaccatgccactccgtcatgatttctgtcatagagatagatgccaagttgttgctatatcaccgattcaatttcatcctttctctctcgtcttgcatagattggtttgttcgtccgttcgtcgtgcagcataggggatcaagaagagaagaaggatcttgtgctgttggtaaatccgaccaagaaggaaggaaaaggatgggggagaaggttactgaagcggagagaggagtggatgatgaggatgaggatgatggctcggtagtggcagcatgcctggatggattcagtactgcagcgaagctagcgagcatccctacaagcggtggtggcgatggctagcggaggacatgtaagccgatcttcaatnggacg

SEQ ID NO: 78498 - DNA, 1168 bp, Oryza sativa
cgacagtttttcgcgggttcacccatatttgtggaaaaccgtatcccgccctgaggaaagttaaaacgcctccccccacccaactcccgaagccaatagatatatatttacagaaaacggaaataagccccacataacgcgaaacgcctctctccccgggggtgtgtggcaaatcttataaaaccaggtggcacgcacaagtttctcccctcttgaaaaacgggcccatgtgcgcccacccacatataatttggagtgtaaggtcccccccattagggcccccacgggtctttcacctcttaaatctttcggggttcgtatatgttgtgttgaatatgtgtaacgggaataacaattttcaccccaggaaacaaagttaatgccctatgtttccgccaaacttattttgggttcaccttataaaatactccaagcttggcctcaagctggggaccaagctcgggttcaattagaaacggcccgcaatggtgtggaatttttccaaattcaaaaagttatccaatacctaccggaaagatcaaacccaagtttcctgtaaaaaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtagccgcgccatcgtggaagagctggcgagcttcggcgcgacggtgcacacctgcgctcggaaccaggcggagctgagcagatgccaggaggagtggacgtagggctaaccaacccgtttgagttgtaacacattagccgattcctggctcagtgtggtgaagcatcggctatagacgctctgaaagttaggttattctggtaatctctgtcctatcgtcgagttccatccattatgcgtcatgaatgcgcggacagaagggtgac

SEQ ID NO: 78499 - DNA, 8772 bp, Oryza sativa
  unsure (1)..(8772): unsure at all n locations
caaggcttcctcatcaagacccttttgagcatagcaagatataattgcagtacacgaaacgacgtccctttttttaagcgtgtcaaatactcttcgagcttcttggatgttttctgacttggcatacatgtcaagcagggaactcccaacaaacatgtgtgactcaaaatttgtcttgactaagagagaatggacttgcttgccctggtatatactttgaggaccagaacaggatgtaagaacagttgctaaagtgtattcattagggatgcatcctgccagatagaagtaaaatgtattacacatttgacagaaattaatacagcatatgttgatataatctgatccttgaagacaatggcatgcattcccaaatggttaagaatatttataacagtaattgcaaaacaaacctccaaactggagagattgaatatcaacttgagaggacattaagacggtcagggagatatgaaaagtaattgttgtggcaatattctaaatatggccatgacataactccatccatattctttacagtaccaaaaattttataaactttactttataataatcatgccccgcatgaaaggtaaaccccgcattatggatgccaaataatgtatctaacaaaggtagattatagagtaccagacaacatgctatgaaaactctgtttttgtttttctgtcaatctaaatcattcagccaaaatgcattgcagaaaataaattgccatctctaatctgatgctactttctgatctgtgtgatctccttatgtcaaatgactcacgagaaacgatccaaacaatttaccagctctaagcatcttgatgaacagatccaaggcctcgacatgtcgttctgtttgagaatagcctgaaatcatcgtcgtccacgagaccacactccgctccggcattctatcgagcacgttgcgcgcgtcgtccagcgcgccgcaccgcacgtacatggtaaccagccgggtccccaggaacaccgcaggccggtacctcgccgtgatcatgcgcgcgtgcacctgccgccccctcccagagcgccctcctctcgatgcacgccgtgatggcggcttcgtactcgtggaacctcgcgctggcccccggaagcgccatccccgatgcggcgcggagcggcgcgacgaagcagcgctggagcgcgaggccgcgcgccgccgcctccggtctcaggagcccgcgcgcggcaagcatgagaggcgttgggctcacgcgagcatttctccgaacacctcgcgcgcgccgccgtcaagacgccgagcgctcgacgaggtggtggtgcgcgtgttggttgctcttctcctacgctaacgggcaatcctggccgtccgatcgacgaatctagcggcctagatgacgcttcgatccaaagactgtctcgtaagaaatcccaaaactaaggggcgtattagaagatatcaaaatattcactcaagggcccgggaactagctgggccaaattcaattaagggctgaatttacaaacggtacaaatgtagccccaatttgttcgtgggctcaatttgtagacgagaattaagtaggccaaattaaattatgggctgaattcctcggcaggaaatggatgggccagatttagaattgtaccgaatttgttggtctcaaattaaattatgggctgaattcctcgacaggaaatggatgggccagatttaaaattgtaccaaattcgttggtctcaaattaaattaggaataagttcactttaggtccctctatttgttggtccctgaaccgcaaaaccgggtatgacccgtcccccaacttacgaaaaccggacaaacgaggtcccttagcggttttgagggtggttttggctgacgtggcgcctacgtggccattttgactcgatattcatctgatgtggcactgacgtggcgcttacgtggcaatccgatccagaaaaataataaaacccgtggcccccacatgtcagtcacacagaaaataataataataaggtgggacccacgtgggccccatatgtcagtccaactcatccctctcttcttcctgctccctccccatctccactctcttcatctctctctctctccaggcaacgacggccgctcctctccctcccacctgcgggtcgccgcacgccgctccctcccactggtccccgtgcgccgccgctcctctcccgccctcccaccggctgccaacgctcgcgcaccactgctcctctccctccctcccgtcagccggcgtgcgctgcctcatctcccgccggccgccccgacgagctcgcctcctccctcgcgacgacggacagcgcatggccggcggcgggcgatggtgggcgacggcgcgtgaggcgcctggggtggcggcggccatatctctcttgcgcacgctcgccgagccgtccgtcgcccttctcctcgatggccaccagtgggagaagagggatcgaagccgtgcgcctctccccgtccctcggtcgccgcagccctcctcccgtcgtcctccccctccgccgcgccctctcgctcccgctcccccgcgccgccgcctctacttcctcgccgccgcggccgggacagccgcgccgacaccctcccctcatcggagctccgcaagcgccatggcggctccgctgcttctggtggtggtggtggtggtgaggacgagaagctccacttgctccaccgcctcctcgcgcggcccgacgtcgccatcgaccccacgtgcctcgcgcgccgccgcgcgtgccgtcgcccgccgccggccatgcactgtccgtcgctgctccgcccaccccgtggcctgccgccaccgccgctccgtcgcaaggacgagggagagccaagaggaagaagaggaagagccaagagtggagaaggagaggggaggggagccggcgagctcagcttgggggcggcgggagcggcgtcgtcagcgtcgctccgcccaccgcccgccgccgctccatttcgccccactaccgctccgcttcctctcgtcgcccaccgcccgccgtcgctccgttcaccactagccgccgcgccgcccatcgtcgctccgcttcctcccaccgaccgccgcgccgcttcgctccgtcgccactttgctcagtcgccgctccgcccgtcgccccctcggcgccgccgctcgcccttctctcctagcagtgtaggagggagagagaggaggatagagagaaggaggctgacatgtgggaccacatggccccacctctttttaattattttttgtgtagctgatatatgggtcccactatttttattagtttttcgagataaaattaccacgtaatcgccacgtcaatgccacgtgggacgaagacctagtcaaaggagccacgtaggcgccacatagacgccacgtcggacaaaaccgtcctccatactgtggagggactttgtttgcccggtttcgtaagttgggggacgggtcgtacccggttttgtggtcaagggacaaaaatcagactgaccgacaaatagagggacctaaagtgaacttatcccgttaaattatgggctgaattcctcgacaggaaatggatgggccagatttagaattgtaccgaattcgttgttctcaaacaagaaggcctaattcgtgggtgaaacaaattacatgacgtgaatctagcggactaaatttgctagtgggctgaatatgtgaacgagaactgagtaggccaaattctgtggtcggcctaattcattcaaggaagtgagtgggccacaatttaattatgggtcgttttgttgcaaggaagtaaatgggccaaattcaaacgtggcccgaactcgtaatttgttatgtgggccaaattcgttggatagtgttaactgggccaaattcatcgcaggctgacttgacgggacatagatgggctgaattcatttaggccttggtgggctgaatttgttgataaaaaaactggtaggcctaattcgttgacaggaactaggtgggctgaattcgttcacgggttgaatttgttcaattaagggctgaattcacaaacagttcaaatgtggaccaaatttattcgtgggctgaatttgttgacgagaattaagtaggccaaattacataatgggctgaattccttgacaggaaatgggtgggccagatttagatttggaccgaactcaatggttacaaacaagaaggcctaattcgtgtctgaaacaaattacacgatgtgactctagcgtgctaaatttcctagtgggctgaatttgtgaacgaaaaatagtgggccaaattctgtggtcggcctaattcattcaaggctgtgagtgggccacaatttgattatgggtcgtttttgttgcaaggaagtaagtgggccaaattcagacgtgggccgaactcgcaagttgttgtgtgggccaaattcatcacaggctgaactcgttgacgggaatagggccgaattcatttatggccttggtgggctgaatttgttgataagaaattggtaggcctaattcattgacgggaactaagtgggctgaattcgtttacgggttgaatttgttcatgagaattaagtggttgaccgaattttctctaggtggggcaaatttgcttgcggacttaatttatactgggctaaactcagtgggacaattagtactgggccaaattcgtggatggatctaaagtgggcaatattgttttttgggccaaattcgttagtgggatttttataggccaaattcgttgattgttattaagtgggccaactttttacatgaatcaatccaggccgaatctgctcgttgccttgggtgggccgaattcgctaactgggtataggtgggccaagtttactcttgggcctaaaactacttggcccgaatgtaggtgggcctaattatttttgggaacttagtgggcctaattcacttgtggaccaaattcgcggacataaattaagcaggccgaattcgtttgttgatgtcgatgggccgaattcgttcatttatattctctaaaaataaaaaaataacaggggggctcgatgcaaaatcccctcaccggctgaaaaatttgagattgtttcgcgagggaaacatacgaaaagctttctcccccatttcaagcggcgcgacggcgcnnngcggccggcgagannggncnacgctagggtttttnctctctctccgccgccgaaatcgaatccccgaggtgagctccatctcatacccaccgagtctcaccgtcccganccatctccttcacccgccgccgccgcttgcgctgccccgccgatcaccgtgagctgctgcagcttccgcctccggtgagcacccgttgccgacggacatcgtcttccttcctcatccatctcgttctacccgctccattcctcgaattcgcattagccttcatcttctcttctggatctggaagcttttctgttcgtcttaaccctagtactaattacagttttttttacccaaaattttttttggtgccctggctgtagagatgaatgcgaatgtgttgggcggcgatgtggtggcggacgatttcaactacttctccggtgtgagcaccatctttgtggccaacatccaggaggtgaaggaccgggtttcccagatcgagctcctcttctgcagccagctcttccctcatgtccaggccatgtggaaggcggccaaggatgcgtggatggagagggaggccgccctattgagccaattggaggagctgagcagcgggaagcggcacgcggaggagaaggcgctgcagctggggtgctcccttgatgagatgaaggggaagcttgcggatgccgagcgatcggtcgcggggcatgaggttgagaagaagcggcttctggggagattggaggaggaaattgggaacaaagatgaggttattcgccggctagagagggagattgcggagaaggctgctgatttttccagggagagagatgcccatcagaggcttttgcagctggttgagttgaaggacaagaatttgcttctcgagcagaataaacggagggatgcggaggagatggcactgcagctggggaactctcttgaggatatgaaggggaactttgagcgattgatcgcgaggcatgaggttgagaaggagcgaattccggggaggttggaggaggaaatggggaaaaaggatgaggttattgggcggctagagagcgagattgcggagaaggctgctgatgtctctagggaaagagatgcccatcagaggatgctgcagcaggttgagttgaaggataaggatctgcttctcgagcagaataagcggaaggacctgatcgaggattacactaagctgaagacactctacaaggatttgaagtctcagtacaactttcttgttggaaagattggccagaatgaaggctccaagtctcctgtagtcaatgtggtggatcggaaaacctccggaagccctccaagcaagagaaagctcaaaggtactcctgccctttgatttcctttcattcagtagagctatttaaaccttgttaatcaatcaccatttttattctctaattactgttacctggaagtttcatttgaagaataccaagttttaattgcaattgtgtactataatccatggtgctctgatcaatgccgcggttgaaagtattattaagcacctttgtaatctgcaagtaatgtcctgccaatgctatcatattagcactaagatctatgcctcctaaatcgatactgattgatgtctgccttagcattttcttttacttgcttgattttcagatctggtggacactaaaaaggagaacaatcaggcagtatctaagactgtagatgagaaaaatggtcctgcttcaagtgcaaaggcacaaggtacccaccatgctagctcagtcaggagtccattcagtaactcgcgcctttgtctaccgtctcgtacaaccaatcctccaccaaagaatgctactagcaattcaaaaacagaggcagcatctagtttcaccgcccaagtctacactggagggagactcgcgcgcgtaaagaaccaggcgttgtagatccacatgatgatttccttgacacacctctggaggctgtcaaaaatatgatcaggaatcctaaaacgccagaagaagcacaagcccttgctgcctctcctcctaaagatatggacttcaataactctgatgatgagactcaagatgtcaatattgccacccagggccagaaaaacatgccagttcccaagcagcaaagtacaatttcaatccaaccaccaaataaaggtttcaaatacacagaacctgtaagaaaaaaagctgaccgggagaatctgaaaggcgttgagtgcaagcagtgcaagaaattctatgatgctgttcttccagatggccgcacaaatggtgacggtgtggactctacaagcatgaggtgtgagcatcatgatggcgtatccagacatcgctacaggtacgcgcgcgccgctgacacctgaagggttttggaacattgggtttgaatcagaaatgtagcacatgaagtatgatgcgctcttcattgattagtgcagtgtcgtgccctaacataggttctcagtcaccccccagatactgttaataatgtcagtagtaaatctcatgctggggaaatgatcatttctttttttaagattatatgtttggatagaatgccaatttgttgaagatagaatgtacttactgtcacatcgattctatgtaaatgacatctgacattgaaaagcagtcgaataatcttgaataacaagcgttataacgttacttgacatttttcttcgatatttactaattacaatcacatccatgatctcttctttttgctgttaccactttacttcagcatatgcaattgttggcagcagactggtgaggtctgtcgaatggtgagccatctcttcttcccatgaaaagcctttctcctttccattgtccatttgatcacgagattcaggtcaagatcgatcaggacgatttcacgtcagatctgctaagaaacaggatgcataacaacaaagcaggtaattcttttagaggaaacaaaataataatatatgccccaagaaagagtcccaactcccaaggaagagtcattcaacttagggtgcaggtggggtgggtcgacctatatagggccaaaatcacattggcccggcccacaaattgtgtagtccaacatgtgccggcgttgccgtgggcctgtggccctacacttcctagcaccgtcacccacagtcgtcaccgcagccgcagtagcgtcgccgccggcgtgcgtgtctccccaaccggagacagcgtggtgcggcctcagtctccctacagtcccctgctacattctgccggatcgacgtaaaaactcacagtttaccacctaggcctcgttcgatttagagaggattgatccaatccctccctcgtagagattaaccgaacaaggccttaggctgtgttaattcttttggaggggttgggatttgggaacccctcacctccgcacttaaaacagagctatagattaacacgtgattaattaagtattatagctatcaaaattttaaaaatggattaatatgatctttaaatcaacttttctatataaactctttacacagcgtacaccgtttagtagcttgaaaaccatgcacgtgaaaaacgagggaggtggatgaggaacccatgagaaataacacaaccttat

SEQ ID NO: 78500 - DNA, 3583 bp, Oryza sativa
  unsure (1)..(3583): unsure at all n locations
ctcttcccccatgcgacacgcatgccagtgggccccaccatttatcttgcctccacatgccacgtgcccctatcaaacatgtttcaccaaaggtattcacaatgtttcactatgtatatatataatgttgtagtatattgaaatattcttttgcaacaaatcacccacatattttggaaaccctctattaatgaaattcgtttcattttttgttccaccaaatatgtttcacctagtgtactcacaatgtttcactatgtatagatctaatgttgcagtgaacgaaacattcttttacaacaaatcacccacatattttggaaaccctctattaagagaattcgttttattttttgttccaccaaaaatgtttcacccagtgtactcagaatatttcactatgtatagatctaatattgcagtggactgaaacattctttcgctatttgctgaaacattatttttatataaggtaaaacaatgcccgatttaaacgatagttccaccaaaaatgtttcacccagtgtactcagaatatttcactatgtatagatctaatattgcagtggactgaaacattctttcgctatttgctggaacattattttatataaggtaaaacaatgcccgaattaaacgattgaaacattttcgatatacttagtgaaaccaattccgatatatattggggaacatcgtgtaacttttaaaaatattcaataataagcttaagaaaaattcgccggaatatatcatgtggtggttttgttttgaagaattaattgcaacgaatttaatggtgcaatcggatcatgatttgaataaataatttaagaaaaaaaatagtttaaagtagttttgtacgcatgtgtggcgctgacgtcatgcccgatcggtagtcccctccgataaataaataacaaaaacgcataaattggacttcgtgttgtcaggtattttttagaactgagttatttcttgaccgccgctgattccctcaaaatttctgcatatatatatatatatatatatcctattatttcactacttgaaacaggcgaagatggcgccaccgtgcggccgcgtggtcctcttcccgatgccgtacccgggccacaccatccccatgttccacctcgccgccgtgctccgctcccgtggcttctccatcaccgtcctccacaccgagctcagagcgccggacccggcggcgcatccgccggagtaccgcttcgtggccgtggccgacggcaccccgcccgagctcgtggtgtccgaggacgccgcggcggtcctgacttcgctcaacgagacctgcgccgcgccgttcgcggaccggctggccgcgctgctcgccgaggagggcggcgtcctgtgcgtaatcgccgacgtgatgtggtacgcgccggcggcggcggcgccagagctcggcgtgcccctgatcctgctgatgacaagcagcgcgtcgagcttccggacgttcatggagtaccctcttctgcttgaaaggggcttcttgcctgtcgacggtgagtttactccatgtgtccatcgcttggagctctgtgtttttctccctacttattttgcggaaattatgaagatcatcaagttattagaaatattttcaacatattaggtagattttctagataacgagatatagagagtatatagatttaaggtcctgtttggctaatgatatagggaaatgatttcccatctattaaaagacatctttaaatcctaaccatttattctccctctttcatttaatcctaatctttcattcatttcccaatcccaatcccactcccatttctcattatccaaacacaccctaacagtcaagacttggcatccagcagaaaagaaagaacagttttttttttccggggaaaagtaatgatctattactcaactaaagcgtcagcacagacagtctgagaaataaaattacaagaatcaccgagccaaaaatcggaaacagactcagagcaagccttattagctagcaagtggcttgcatgattctgggatcggtgggtcttctgtaagaatgaacagattcaaccgtctctgcagttctagttttaatcttccttgagatatggacagtgttagccccgtttgcttttcgtttgatgtggattttgcccgagaatcaaaagcaaaaccgaataggttgattctgaaagtagattattataattatactctgtttttctatcaaaatctgacaactggtacagaactacttttattggacatgatgtatatttaaaataattaactacaaatatgtatttatcttctaaattacttatagaacttatcctaatatgttttttcgtatttgttgtttcactgattcaatcatttcaatcaaaattcaaacagagttattttcccttatgtgcaaaatctttactgatactaaatataaccccttcatataaatggttctactccatctatctgttcatccatttctccttattttagatgcccaaaaggacactctagtcgacattctcccccctttccgagtgaaggatctacagcgcattgacacgacaaacctctacagcttcgccaacgtgcttgccaatgtagtcgccgcagcgcggctgtcatcagggctcatactcaacaccttcgacttcatcgagggtgacaacatttgcaggatccgcgacgagctctccatccctgtgtttgccattggtccactcaacaaactcataccactcgtcggaagaagcagctttcttcccccagattgtgattgcctgaggtggcttgacacacaagcccctagctctgtgttgttcgtgagcttcggcaccatggccaccattgatgctcaggagtttctggaggtggcatggggcttggctggcaccaagctaccatttctatgggtggttcggccaagccttgtccgtgggttacggctgcattccagtgagctccctagtgatttgcaggaagagatcaatggtcgaggcaggatagtctcttgggcaccgcaagaaaaggtactaggtcacccttctgtccgcgcattcatgacgcataatggatggaactcgacgatagagagtatatctgaaggcgtgccgatgatatgtaggccatgttttggagatcagatgggaaatgcgaggtatgtttgtgctgtttggaggttgggtgtggagatggaggtagggagtgttctgcagagggcaaaagttcaaactgctgttgagaaattagtgaatggggaggaaggtcaaaatgtgaaacagagaatgagaaatctgaggatagaagctgaaaaatgtgttagtaaaggaggatcatcagacaccggtctacgtaacttagtagattcgatattatcttttggaaaatgttgattatctgcacagatataacgtagtcatgtcttcgactaatacttgtagcctctttaaatgcggatggtctaatagaggctaactgaacagcgatggtaaatcgtagaagttaaacaaaaggcaatgacatattatcttctccatggctggcgccatcagangtgcaatcaatggacagg

SEQ ID NO: 78501 - DNA, 1748 bp, Oryza sativa
  unsure (1)..(1748): unsure at all n locations
cctattattctanctattanttatatatcttaatattgtagtacttctatcattatattttttnttacttatttctagtangtagtttatgattcnnctccncccccctattgnanttttntatctattanccccncnnnnnnnaanagaacaagaaggacgaacaaaacaagcacaccaacaatttttttttttcnactactttttttttttacgaccatactattaagtgattatttttttttattagattttattacttcttttttatatgtttttatttagtattaattaattttatatttattttatatttttttatatatttttttatttttattatttttttttttatttattttttttttttatttttttttttttttttttttttattttttttttttttttttttttttattttttttttttttttttttttttttttttttttttttttttttttttttttttttttttttttttttttttttttttttttttatttttttttttttttttttattttttttttttttttttttattttttttttatttttttttatttttttttatatttttttttttttttttttttttttttttttttttttttttttttttttttttttttttttttttttatttttttttttttttatttttttttttttttttttttttattttttttttatgtttttttttttttttttttttttttttttttttttttttttttttttttttntatattttatttttaatatatattttatgtattttatagttctattttattttatatattatttataactttattataagttttatatttatattttatatttatttttttatttttatttaatttatttttntatttttttttaattttttttattttanatatttgtttaatttataattgtatattttaggattgattttctgtattagttaaatttattttaaatttatatatatttattttctattnttatttttttatattcactatatttattatttttcttctaatataaatattttttttacatttttattatatttaattttctattatatattaatggttatattttttatttattaattttattatttattattatttttttattaatttatttcttatattatttcttaatttttatagttttatatttaatattatattttataatttttatatattattaatatatattttaatacttgattatattttnatattaatatgataattatgtatattgtaatttatatctattatatttttatatattatattgtttagtatttttatgatatttttttgatttatctttaagattattttttctaaggttgtataatttatataaattattattttttttatagtattnagattatttgtttatttaacatataataggatatgtatatttgttttttttatcttnattattnngtttttatattttatggntaaatgaatctataattattgtattatgttatanatagtatattanttttttatatttatttagttattaatatagttttatattactttttttatattattaaatatcttattattgtattataatttaatttggatatnataaattttgcttatttttaaatatatatattattctatgtatagagttttctatgangaattttttatatggtatatcttttatttttttatattttttatatattt

SEQ ID NO: 78502 - DNA, 4683 bp, Oryza sativa
cgaatcctatgttttattagctacaacctccgtcctataatataagagatcttaggtggatgtgacacattctagtagtctatctccagattcgtagtactatgatatatcacattcacctaaaatcccttatattataagacagggggagtatcacatcactatttatatgggcttgattcgttacaatgtaagtcatatactactataactataaaacttcgtaggatgatatgttacttaatctttcatgtttattctggagagttatttattccatgtttagattatgtttagattaaattgtctcaaatatagctacttctaaagtaccaatggacatttctagccatgaaatctccaaaatactactcatcttcgcaaccccatcttccaacaaccatgaattcatgacaataaaactaagggtaatatagtccatttttacctctccccatctaagtgaaaactttaaaagtaattattttgagccggagggactagtagtgtattagtgtaaacatttttccatcctaaaaaaatctctgaatgtttaaggatctgatttaaaaatttttggagagttgtatcttgatgcgttcaaatttcatcatatcatggttcacgaaatacgagtagcacgttacgttaacgttgctctaatgatcttgcacagagtcctgtgtgcagaataacacgttggcaaacgataagttccagaactatcttccgttatggcaactgtacatttgctcagttgcacgtgctaattgtcttcctagtcctgtcccttcgcacccatgtgctcatgtcagtctttccacctcagcgatacaaattactctccagttttctgttaaaaataaagtgcatactaaggcaagtataaaggtagagaccggtctctacgttaattacgttaattagatgctatcatgttacaatagttaagacaatatggtctctaattattaatgtaccaaaatactttcttactagtcatctttcatttattagactcactgcaacgaaaaatttccttaataaatgctaagagtcgactctatacggttgtcatgcgtagcaaccatatttctctttcattctttctctctcttccatgtcatcaaatatgcttgcatgacaaaaagcttgcataataatgagagaccgcttaataaagaccattgtacatgtcctaagggtctgttcactttgataaaaaaaaacttaccaaattttggtatagttgtcaaaatttgaataggatttcttatatagttaccaaaatttggtagcaaactaaatgtagccacttttggataactttatcaaaatttgataaggttgaaaatggtatcaaagtgaacatgccctaagttcgacatccttaagaaagttttatcttaggtttgttatttctttcattcttccaaaattttgtaaaccaaacatattcttaccattggtgccctatttggtaattccgaaagtttccactcttataaactctaccaaatgtttaataaggctttagaattaaagccatgcaatactaccaaaatatgccaaaacttagtactacaaaatttttgtaggattggaattgccaaaaacaacccattactgccctaaagttttttttttcacattagaccaccatttcttcacttccatttaactttggaccccttaaacttcgtttaacttgttcaccaaataaatgctgctcatataaccttgacattaaaccatcgtagtcaggcatacaccaagaatacatcagcaagaaaagaatccacagtatctctcgctcatctctacaaaaaaagatagcagcagtaaaacctccatatccatcacctccagctccaagagtctccaacaacagcaacaacagtatctctctatatcttgcattccatatgtacatcgtctcagaatccggcctccaaaatcaatgaaagtcccatgcaccgcactgctgcactgcacaagacgttgccaaccatccacagcagcagcagcagcagcagcagccgtcagtccacagctcacgcctagctagctagctagctctcctgacatccagccgccattgtccacagctcacgtatgtttgtttggcttgctctgctgacctgcttgctatcactaccaccaccggtggtcacaggctcacagctccgtctttagcttgttgcctgtctgggccggcgctcctgcacaaagacatggggaaaaaaaaagtagaagaggtcaaagttagtggtagggttcctggggtacaatgatttcaagaggggaggacaatagtagctaggacagcatcaagtgaccagctggtaacaggtaaaaagggggttcagttcagatcagtcaaattccaagaatttgccaaaaccagtcttgcataagttaattgagtactcctatagtcctattcagtagtttcttgaaattatatacgaaagccaaaaaagaaaggtccaaaaatgcatgcataggataacattgtcagtagcaaggggaattcagcaagaccgtctattttcgaggaatgcaaagcgaatgagctgaaccacagagattagaacggcaccaagttgggtccatttcaatgtgaagccatgaggttgagatctgccctgctaagacagagctgcaaggggatgggccgcgtgataaagatgatggctgggaaggactggacaaagcttgctgtataccactcagctttgagcgcagacaccggtacacgaagaagctgcaataatttctggcaaaaacagattctgccagccgtaatgcagtacagatatcatgtagtcagggcctcaggggagggccctaaaggtttaatgatccttgaacgctttgcatgattgggtctgtacctccaatagcatttgtccctccaagagctctgcttggatccagagctgcagatcagttaaccagatccaaacggcagatcacctgtactacacaccttttcttccatcttactcattagcaaatgcaagagtataacttcatgatagtgctaaaacatgatttttagacaatggagctggctcatttggctctcacaatatctgtactagttatccaatccactctcttagccaagctatataatcgacctcttaaactgaaccatgtgctacggtgtattccttgataaatatataggatccactacaaacttcagtacccagctacccagtgataaaactacatctctagttacaaggacagtcaaatggcacgcaaaatgtatgtcatgcaatgcaaacgtaaatctagcccacatgaattgccataatcgaatgaaattatcgtcgttagatatgtcaaattaagatccaaacccttagattcgcttatgtatttgctattcaactagttgaatagaaaacaatactacagtacagcgtacaaatagtagcactgagattaaagttgttttagctggctccctccattgcaagaaaggggatccctagacaggcactggacaacttacagaaaaagtggacccttcacagttgtacaagtgatcagaagggccaaagggaccagatctgcatctacaggccttatgcagccaagcccaaacggaaagccgggagcgatatggtttctagacatgcatttattgattcgggcccagccacaccaaccagttgggtccgctggtgccagagagaacagatccaccagacgaacacatctatggccccttaccatccaaaatggtggcgatgatggcaataatgattgagtgaacaaacaaagggaagaagaacaaacaaagcattctctaatctttctagaaagttacaagttcctgcttccttaaaccccctagttgctaataaacattcactatcaaatagaagcgggcccaattaggatagtcatctccatcacatccaaatcagaaggtaaatattatttatttatgtagaatttataacaagtacttttattagcatgtgcatgagataaggtatgataatctttcctaaagatgtagtagtagttttccctggaagaaactggtttttcacatattttaccacaatttcccatttacctatgtacttctaaacactctggaacaacgaaagagacaaaagttgtggtccaatcaaggctgaaaaattttaaaagtaaatgacaaacaactaaattcaatgagatataggtttggttgcaagttttaccagagcttgctagatcatagccgaagagggaggaacttgaattgctaaagacagggggattggtatccgtccgcttttcccactgtgaaggcggctggagcgggtgtgctaaatcaccatgccagaactgctgttgtagttgcatgagattccttgctccatggacgcccatgtctggccaggtgacctgctccaaatccattccattcttgtagttcaagcctgttatccttccacactataaataccatagtaagcagagtatatgcccaatagcataatcaatgaacctaaaatgtgaatcatgatcaactttaattgaatttgttatttctgagagatttacagaattacacgacatgcataatagaaaatttacatggaatttcacaaatgcaaaattctgcagaaaacatgtgatccagctacaatggtctaatcatgcatatat

SEQ ID NO: 78503 - DNA, 1832 bp, Oryza sativa
  unsure (1)..(1832): unsure at all n locations
gttgtcgtcaccgcccactcgtcgttgccgtcggggtcaggctcattgtcgtcaggttattcagatctcgaaaatcaatgcaaaccctgaccttgccattcttcttaataactggaactatactagaaacccattcagcgtatcagcaaggacgaataaaaccagcatcatacaatcgtttaatctcagctttgcaggttcaagcatatcggctttacatctcctcggaggttgctggcgtggcctaacccctggtttgataggtagccgatgttcaacaattgatcggctgagtccaggcatctcataatactccagagcgaagcaatctctaaactcttttaagagctctatcagcttggttctaaactccagagataagtttttactaataaatgtcggccttggccgatcgcctggacctatgtctatttcttccaaatcatcggctgacatgaaaccttgaccttgcttgtcatcgagatcatctactgtatgcttagtgtagacatctaaaccctccacgacaccctcaaaataatagctggngttctccatctntaattggctgtatatcagaatcggatacttttagaaaatctccatcccagacttttccagataaacaatcaaggccatccatatcccanaggggctaaatagcactggcaacattaactgaccttgtcgctggcacgatctctatcttgtcgccttgccattgaatcaaacattgatgcattgtcgaaggaatgcaacaattggcgtgaatccaatctcttccaagcaacaaggtgtaagaacccttcccatcgatgacaaaaaacgtagtaggaatagtcttactaccgactgtcagctccacatttagaacacctttggtttccgatggattaccaccaaagtctttgagcaccatatttgtcttgatgagatcctcggcgtttctccccaacttccagaatgtagcataagacatcaaatttaccgcggccccaccatcaaccatcatcttagacatcggcttcccattgacatagccgtttatatacaatggtttaagatgccgattatctgtcccctcaggtttctcgaacactgcctgttccggtgaaagaaccaacttagccgattcctcttccacctcgtcgacatcgacttgatcgatcccgaattcggctggcaaggtaaagaccatgttaattggtgccgtcacaacactcttccctttggccaacctttttgcctcatcggctgcaacatcatcggctagaggaacctgattcttaacacgccactcctgcctcggttttgctttcctcagccgatgattaatttcttgttcaaccgaacagagatgaaattcaaatttcgaaacaagagactaagccaaacttcacaagatggtgcacaggtattctaagcagaggatatatcacagaatcatccacagaaacatcacagaaagagacaagagcgattttttcccgaagttcggatcttgcaatcctactctccgttgaggagctccaaagagctgggtctcaattaaccccttgcctcacttgtgcaaaaatcccagaggaaatccgcagccttcaaccccaaacacccctaggcaaatttctagaattgagtgaccaccaagatccaactcaacctactaatagaaatccaccacaagtgtgggttgctctacttggaagacctctagaatctcagcacaagaacttcactaacttttttcctgggattaaaatattgcgcttgctcatttttaattggttaaaattatttccaaggctctgaaaattccactaaaaatcttgtta

SEQ ID NO: 78504 - DNA, 3878 bp, Oryza sativa
  unsure (1)..(3878): unsure at all n locations
tggaacatgctagtgcgggtctattcggtgaggagttcatataagcacgaaacctccataatctattcagccgactcatagaaatataatcaagagagatatggggagggtcggtagggatcagacttctcgacgaggtcaaccggacagtgcacagttgataacaagaggagacgtagtgctgtgattgtagggttcggatcatgttgatcgaaagccgaatcatgtttgtcaatttccatcaaatcaagagttatcaatacctaccggaagatcgagacctagtttcttgtaataaaatatatagatggtagtcatttgaacgtgttacatgtgtaggtttgggcgtccatatatgcctatataatgggcacggtgatgcacacaataatcaaacaagattcacagaaactaccatcaataacaggactcctgcacttcatacatggccactgccagctctataaacaagaggtttagcctcgccggtgccacggcgcttgtcaccggtggcagcaaaggcatcgggtacgtataatcaacttaccaaatcaaactgactaattgtttggctcatacgcttcatcattccagtggtgcaaatttatcgaagcatatcatatgaattattaaccatgtagccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtagaagaacacgagcacgcaccatgatatgtgatattatcttctaatccagtataatatctctatatggacacgaaccgatgaaacggccggatggatatatatatatatgcaggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggtaaaaaaattaaactcccactctgtatgctatggacttcttgtcctattgcacaaaacaacaagcctagcttgcaaatataatttcactgaactgcacctcctccttcaggtcatatatttgacgacgcttaggattagattttgtttaacttttaaatttccaacgtaccattagttttatattattagaataagtttgtaaaatttaacagaaatttatgttatgatggtatagtttgaggcaaatacatgtataccgtatagcatgatatttattacatcctaaatgtatcgttgtcaaacggtataaatccaactccatctatctagtttattttgtgagagcgtttcacccaactcaactcccactatcaggtggatctaaatctaacttcatctatctagcttattatgtgagagggttattccacccagcgttatttcagatctcatgttttattttggcacgtggcgcgcacatccagcgcgagagaaattaatgaattgatttatgtgcacttgcttctcaagttgtaataatcactagctatgcgctttgtaacgtcaggagcaatgaaccaagtcacaaggaacctggcttgtgagtgggcgagcgatgggatcagagtcaattccgttgcaccgggctacatccagactccactcctaactgccgtaagttcctcgttttacaaatactccctcctcctattttatgacgccattggcttttcgaccgacgtttgaccattcgttttatttaaaaattttatacaaatatgaaaatatttatgacattcttaaagaacatttgatgataaatcaagtcacaataaaataaatgataattacataatttttttaataagacgaatggtcaaacgttgaataaaaagtcaacggtgtcatacattaaaatatggatatggaggtagtaatatttttcaaaaataataatagctaggtactataattttagtgccgctttgttttagtatcttgctacggcctattagtgtcttgacatcagagataccgaaatgaaaggtatgatgtctcattatattttaattttagggatcataaaagaccttttttttttctaatgaacgggcgcaactaattaataagactgtggtccccggacgatctcgattacttgctggacttttgtaaactttcctagagaggttgaacagttcggaaagcataatttggggacaaacaaccgggtggcatgtggtattttgcgttttgtacaaaattatatctttaaaaaatactattgggttcatctgttgtttgtcaagctaactgtttttttttctaatgtatatatcacttacatgtcacaatttttgttaaggtgaaataaacagtgttctaactattttcaataagaaattaatatactttagtgcaaatcttagtaatacataaacacaccaaattataagctaggaagatgcaacatctggattaataaaataaaatcgaaaagttacactaaattatacaagagttgtgatctttcggattaagggtttaataagctatttaatgtgctacgttttagtcgatggcaattaagaagaaaatatcagatgactgtaaagctaaacaccatttgaccatccaagtacattaagaattgaaaagttttcctacatttaatgtgagaattccaacctaattttgctatatgtcagatgagactaaagtggaaattgtaagagaaagaacataaataattaaatactatttacgaaagtttgtaactaggacatagtactacttattatgaaaaagtttataactatgacatactacttattatggaaaagtttataactatgacatacttatatttctcatatatattgttgctaacacatggtgcctgcactgcatgtgtatagttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaataaagatatatcatgtatcataatatattctactgaattgggagacttccaagaagaatgaaatctttgtgtgcccgtgtaccaaccacacacaacaggctagctagtcttctctgcatgcgtagagcatagactgggtgtaatgtgtaaaatggccaatatatatttgtattaagtttgggaaatcatgtggagaagattggcaagccgagtgtaatgaattttccatgaaataaaatttacggttcctatgattattgatacaaaacagtatgaatgagaacctgattngtttgacttaagatcattatanggttattcatgctgaattggaaaaataactatttattggatcgtncctttatacactagtacagataatttattgtgacgcttcctaattgtctaggtttggcggccgtcaccttgaagtattcaaaacagccccaaacgaggncgacaaagattacttgcacaaaccttgtagatggcataaaaatcgagccggtacggatgaaacctattgggagggcttcaactggagaccacaaaggtaacgtttgaattttggtcggcctaaccaagcag

SEQ ID NO: 78505 - DNA, 2060 bp, Oryza sativa
tatcattctaaaatcattttcataatatttcaatccaaatcatttcatcatttcactattatctaatatatatcccgcagtaaagcgcgcacggggcatcatctagtattaaagaatattcaatacccattcaaaaattaatatcttcctttgaatctagctagctgctgggttacttgatattttaagttaaacaatttctgagtactgtttaagttgcatataaaaggattgatattttcgttacagataaaaaaagaaatggattgttaatgtggtatgcagtgatcagtcttattgttgtttatagaaagcagagatacttggtttaattcaaacaaaaagaatatgtgcgtgttgttagcacatacgtttgtactatatatgtttctcagaaaaataaagatagataacttagatgtaagttgtgagactattgtcgccatatattaaaacttctagatcgcttgaagaaacaagaatgcatgttcactcaagggtctttgtcaaatctaaggctataaaatctattttgtataatatagttaaagagagaaaggcataaacctcgatcacaactttgctgccccgtaaagtggttttttgacaggctatctctattataatttgttcaaacacgacaaagctgcttaagttgtaaccttgaaagcaacttcaagttaagaagtgaccgtccaacgactgatgaattatgttggagcaatttttcatttttaaaaggatattcatacttctttagtgtcggtaaaaaaaagtacccaaaagataccaattaatgtcataatgtgggaggtatatatcacatccctaccatattctatgtagtactatatagtttagtgcctaccttcaagcatacatgcatgataaaaaggtatagtgggatccaaatccaatttgtgatttctttgggatcattatatgaagacagaagatggttggtgccaaatagtacaagaagctagctaatttaaaagtcattttgatgctctttctattctttgtcctggacaatgacactcactgatccacatcctgttctatggatggattctagatatgatatgacctctcaaacgaatactactggtatttgactctcactcacagtccacagttccacacaaaaccaaaactgatgatgcatagcatatccctgcagcgaccggcctcagcgtctagctttctacagtgtataacaagtactacgcaaaaggaaatccaaagacaagcaatacacatcagtttatatcgagttcacggccgctgagaacaatgaaactgtcatgcacggtcatactaattattaattagggcagcatattctactaatagtggtagttgggtgtagtagaaattaaatataactatgaattttcatgagtataaaaatgttttattcaaaactgcactaaaatatctttactaatttatctaaacatgctatatgtcatacaaatttatcatggcgctatatattttaattttaattttggaaaaagtacgaatttttccacttgagtattgcggtagtacgatttaccccctaaaactacaataccggacatttaacagcccaaactcttaaaaccggataaattaccaccatagctcgattataagcggttttcagcctacgtggcacacacgtggcgatacagtcagaaaaacaaataaaagctggtggggtccacctgcgcttttcttctctctccttgccctctctctctcttggtgaacataggagccgactggcaggtgcggaggcagccgcggctccaaggccggcggcgggcaagcgcggaggcggcgggccaggagccgaggccggcgactagcgggcgtggaggcggcgggtgaggaaccgacgaaggtagtcggtgatggctggtggcgggcgagaagccgaggccggcggctgccgggcgcggaggcagctgcaggcggcgggtgagaaaccgatgacggcagtcggtgggggcgaaggcgggtgcgggcggcgagcaaggagccgaggacggcagcggggatagctgcga

SEQ ID NO: 78506 - DNA, 2556 bp, Oryza sativa
taaacttttggattaaaatggcatgctttttaaactgctaaatggtacatttcgtacgaaaactttttatatgaaagttgttctaaaatatcagattaatccattttttaagtttgtaataattaaaacttaattaatcacacgttattaccacatcgtttttgcgtgaaacacttaatcttgatcttgatcttcatcttatctttagtcataagaaagtacctccgaatataaatccaaaaatatattttgttatggcagaacctaattaaatattattggattaatcgtttataaaaactcaaaatcaaatagtcgaaatatgtcttatatttttcaatgaaggggggggggggggtataatgttaatctttgttgtaatgttacatttttagaagtaaaagcatgcactaggtcatcctgtaagagttagaaattcagaatccatttccactagctagcagcaacagaacgatacacagattgcacatagatgttcttagccgccaattcacgagatagtggctgaaaaattctggaagctagagagaaccagaatgccaatacagtagacatgagacacatgacatgcgttgcagaataagcttaagaaagaagcagacggaagttgcctttattccgagcagaggaggcatgcatgcatccactggctaagctgcaaatgtgtcaaaaaggcagcagcgaatatattctctcgcctcaccaccaccggcaatatcagtgtgtatcttgcatcgttctcaggctcagcatgaaactaatatgtttacgtgtttctagtctacagattgatagccactggtttctgtgttttatgatgaggaagtcttcttaggtccagttttttggctgtgtacattctatacagagaccgggggtgaactcagttagaatgtatcattttggtgtatgtaactgagtcttaataaagcttctattatctaaaatgaaactaatatggattccgaggtctaatcaagcccatcggtcatagctaatcggtgtatgcagatgatttcatggttgcatcattgttctgtagtcttaagcatacagtaagtagcttggtttggtcagaggcaagatcctctacatcaggaacacactgcatctagccgttctggattctttttcttcttaatttctttcttgagagcatgtggcctggaagaaagttggtatagctttcagcccaaattaattaacatctgcaactccagcccattgaaattataatttacaggccaagcccaggatgctgttaatttgggcttttactcgaggcggcatcagtggcctaaagctaatgatacttgcaatttcctcgatacatttgcaaaccatctccttttagattaagaaaggggcttgttccactgaggttaatttttgccgtactaaatttttgacaacttcaataatgccacatggatgtttggtggattttctatgaatcttttacccatacgtacaaattctacgctaccaaatttggtaaggtcaagagttgctagtgtaaagattagttccaatccaaataagtcctaagatcaatgatgtttgtaactttttaaacctttttaaacattagtaaaaattatttcaagatatgatctttttgaaatttattattttcaagatctatcaccacgatctgacaagtgtgacaatattatttagtcacgccatcctcactagggtggcaagataaaactgtcacgcccactacgagtgacatgtcagtattgttttgtcatgccaagcacattagctcgattaaaaaaagtttagattctggaagtaagttttgaaaaggttcattttaaaattaaacattcaaaaagtaaaaaaaagaatcaagatcaacacgtcgagtctatttttaaaactattttcccgatcgaatacacatacaaccttattttgatcgttaagatggtgcatatgctctctctagctatatatctactcctcgtctccctcttacatgtcgctatatagccttagctactctttgcatgtgtgcgtgtgtggctaataacctaagctaagccgattcaattgatttctagccggcggccgggtgcggccgggtggtggtccagaacaaggcgagcgcgcggaggcggccgaagtagtcgtcgacggcgacgaagcagcgcgccgcctgcctcaccgtcagcatccgccgcagcgcgtgcagcgtccgcatcctctcctcatccgcctacacatacacgcacaacgtcgtcaccgatgcgaaaacttgcaacccaaatcgaggtggatttgaaactctcgaatggatgttatcttattgtttgcatgtcacttaaataactataaaagattttaattttttttaagaagatatgtagtatgctatcactctacgaacatacaacttaaaattgtatgtttgtggagtaatatatcacatattaatttatcttcttaattttcttgtaaacaaattatctttttaatttttttcataactacgtgagaccatgcaaaaaaaacgagaggacatcc

SEQ ID NO: 78507 - DNA, 36150 bp, Oryza sativa
  unsure (1)..(36150): unsure at all n locations
ttcttttagctgtgaagaagatttgtgttgccttgggaaatgaagcaatcaaccaagctacttcaaaattcaaaaggtttgtttcgcagataacagagcttcaaggaagcatgggccgcatcaagagggagctcaggctgatacatcaattcctttctcgaatggatgtacgcaatcgcaataatgagacgtatgaaatctgggtggaagagataagaatgctggcacatggaattgaagatactgtggatgattacctgcaacttgtttcccataaacatgatactggatggagtacctatctgaagaaaggattcacacgaccaaatattctgctctctttaaacaagatagcattgtccattaaggatgcagaagccaacctgatgcacctattctaggcgaaagaccgatgggtttcgatggtaggtgatggtaataatcctagtaatgacagctcaaattacattgttgagaggtcccaacatctagcaagcatttcacgctcccttggtgaagaagatcttgttggggtcaatcaaaatagagaaacacttgaagagtggctggcagatgatttgttggaacgttcagtaattacgctgcatggaatgggagggcttggaaaaacagccttggcagcaaatgcatacatgagggagaaagaaaagtttcagtgtcatgcatgggtctcgatttctcaatcttactgcatcaaggatgttctaaaatgtttgatcactgaactttccagaaatgtgaaaaagactaattggggtaacattactgacatggatactggaggttttcgtgaagagctgaagagattcctaaagctccagaagtgtttgatcgtattggatgatgtttgggcgccagaagtaatcaatgatttgtttggagcacatgttcctaatctcaaagggagcagaatacttgtgacaacacgtatcgatgatgtagctcaacttgctttcccagacaggagaataacattagaacctctatgtgagaaggaatcatgggaactcttctgtagaacagcttttccaagggagacaaatcatgagtgcaatgcagaactgttgcacttgatagatcaaatagttagcaagtgtaagggggttcctctggcaattgtctctattggcaggcttgtctttgtgcgtgacaagaccaaagaggaactgaggagaatacatgaccagctcgactgggagttaataaataatccaagcctggaacatgtcaggaatatcctttacttgagctacatttaccttccaacacagttgaaaagttgtttcctatattgcagcttgtttccggaggatcatcttctcaaaagaaaggcattaatacggtggtggatagcggagggattcatcagtaagaggggtagaagcacaatggaggaagtggctgaagggtatctacaggaattggttaacaggaacatgctacaactaattgacaggaattcatttggcaggataaaatcattccggatgcatgatatcatgcatgagttggcggttgacttgtgccgaagagaatgttttggcgttgcatatgatgaagataatagacgttgggaacatgaggatagagatgaacgccgattggtagtacacaaacttaataaggacattgatcaagaaatttcttgtgcgcatagtcttcgatcagtcattacattggataatagtatgatatcatcatccagcatactatgtctagtagtggacaattgcagatatatgtcaatactggagttaagtgggctacccatcagcacggttccagatgctattggagatctattcaatctccgccatttaggtcttcgtggttcaaatgtgaagtttctcccaaagtctatcgagaagctaaccaacctgttaacactagacctcttcagatctagcatactggagcttcctagaggcattgtcaagctgacaaagcttaggcacttgtttgctgagaaacagactgatcgacatcggcgccttttcaggtggtgcactggtgtaagcatccccaggggccttgagaacttgacaagcctacaatccctacaagcactggaagctcaggatgagtctgttagatgcttaggagagctcaggcagatgagaggtctcagattatggaaagtgaaggcaagcctctgtgaacgcctctatgagtcgctgcttcagatgaaatgtttgtcctacctaagtatcacggcaagtgatgaggatgatgttctccagttggatggcttgaacccccttcctccaagccttcataaactacgtttaagtggacgattggcacacaccatgttgggtgcagagtctcctctattccaagaagatgccgggggacgaaatctgtactcgttgcgcctattttggtcccaactaaaagaggatcccttgccatccctttctcggttgttaaatctaacagagctacatttcaccagagcctacaacggagagaagctggtcttccttactagatggtttcccaagctgaaggttctacgtttaagagacttgcctaatctaaagaggatggatattcagcaaggtgccatggtgagccttgaaagattaagactaataaacctaagcagcatggaagaggtccctctaggcattgagtttctcatgcccctcaaatatctaagcttcgaggagatcactgttgacttcttactgtcattgcgccaatctagaattggtggtatgcgatggtggcacactttacgagaggagaatgatatggaagctggtgtaagaacgtaggctacttgattccgtggcaattagctactgttatgtaatataaattcaattcaatatcataaactacaacactagctagctatatgccaggttatgcatgtcacaacatttttgtccataagccttctcttactggctaggtgtggtagatagtctgaccgcgtgcagggagatgcatcttctcaattacaagattagagtttaagactcttttcatttaatgggttggttttggttgagggtcgtcctaattctgagttaaatgtgtattgaacttggtttgttgtcggtatgcatcataggtatgaagaggccggagtttagattgtaagccttccattatccaacatgttttgatgggtgctatagtggtcattggtaagtgagcaaaacaatttggttaagagagctgaaataacacatatataagtagtacatgagtccttttcgaatgattcaaaagcactcaagtttctaatgtaccggaaaaattgcaaagaaaaagatacaaatataaaaccaagcagcactactgtgtgaataaaaaccactgctacggtgaaattttaaccatcgattagggaatttgcatcgagcaaacaaaacagcttctacgtattaatatcccaagtcctaggtgggataacttcaaaaacatcaagtgggagttgctttggtctgtggcccccctagtcactccaggagggaccggttcgggcagcgaaaccctagccgccacctccgcctctcctccctactcccttgctcctcactgccaccctgagcatgccgacggcggctagcgcgaccactaggacgtaagctgcggagccagtttccgagcacacgctcgcttgcagcgacggtgacacggcgggcactcgcggtgatggagatggcaccgacacggtggcgctacgaagtaggtgctcatggcgatggtgtccctctcatgctatggctccaaggtggtggatggccagggtcggcggcccgagcttcagggaggggtcagatccatggccgccttggccagatttggccaggttggtggtgtttgaatctggaggctcggggcatgcatgtcgatgaatggcgacacgtggtgcgtggtggcggggtcatcaccttctcctttcactgcatttttttgtggttggtggtggcacagtgacggtccaggtgtgcagtaagtcgttcacccctctgttggccaacattctcccctccatgttgctcctccccttctatggtcgatctgcttccatattgggtcattgggagctccgtggcaagggtagatgtggtgcctttgttgagctcacgacgtcgagatgacggactgtcctatgtgtccgcttgagctggcttgggtgttggggctggatggggaaacggtggcgaaaagctagacgtgattttgcctggtttgatgacagcgacgccctatggtgcagatcccctccttgtaggcgccattgtggggttttatccctactcctaccacaccacactccgggtgaaaaccttgatttggattttcggacaagcggcgacggcgtttcacatcatgtcctctatggtgctgccactttggagagccttcctggtgcattaatggttgttttcttgctcctactcggctcaaggccttctgcctccacatcaatggtttaggtgttttcatgaggccttcgctgccttggttccagtttcttgcttgcggtgcaaggtagagtcagagttgtgttgttgggggtgcaataaaactaggcaacgaagacacattgtgtgccagccgtatttatgtgatggattttaatggctttggctgatgtccgtgtgggaagtggaagctacttgatcgctctataatgggcttagcattgatgacacttttgctgtggagtcggagctgctgtgttgcaagaggtgacaagctcggcaacgataacataaattctacgtggtcgaagcattcttgttactttgcggcaagctcggcaacgataccctatgtttaggctttgccattgttggttgtttggttggatggtgtgtgcagtgttcggtgtgttgcgcttgttcagccggcctcgtgtttggtgagacttgtgtagttgagttgttttttcttttcatttaacccgttgggtttttatccccgcttattgaaatataattggagcccttcggctggtttcgtttcaataaacaaacatattattatccataaaaaaggtgagtgatcgaagaaaaaaatttgctgtagttcagtggcaaatcaggacgaaaaatagaagaatggctcatgttgaagctatggcataagataagggtagtagagatgattttgctagccagtattggactattggctaccaaattttaatctcataatagatacgtaaaaaatgagtagcaatttgtaggcttgttagcatcttaatttgtaggctgtgttcttttggaggagttgggaaccccctcgcacagaaaatggagcgatagattaacacatgattaattaagtattagctataaaaaacttcaaaaagggattaataagactttttaaaacaatttttctatataatcttttttgtaaaacgcatacagtttagcagtttgaaagtgtgcatgcggaaaatgagggagatgagtcgggaactcatggaaaagaacataatggttgtaatgtaacacacgagtgccggtcagccacagcaagtcagtgatacggttgtaattgtgagtacatgtctacatattaaacattcagaactaattatgactgcaattcacacatccacgagttggctatagatggccaaaaggcctgaggcccgacggcccggcccatggcacggcattttggcccggcccaagcacggcatggcccgacggaggtcgggcccatgccggcccggcccgaccaccgggccatgccggcccggcccgaccaccgggccatgcctgggcccctccaccggcacgttggcccggcccggcatgatgggttggcagttaggcccgataaaaaaaaatatgggagtaaaaatagacatattatatgccatggacgaaagagtagggatctaaaatagacttttttttatctatacatatgtcagccaaagaggagggacggcaaatagacttattttagctatacatatgtcagcccaaagaggaaggatggaaaatagacttattttacctatacatatgaaatagcccaaagaggagggacgaaaaatagacttattttaaaaaaggcccgatgggccacccatgccttcggaccggcacggcacggcccgacagctggtgggccgtgcctggacgggaggtgcagcccatcggccggcacggcctggcacgaagtgcctatcgggtcatgccggcccgatgactgctgggccgtgcccagccatgcctgggccgggccgtgctgggcgggccctttggccatatatagagttggccattcctaaatcccctgtctccgccggttcagccactagctgcgcgggcgcagtcgtggccccgtgtctccggtgccgtcacgccatggttggcacttggaagccttatgccctttatattgcccacgaaggcccaaatatccaatccctgtcaaccagcagaagcccgaagcccatgttttcaggtagaaatggaacaagttcaccaccaagtttgtttgacatcccttattctaaatattagaaaccttcatcccctaaactatacataactgtacaatttagatccatagcagtttgtatgcccggtttcgctggcatggcattctattcagcaaagttaaaataaaaaaaatatgtggggcccgcgccaccaacatctttctctcctttcttcccaagcaaccgccccgagggggggggggtgaggggcaccgggaggagaggaggccggcgagcctaggagggagagggcgagagaagcggccggaggaggtatggacagtgccggacgactgctcgacggactgcaggaacctgagcaccttcttccagctgccgctgcacctctccaggagctccccgcgcgtggcgggccagggcccatggccgcgagtgccgcacgtgcgacgcatagtcttgacacggcgtgctcggcgagcgggcagagcacgagacatgtggcctcaagcctcgcgaggttcccggcggcgaggcggccggaggtcaggacctccccgataaggtggctgggtagctcctccatcgaaaagcttgcggcgccttctccctcatcgccatggatccacccctccttctgcgatccccgcctccacgcgatgaaatcttggcggtcttggccatggacgacgacccgccaccgtcgaagatgccggtgatgaccgggtgactaggtgacccggcgagcagcgccatcaccatggatagccctgcggccgtcggtcccgtcctcctcggttgccgccaccgtctggcacgatcatcccaggctatttctcgatggctgggtactccagaggacaccgtcttggggtcacaggtaggcgctcgttgctgcccaactgcagggagccccggctcgccacgctccgaccatgcctccacatcgccaccgcagcgttcgatttcggccgcaccgccctcgacaggaataagttcacctactgtcgtgagccttccttctttagttatcataggtgtgaacactagagagggggaagaagaggccagcatccagcagcctcgcacgtgagcgtcgtcgtcgccgtcgggtgcggcggcggcagagcctctcgaggtggcggagctcggctgggcttgccggccgtctctccctcttctgccgccggcgacctcacgagaagagagcaggagagaagaggagaagaaagaaaagaaaaaagagacgtgggtcccatattattttttctcacttacatgtgggctcccatatactttttttttaactaggatgccacgtcagtgaaactagatatctatactactatgggacctaaattgcacggttttatatagtttaggggtaaagatttctgatattgaggataagggatgtcaaaaaaataagggatggcaggtgaacttattccggtagaaattagtcctgcatcagaatttctcataatggcgacatagattatggatggattattcatgttttatacacttctaaaaatacactttcttctataactttacattttagtaccaattaaatattttttttctaagctatttattagccttataatattacagaacttttacgctacaatatacgagtagtatgctgccattataaatgatctaactttataggccgatttgatcttccaattaattactccctccgttttgactttctttctagttaaattttgtaaagttcaatcaagtttatagaaaaaattaaaaacatctaaaatatgaaattagttttattaaatctaatgttgaatatagtttgataatatatatttgtttttttaaataatactatatttttctaaaaatttggtctagaaacaaaaagtcaaacgacttataaacggagagagtagattacagtataaaatttcgtaaaatttaaaaaggtagatttgtctttctacgtggtggttcgggtcccctttggctggccatggtaatcatgttctaccttactctgcgcgatgattcattgttcatgggaggagagatgggtgaccaggcttttctaaagtagggggattagcagtgtttagtgtgccttcgattcgggtcaggctatattggaggtttggatagcaggtggggctggaggtaaggaatgaagaagctttatcagttgaattggttcctcatttaaataacgatttatctttctttttttcggtgagtcatgtcaaatcataggctacaccaattttgatagtagctaaactacctcaaatggtcatctcactactatgaaaaccatttttcgtggtggccattttgaatttttgctggcggattttgcagccgtcaaaaagcaaaggccagtgaagatcaagatcttcgctagcggttattgaccgcaagaaaaaatggagcagccgccacaaagcaaaggccagtgaagatcaagatcttcgttagcggtcatcttaagccagccgccagtaaaaatccagtttcgctggcgttggcttaagacggccgtcagcgaaaatggatttttgctggcggctatgttaaatcggcctccagtgaaagtctattttgggcccaaaaagaaatacccatgcagctgcccattgattcattaattttaaaattcaaatccatatctagattcgccgctcatttccaaattcaaacatgaaatacaaaatcatcatcagcacagatcaaacagatcaaacatcatttacacagatcaaaacatgtgcatcatctggaataacatgcaaaaaaaaaagaaaaaaaaaatcaaatctagcagcacggtcggaggagggagccgcgggagcacggtcgacggcgtcgaggtcggagaggagggagacgagcagcatggtcgacggcaccgaggtcggtgctgccctccccgtggtccggcggcggcggatctggcctccccgcggcccggtagtggcggatctggcctccccacggccgggcggcggcggttccggcctccccgaggcccggcggcggtggatccggcctccccgtgcacccgagctcctctcgcggccacgcccgagagccgccgcccactcccgggtgccaccgcccacgcccgagctcgccgccgccttcgccgcgcactccgtggagggagagggagttggaagaggaagagaaggatgtttccttcaaccttgaaatcttgaatgcagcgtttggtaaagaacatcatcttttaggtgattgttcttaaataggcccggttgaacttaggaagatgtgaaaacaggagtttctgtctttctaatgacaaatttgtttgtgatatttagtacgtacgatgccctttatgcactatgaatgtaatgatctacatggaataatattatcgtgcttgtcacagctacttaattagaagcctatacaacaaagcaaaggaaattgcagatgcagatgatgaaaagagtaaaacctcagacgcttcattggtggataaatacaattcctccaaacgatcagtatctctcgtgcaaaagcataaagagagcaaaaaggaaaaaaagaaaagaagcagaagcaacgagagaaagaagaaagggaagggaaccatcaaccacccatggaagccttgtgaccgcgagaaggacctgactgctgggcggcaaaatgtcaatttagatcctgagaacatggcacaaggattgtcatcccgtttttcctctggagctgttcagaggaacttcaaggatgaccatgttggctaatcacagatgaagcatgcatgaccatgttggtcactagtatcctggtattatgagattgtcctgtttcttcatgatattgttggtttgaaaaagaaaataaagtggggtaagattgtcatgtttttccatgatattgttggctcccagttagtacttggtactcctactatcctaaatccagaaatagatttggtgcatgtttctttgaaggatctgttgaattgtcttgtggcatgtagttagttaatttttgattaaggtgcatatgctactatggtactaataagaattaattatgtctgattcatgtggatagtctctaagttattaaataaaattgtagaggaattacttacaatcaaaagttagattagatggggctggtcatgggctgaagatttgacgaaatgttccttctgtgattatgaacatgtatgcagttagctgattattaatgaacagttagctgaatttttagaagtgtatttacaggtgcctgtcaggcttttgacacaaataattatactaactttgacatattgttttggtgtgcagttttctgatatgtgatgtccacgggccttttgtttgctgcaacaatgatgcaaggaaatgtattatgatgtatgtcggaaagtgttgttactagatagaactattaaggcaatgaagctcaagttatgtcttgttcaatttgatactggtaactgggagagatatttgtgtgtcctaaatctcaatgtgtattggctcttaatgttggttgcctttttttttttgcaatattgtaacaattacgacatggattttgcagcaggtcttcagtatttctttaattttctacaattttcgtaattttctaggcattttcggaaaacctcatggcggccggccgacgtggagtgagaacttcactaccactggcgcggggacctttactactttacgacgatgggtgaccgcccgtagggggtttattgcacaaggcccctgcagaggaaaagcttgatcccagcgaatagaagatggaattgctttgctcttttctttctttgatgcttggaaggaaggcctataaccaatcaatagtaaacatcccgctaacttggtcagggagcatttagacggtgcagttagtattgaccactaccgccaagtccataattcaaaaattgatgaattcannnnnnnnnnnnnnnnnnnnnnnnnnnnnnnnnnnnnnnnnnnnnnnnnnngaagaccccaccgtggtatgcgccaataagaccaccaaaggctcaatatgggggatttccgttggatgtgatctccttatatatcttttttctgtattttcctgaaaaattatattttgtttgtgccgtatttcgaattatgtgcataatattttgaaatttctggagtgagactattaaattgatatgatatctcaccactcactattatttaccacaccaataatatacttagatcccatgggttaaggggattatatcccacggtgaaggggattgacgtggggattgggtggtgggaggggatccacccaatccctgcctagtggtattttccctggggaaaaacaaccccaactaccgaacaagcccttagtcgtagctgttttgttagcatcgtatttggatggaagcgggagttatcctcgtgccaagaaaaacgagagagcaccctcatcatcactgaacggctaattaatcctccactggcttgcacactagcatatttaatttattgtattgcaatttgcaacagggtgttttgtttcttctcaaagttggtaaagacctacttcctggtcgccgtctttttcttaaattaactttgtgactttgtaaagaagacctgtctgcagattccaagataccggtcgaagagtaggtcttccatatgatttatatcatgtccatgtacgccctgctcattggctaattaattaagttccagggcaaaggaagactttgccaacttgcataactatagaacgactcgcagatcgatctacctcccaagagtcactattaatatatatatatatatatatcaagaaccgagaaatatatatgattactccatatatatagtgtgtactctttgctaggtaggagtagatcgatcgagccagtcgcccagtgctgctcctgcagcgatggcggaggcagccgggacgagggcttcacagcagcaggaggaagcagctgggattgagaacggaggaggcaaggaccagctgccagaagatacaagtaagttaaacataacagtcctctggcttgcaatctactttaggttgatggacggcttcgggaagctggcacttgcctgggccaccgttgtgctgctaggtggattctccaccctgataaagcccaaggacttttggttcgtcaccatcatcgtggtcatgcaaataacaaggtgcgtatcaatacgacatccctatatatataaagtagaagttaactaaactgctaattagtttccgtttccaccatcaattgatacataggaaaagtgctggcttgttcttgggcactcgatcacaagagaaaaattgggcgtcccatggctacaggcagtgcccctctttcactgtgaatagcctgcacacgccagcccctctctctctcctatgcatgcatgcatgtgtgtgtatcgctctaacgagtttcaaatattttcccttaaattagttattatctcacatatgatccaattacacccatatttattaaattactagaaaaaatatccatgcgttgcaacgggaaaataccttaaatcacttagatccgtactttcctttctcaaaacttcggcaaactcaatttgaaaatttgaaagcgaattcaactttcccttttgaattactttcttcttttactagtctccccttgtttaaaattcgtttaaattctcgtatatcaaaattcactaaagatacaaaagtccatataatcacacgttgtgaccgatgatggatgaaaaacggaagcccattaagatttttctacaaagtaggtggtgaagatattccaggagaaaaacaagataaaaagaggagaaaagagaggagattgaaaggagagggagataatcaagattatcggcacaaaagaaaagaagaaaaagaaaacgaaaaaaaggaagagaaaaaaacaagctgattaggggaggggtgtgcgtggcgcccaagtgtaggagcgcgagatggacggtgggatggtgttgggttggttgggttagactgggagagagagggattgggatgggatggtggtgtttaatagttattctagactcacgtgcgtggaattggatatgggtgacatataactagcttaaaaccaacttaaacacggatgaagcaccaaagtttcggctgaaacatcttcaatttttatatagtagagactagaaaattaaaggtgtccgtgcgttgcaacgggaaaaactaatgttatgataataattatagttattttatagtttcatgggaattaggatatggcatattcatggacataaataatgaattaaatctatacctaattctatatcatgacaaagaaataattacatttttgttgactccatttagctagaaataatttaatatgaagaatgaaaacatatttcaaatttaagtaatttttaatggctaaaaatagtgcttgaactaagtttgttaacggaaaaatagtttaaatcggttgaaaataaataaaacacaattagtctcataattagaaggatgttgtgaccggcctgttaagtgcactgggcccatgtgacaggtcatggcacaagtcgacataggtgcgctgagagtcgttggattcgatagaacggttaggaacttaggatcactcgtgatttagataaacattgcctgttaaaaccctaaccttaaattcattcctcctctctcccaccgcgagcgatggcgcactcccccatcatgagcgatggcacggtgccctcccttagcatgtgtggcggcggcgggggcggcgcccttcccctccatgagcaacagcagcgtcgccctccttaatatgggtggcggtggcagctccctcccccaccacgagtgacggcgtcctcccacggcttcaacatgcggatccagcggcgacgacgaagtcgacgacttgttgcgggcggatccaacgtcggcagtgtcggcgcaaatccggcgacgaggcggcttccaacgggcggatccgacggcggcttcccgagagcagatccggcagtgacaaaggatttcatatttatctttgaatttttttatccaccttacccaatgtgttactcgcgcgtgtgagaacggaggacatcattcgattggacttacagacaaaaaattgatgtgacaaatggatagcccatattgatcagtaacatacctaaggccctgtttagatcccacactaaaatttttcaccttgtcatattgttgatgcgaaaaacacacactggcctgcgagatctgcttaactccagtgcaggtccaaaggttgacgagatgcgggagtgccagtcagtttgactctgcaactgacaagatatgcaaatagtagatcaataagccgatcggctgacaagccgatggagcaattccagccgatgccgataccagctgatagcgatagggttttgaacaatcggctatatgtccaatgtagataatgatataaaggcgatcggctgatgatgataaataataataatataatccagtataaaccaatcggccaacattatgatataatagaacaagtactgatccgaaggttaaagcatacatcggctggaggtctgatgtcataaaatccacaagattagatagatcaattaaacctttgttgtcatcggctaaatcgaacttatatgtatatgcaatccttataagccgatgcaacatctagataacttatcggctagcactccgataaaatattagcatgaaccgatcggcttaacaagacctatattatcaacaacaatctagtaggttgaacctaaccgatgcagcacgagattgtatatagtaatctaatactcgatgagccaatagatctgtctaatgtgatagatataacaaatctatttagaacaacattgtgattgtagagatatatcggctaagatagaagatcggacctaaccgagacagtcccaactaaaccgatgtgtctctaaacacaatgtaattagagatataattgagatatcaggtaggcaaatatatcaaccaaaccagagcgatccaagagattgaagcgatgcagccttgaacaacaccaatgtagccgatagattcaccagggctggtagaacgtaggacttacctcttcgccggagatcgaaagccgatgcagccccgcgtcagctgccaaattccgtcggatgataagtaaaaacctcaagaaagaggatggcgatgcgccgagagtagttgtattgatcgtgtgattgattacaatgaccctgggtgtacatatttatactcatggggagatactagtccttataggacaagaaagaaactttcctaaagataaaaggaaaacataaagtccttagaggacactaaacacactttcctaaagataaaaggaaactaacaaactattcctaattaatagataacttgccatgttgcatcctccttgaactcggttacttctcgataaacttcctttaatagattaatttccttaaccgaatatagcaggaattcggctattgacgacttggtaattctcatcggccgattccaggactctgaaaccgatattgactttaggccgatgataacttcgggcttaccaaatttgatcgttagcacatgccccccagttttggagtatgaaaactcatgcttcaaaattatcttatttcttgtcttgataactacaaaactgatcttcctttgcttattgtaatcagctttcatgagcctatactgtttgcattagatgagccaggttgtcaaactcatggcaaaagaatctctctctgataggtgttgacaatccttggaatgcgagatctgctagttgctcatcatttaggctcaaaccataacatcggctgcggacattacgaaatctctgaatatattccatagccgattctccttcttgctgctcaaccgatattaagtatgaaagcttcaactcattgattccagcaaagaagtagtcattaaattgcttctcaagatcggcccaccctctgatagaatttgatgatagcgatgaaaaccatgtgaaagccgattcagtcaaagacaacggaaaaaatctaactttcagagcttcctcagccgatgcttccccacattgcgctaagaatcaactgatgtgttccattgtagatatatcatcttgccctgaaaattgggagaagtctagaaccttgtattggtgtggcaatagaaccctatcaaatcacttatgatatgacagtcgatatacagaaatatgttccttaggtttaattccaaactgctcttctatcatctttgcaattctatcggcccaatcattgttatattggcattcttcaccatgcccatattgatgaagttcgtctggccgatattgatatagcccatcatgttgatactgatatgcttgcccccaagccgatactgttgttgttcatcaatctgccccccgagctggcttttctggataattaaatcgtcaactgataccttgatcaaattttgtaacgtatccgccaaaactccagattgattaaacaatgcgcgatgaactgcttcatcaactgtatcttgaagtatttcaactatcggctcaggagattgttccttcttggtattgacttcctcttcagacatgttgggtgcgaaattcgggtcccatcgggcatgccaaaaatgtgttgatgcaaaaaacacacactggccttggagatttgcttagctctagtgcaggtccaaaggttgacgagatacgggcgtgccagtcagtttgaccctgcaacagacaagatatgcaaatagtagataaaaggaaaacataaagtccttataggacactaaacacattttcctaaagataaaaggaaactaacaaactatttctaattaatagataacttgtcgtgctgcatcctccttgaactcggtcacttctggataagcttcctttaatatattaatttccttaaccgaatatagcaggaattcggctattggcgacttggtaattctcatcggccgattccaggactctgaagccgatactgactttaggccgatgataacttcgggcataccaaatttcgtcgttaacacacatcgaacgtttggacacatgcatggagtattaaatataaacgaaaaaaaataactaattacatagattgcatgtaaattgcgagatgaatcttttaagcctaattacgcttgatttgataatatggtgttacagtaaacatctgctaatgacggattaattaggcttaataagttcgtctcgcggtttacaggtggattctgttatttgtttcgttattagactgcatttctctactattataaaaattaaagatgtttttgctgtattttggtacgtcacccgtgtttgagtcggtttttaagttcgttcgcttttagaaatatagatccgcgtttggcttggattttaagcttattttcttttggaaatacaaaaggagtcgtagaaggaatatctttaaaaaaacatgcatgctaacttgaggtaaaatacggacttctaattgtaccttatgattttctaaaaagaatatcaaagcggattaccacagtgaattttaccctacttaaactgtataacaacaataaaactaaaatagcatttaccgttacaacgcacgggcatttttctagtaatacttgaaatgtgcgtatgtatatatgatatgacacgccaaaactttacacccctaatctaaccacagcctaaatcaaaccagcccaaaacttccgttttctttttttttatttcttttagtttttcttatggccagatcgctccacgcctcctgaaactaatatttgaatgtttagttcatgctaaaattgaaagtttgaaagtttggttgaaattaaaatgatgtgacgaaaaagttgaaagtttgtgtgtgtaaaaaaattttgatgtgatagaaaaattgaaagtttgaagaaaaaatttggaactaaacaagccctaggctgaattggagtgctcgatccagcgatctaacggggtaggaaaactgatgcacgctcaatacacagatgatttgacacggcgatgaaaaaaagaaaacataaacaattaattagtgcgcaggttacttctaatcggatacatatgcgacgtacgaaaattttcgacaaaaacataaacttttataatagtagatataataattagaaaaaatacccgtgcgttgcaacaggtgaaggctattttaattttattattgttatatggtttagttaaggtgaaaatcatgagctacaattaggagtatgatcatctcaagttaacatgtcagtttttattaaaaaatatttcttatacaatttcttctgtattttcgaaagcgaacgaatttaaaacccgactcaaatacggatatgtatttccaaaagcgaacaaacttaaaaaccgactcgtacacggataacgtaccaaaataccgataaaaatatctttaacttttataatagtagagatagagatagatctatctataaatgtgtcatcctaaaacggaggcaaactttagaccatacgatacaaaaaattattacgatagtcggcaagcccatccaacatccacaaagatcgtgggatggactggttggaatttcaactattggacgaatttccgtaacaccactcgaccacaaaactaggtacgtagagaacatgcatcctccgacttacaaaattagatcaatttacatcccttcgaagtttgcacgatgtttttgttctgatatggtgcatatgtggccacggttcgacttgtcgtcgccttgatccttttcactcaaatgaattttacaataataatcattaggtgggacccacatgtccgaaatcctttctccacccctcccttgccaaccaacagtccaccacgccacatgcatcctctaggattgaagacaccgaggtcgtgagaaagagcgcgggtgtggtagcggctgaggacgatggtggcgacgacaccaccgttaggagagggatggatgcacgtccgtcgtcgacaaagatgcagtcagtgtgagcagaggaggaacatggtgacaacgtccaaggtccatggcgatcacagcggcgaggagctagtgctgctgggtccccaccccacggcgacggagctgcagctgctacaacaacccatcctgccaactggtggaacaggcttaccccacgccgcctactcgagctcagctgcggtttgggctgggtctgtgtcacgcccagaaatttagtccaaattttcagattattttgtatataaatccctatcaaagaatcaaaccagggtacacaatatgatgaattaatatacaaatctaaacataaatattgcgtaaatattttcagaagaaacacttggtcctcacaccgaaaagaaagcagaatcagcggaaaaaggcgatcctcagctccactccacaggcaaaacttaatcggggtatgagccttggtactctaacttcgtcttcggctcaaaagcactacacttctaacctcttatgcctaggtgaatccggaattcgcaaaggtcatcgcaaggcccatccaaactccatcatgctcacccttgcctcgtacgtcacaaaggaaaaagctgcactacaagttcagcatttgcccattctttcttgtcataagcactgtaagtcttaattgccatggtgtgatcataaaaaagatgcacccacaacccaccattaagtcatattttaaatggatagttacgaccaataaaacatggccatgtagttcgagctcgcagctcatcaagatactagaagtagataatgtgattatcccattaggatactagaagtagataatgtgattatcccattaggtaaggtagtggtaattaagcatggctaagcatatcataattctagcaagatcaatataagtgaaacaagctagacaaattatttcccaagtctaacaaaggatggatcacaagtaaacatggcacaagcgagcagataggtaatcccatagtcccatgtaattagcaaagcgtgcaatttatttgcaaacggtaaaaacatttataaagtaggctcaatatgctcaaggggaaggtgtgacttgccttgcttcttcgattgatcttaggaacatttttcctcgcggtcacgatattctgaaaactagcagaatctacacgatggcacacaaaatgaacaaaaaccctaataaaaaccaaataaatagtacatgaaaagtataaacatgtagaactcaattttgtatagaactcaattttatataaattatgcaagttgaatggctcaatttggagttcatatgaattagttatgaattttagaagtttttaaccatttaaatcaatttatggaattaaaccaaattattgcgcaattactaattattttaacaaagaaaaacaaggatgctggtgtcatcaatgggccggcgccaacatgtaggccccacacgtcagcaggccaaggggtgtgggggggggggggtcatattgcaacggtcggctgggctatggaccgggtccacggggtgcatgggcgaccgatggcccaaatggcccaaggctgaacaggcggccaagatcagctaggcggcggcagcgaacaaggacgcaggcgcgccggccagcccgagaaggcggtgaccaccgccggcgatggtgagagacacggggagcggcggctggcacaggaagtggcactgcacgcgaaaggcgccggcgagggcgaaaaaagggaaacaaggagagagggggagggtgatctcatcggcaaacatcggcgggcggtgcaggagaggacggcaacgacgatgaccttgcgagcgaaggggcggacaagcggcggcgacaactaaggatggacaataaatcgattagagagagaaggaggatgttgctagctggaggacgggaaatggtgggactcaccggcgtgcgagggaaattgggtttcggtggcggggaacgtcaaccgagtggcggccgtggggctcgtcgtccttgcaaagctggaggaggaagcaacggggcatgggattgccccaatctacggcaattgccggccagaggtggcgaaagggtggtggtctggtggagctcgggttagtgatggaggtggcagctcggtggcggattggagtggagtggcggccaggacgtggcgcggcgctgcgatgcggcaacgtgaacagcacggtgcgatggtggctaggcggtggcagcgtgcgcccggagtggggaacaacggcggtgttccagtggtggaggggaaaaacacgtagtggaggctaaggtggagctcgatgcggtgaagctgctggtggtgggggcgtggcgcagcagtggcgctagcagcagtgatttgtggccgaaatacgacggcgatggtggagcttgtaggtctcagcgagggagtggtttcgggcatcggcaagctcgcaagagaggggtaaacggatgagtggagtaggggggttgatttttctaggcttgggaggctggctcgagcctcgaggtcgggaagagcgggaacaaccagcggagtgaggctccggcgacttgtgcgaaatgtggccttagtgggcatttaactatttgccacttttagatttggcaattaactatttgcacccctatctcaatgacatgtgggtccaaatgtgtcaatgacatgtgggtccattaggaaatagttaattgccacatctaaaagtggtaaatagttaaatatctcacacagggggccacggggatgtgggggaaatgaggcgggaacgtggagacagttcgacgctgtttagatgcgagctcgtgaccgggggggcgccggatttggcaggatgtgagcggcggtgtggtccggccggtcaaccaaccggaggttgaaggagagcccaacaggtgggccccacctactagcggctcgggagataggagggtggcagtgtagacttcgcaaaggggaggtgcaagcgggcggagcagcgagctaggtcagggagagagaagaggggaggatggcctggcccgggagagggaggagaaagcaggtcgtgcggggagcttgggcctaatgtccctggtggttgtggcatcgacatttgtggtcatggcacgggacgcccgcagcagcggagtggtaggcgctaggtgccaagatgtaccgacagccgccttattgcagacgcctaccagtgagctcctgccagggcaagtcaacgccgtgtgtaggttagagcaacggtgccatcttcttccttcaccaccaaagaggcaccgccatgccttgctctttgaaccgagaagagagattagggagacactacagccgaatgctgatgagatcgggaagagggagcctaaggggacagaaagggatagaggcagtacatggcgcggcgatgtatcttgaatcgcccccacgaggtcagcgcaccagcttcaccaacaccgcccaggcttctacaaatttattgatccacagacatcacctgcaaatcaacaaattcacatacaaatcaacaaaatagacatccgtgcagcccgccgtgcagcccaccgcaccgcccgccgccgtgtaggccgctgccgccgtgcacctcgaatccgccggcttgctcgcttcctttaaaggagaggataagagagaggaaagagagaggataagaaaagggaggaagaggaagttaaaatgaggagataagggagggggagtttgcttgaggataatggcgaggtattatatacgacgcatcgatttttaagtcccggttgctcttatcatatgagtctaaaaatagtagggggacacacactttttgaacctggactaaaaataatctttagtcccgggtctaaagatcataaagtggtggtgggcttttcaaccggggttaaagatgatctttagtcccggttcctattcaaaccgggattaatgtggtttttgcaccacccagtaaagatcatttcttcagtagtgatataattaatgcatgtgatataattaatgcatttaatttaattaggtaaactatgacaggcttctaggaaatagctgttgttggttaatgtaaggaaaaaaaagtacgaattacccctaaactattgcgacagtatgaattgccccctcagaccacaaaaccagacatattaaacctcaaactattgaaaccggacgatttaccccctgactcaacccgaagcggttttggtcctacgtggcatacacgtggcaccgacgtggaaatccaatcagcaaaaaataataaaaaataatatatatagggcccacatgtcatattgaccccttcttctttgtcacttctcctctgtgatgttggcgttgggcatggctgggcaagcggcagtgggcacagatgggtggctccggttggcggcaggcacggatggggagggggaataggttggcggcgagctgcgacaggcgcgaatggggggactctccaggcggcggcgggagcagcgggaagggggtgcggctgggagtaagctccagatgacgacgaggcggcggggaggaagcttcggtcgagcggagcgcgatgacgggcatgactggaatgacggtggtgaaggtcgcctcatcggtattcgcatcacacctcggggggacgtgcgccaaggctctgtcgaggtggggactctcatggtcgtggacgtgcgcgatctgtcgctgctgctccttgccacgccctctaccgctcccgccgcgcctgccgccgcttggcgctggcatgctcccacaaatccgccactgccgccgcttcccgtgcctgccctggagggcgacgacaccgccgtcacttcccccgctcgccctagagagcgcagccgcacgtgaccccgctcgacctggagggtgccgtcatcgccgccgcttcccccacccgcccttgacgtcgccgctttccccacccgccctggacgccgctttccagcccgccctggagagcaccaccgccacgtcgctttctatctgccctggaggagatgaagagaggggaaagtggaagaaatacataagcatgacatgtgggaccacctaattttgctgattggatttccacgacggggccatgtgtatgccacgtaggactaaaactgctccggattgaggggggggggtaattcgtctggtttcaatagtttgagattccggggggggggggggcaattcatactatcgcaatatttcaggggggtattcgtactttttccttaatgtagtaatgtgaaacaaccttaagcaagtagcgtaaaagaaaatctatttttcatttgatacatggttttaagaagagtaaatactagacacatttcagattgctacaataatatatagtctatgattttatcaaaaatctgccactttattagtctgacaattcttggagccatctgtcattcatagatgcaatacttaggctggtgtaagttaggtctacatgtcatatacatagaggatcgtaaagtagtagttttgtgataattaaaatctttttctatagctggagtttttgtgaaatacctatctaaagttgttgcaaattaaagcgttatgtttgacaaaataatggtagttttgggaaatttaggacctgttcagattgtagccaaaataaaccttattaagttttggcaatgtcaaaattttggcaagatagcaatattgccaaaattttggcaggatttcttatgtattgatcaaatttggcagcaaactaaatatagacatttttttagtaactttaccaaaaaaaaatgtatggttgaaaatgacatcaaagtgaacagaaccttatactatcttaagaaatatgtgctgatcattttgaaaatggtagggtttttggcggttcccagaaacccgaggatcaactctttattcgggtaccactctcgatgctgcaccgtgacgaacttacgcatgttggactcggaagttggcggaagaacacaataaagaacggagaggccagcaaaggctcgtcaagcgtacgacagaatcaacgcaatgtcctagttcgcatgttttgcccaaagcgccatgtcaagatgaccatattccagacaaccctgacatggatggaggcagctgcactcgtcgcttgcatcttcatatcgttccggcgtttactcaagcaagactacgtcgatccaaaagacaaagttaaggatgaccacaagaacattagaggttccctgaatgtcttctatgggctggcccttgcccatagcatgtcctactacatcttgattgttgcgttccagtttttagtggctccattggtaaggttggtccattctagttacaagcttcatgactggggcatggatgcagtttctgagtatacagccaaaaagctttgggcattcattaggtataatgttagggaagctctcgagatgaatttgatcacctttggaaaggagctggcacgatccgattcaattgatgaccagttgaaaggagttaggattcttgattacatcataagatgggagaagcagcacttatctagagcaggtgttcttgacatctacaagattgagaagtacaaagggagggtgcttacaagtattcgagcttccactgagacactagagagagtggtgaatatgctggggctgaatttgaagagcctagaagaggaagaaactagaggtcatgcagcatccatagtgcttgaacttgctccatacctcctattcgagaatttgcctgcaatgccacagcttatagcctcactactaacgacaggccgagagaggatcaatgaaggcccccatgacataaatagtgtggagctcacttgttatggtgtgaaaattcttgaaaggcttgtagagaatccagataaccgcagatctgtggctgatgccaatgtcgttttgtcgaaaattgtagaactgctaaacttcagagatgattgtaaggtacctgttccagatgaaactgagaatagaagccaagaagagatagttgaggcctcactaaatgtcctgcacaagctagttagcactactggtgagactggcgaagctctacgaagcaccatttccaagaattctgagatcatgagcaacatcagaaaaatcctgtatcagcatgataacaagaacagtagtttatctgttcatgctgtaaaaatcctttcttgcttagcgatgcatgagactgctagagaagtgattggaagttcttgccagatcgtcaggaagcttgtttcgtcggttcttccaaggcctatggatattgttcaagatggcaacaatggatccacagttgctgactcagccgcacaggcattagttctgctaagtactgggagtgaatacaacagggcaaccatccttgataaaattaatctggaagagcttgtcggcatgctctttgatgcttccatggagcaaaggattatgatagcacatctgcttaaacatttgcggacgtattcaggcccaggttatggaaaccaactgaagaaagtaattgacggttctctgccaaaggtaaattctgtcatatagttgagtttttgcctaaaattggaattcgatactaaattttctgcatcaccataccactgaagaatagctgaaatatgtgtcaatgaatacaatttttctgaaggtaaaataaagtgttcgcgtgctataagtttcggtagtaaactatctattctttgtcttccgttacatgttccaattctatttctgttaaaaagctaaatcttatgttttccatgacaatctgtattgcatatttagttagaaacttagaagaaaagtaatatatgttatcaattaatgccatttcagttattggaagaaatcaaagttgcagttcagaagctcgataatcctgaattccctgatggacaaccttctcatgtaacaaacctctctttctaagacatcattgattccatgtagcttccctcatttaaaacgtacactcacttttcttgagtaaactcacttaaaattggtgctgtgtacaactaggacctgaaagaactgaaagctgaagaaggcaaactactagacagctttattggcctcagctcacagatttgccactccttgcaagccattgattttgataaggctctacagagtgccaaccttacaatggatacgtatgctcaagatggtactgagcgtgtgcaaatctcctaccaccgatttcccggggataagaagagtaacactcagtcagatgaaatggctgataaaaaataacgaagattacgttggggtgttcaagaggtatgaaatggacaaggcgctgaaggaagtggcagagacagcaactgagctcgagagcttcgagctattctgcagtggttctggtgttggcaagcatgatgagcccatctcttctgctgtcagatctactttggcgctgcttgcaggagattcagcataatgataacattgattactgcgtttgaaggtatcaaggatcaaggtatatgctgtttgctgctacgtctcgacttccttactcgtagcaggaccaatttgccgtatgtcaatttaattatctacactagaaagatagcctcctgaaataaaattaatgaaattttattatgaatatttatgtgcaggtggctttttattaaaatatttttattatattccaaactaaaattaaacttattttgtgttatttgaatgctgattttttttaattaccattgcaacatataaattctaaaataaaattacttgagatcatgcggttttgaattgatgagaaaatattgtgtcgaaacaatggaggtggttccgtttttgtcaaaatttcactttgttcggttataatcaaaacagcagttgatttttggtaaaataatcatgagcatcaaaaaccaatacccctattatagctagtcatttagattgatccaaaatcatgttatctttcttttcccatcataaaatgtttccaaaaaacttttcaaataagaaacttcttttgtcaaattagcacaaattttacaatcaatcataacacgtttgtttttgcgatatctagagcaagaaagcacttcatcagattttacaattatttttttatgtagtcactattattccttgcataccatttgaccttgctttgttagatatcatgatatttttgagaatccatataaaatttagtatttgaagaagctattgacctaaccaaacatatcgaattgtagtaaggatcactctgaaattttgttaatcttaattggttttttatgaattttctataaatttttaaataataaataaaatctcttcagaggtggtggcttatgaaaaccacctggaaaacgaagtgagatcacatatcagtgagaatccacatttgtacgggtcaactttatcattgagaatccacatttgtgcaggtttacttgtcaactcttttgacactatggagatgaaagatttaaaatatactaatttggacaatagattttaagtttaagatattattttttatagtagatttaacctatattttactttgtacaaaagatttaacatagagaacatggtgatatatcagaaagcaaaagtttctccccaatttaaactacttagaaccctcttgtcatactctggggctaataacatgtttgtggagtatatagctgtcgacgagtgatacttgtataccggatgattagggtattgggatatgttggaacgaggatctacgtaatacgacatcaagcagacaaaagacaaggattatactggttcgggccccttatcaggtaatagccctactctaatttatatgagattgatgatggaaaaccaaagattacaatggaagtagacagaatcggcgacccccggcgacttggttccgcgttttccggctttgtaaactatggtgtgtgttagcgatgagattcgatgccttgcacccttccctgggggtcccttttataccatggatcatcttgatccccaagtaagactcgaagacattggatcttatacgatataacaaaaactctatcccctccgagtaggactttgaaaatcactcgactcgtgtagatattttccatgatttttaacagattccactaacatacatagaaataatccacgtacgtgaaggtataccgtatctgcatattccataagtcgtcgggtaggaggtatgccctatcaggaacctgacaatagcatcttcttaacatagatatgatttagttatttgaacttaacatagatatatgtagtatgagcaaactgtgaagtcggagtagagctcagagtttctaggtgaacattaattcattgtggctgctgcttacggttgtagaagtatatataagagcaatgggaaaacttgagaagactttgcttgcttgtcataataacaaagacaaacgactagcagacctcccaacaaggcggtcttaattcatttgctccaccatattatattactacggccctagattaaaactcttcaatataatactagtatttcgcatgataatatatagatgtggcacggatcgttatgtcgctacaaaaaagcttcgaatctgcacgcatgtggcttcgtatctccagttctccaccccctgcatggtaacagtctagtgatattaaagggcaagaacagttgaacctactaacatatatatactcgctctggcactgaaaaaaccaacttctgggacgtgtttgaacaagtactttttatcccagattcattattgaaagttgatttttgggacaaagaatgaataagtgatcagaataacgacataagatgaaaagaagtggagaagaaattaagttaaggaacgatgaaaattaattatagaattaatatttgcactaactatatatttaagttaaggttgtatttttccttgacggtaaaatgtatttttctgatggtttcacgctcatatatatacactagtacaatagctatttttctgtgcggtcgaatcggtttttgcgtgcggttgcttcacccgtctagaattaagggtctgcgaaaatcgtgatttttttttgcgggtgacgcatacgcacgggaaaataaaaaatcgaaacaaaaaaaaagaaaatcaaaaccaaaaccataaccctaatccaccgccgccgctgccctagccgaggtccgtcgccgtcgcccgcgcggtcgccggcgacggatccagacgctggaagaccgctgccgtcaccgccgccgtcgtcgcccgctcccgacgttggatccgtcgcccactcctatcaccgacgccggatccgccacccccatgcctcctcactgctgccgatgccaccctcccctccggccgttgtccccgtggtcgccggctgaagacgcccctcccctccgccggatctccaaggggagggaggggagggggaggagagccaaagggagagggaggagaggggccacgcgccgccgctgtctccgctggatccgccgcccccatgactccccaccgccgacaacgccaacctcccctccgggcgtcgtccccgtggttgccagccgaagacacccctcctctctaccggatctatcaaatcattattttatatcaaaattttcaaaacacgttgtttaatataaatgttacgcaataatattctctaccagtaaattccaatttatgatctatattaactaattttttacattaattactgaacccactattttatactatttttaataaaaatattttgatatcggttttcgcttaaactgatggacctattaactagacctattaaggacctattaacacgcatgccatatctatcttttataaaagtaaaatgaaacatctcaagacctcatacatgtgcatgtttgccttctgcacatatgacgaagcatcgtatctgaggcagctaaggtgatttgtcaaggtgatccgataaacactatacataccaattaaatttatataattttgctcttatttcaaacaaatattgtttcgaggaaaacaatcaaacatgcgaaaaagaaaaaaagggaaaacttcaacaaattgctgatattttgcactacccaaccaagcaattctgccaatgatttgtgtcctaacaaaaattctttaaaactttggaaaagaatatgaaaattttgaacttctacgaagggaaaaacaatccaaccattaatctatgattaatttggttgtcaataaatcatgcatgttcatgagacgattcgatcaaaataactttgagtccttgtgttgacagaaaacacgagacctaggaaatctgcttaactccagtgcaggtccaaaactcgcattcggatgtgtgagcgtgccagttgatttgatcctgcaatcaacaagaaacaaaaacaaagaaaccgaggttaaattcataaatgatagccgatcggctaattgccaatgacatatcatttatccttgagccgatgtcatatgtgaatcgatcggcagtcataaatatgtaacaaggaactaaatctactcgatcggctgtagatattagcaatatataacccttatatcgatatatactcaaatcaagtgattgggatagatcggtcgtcatgccaagacagtacaaatcacttagattgaaatatatattaacaacaagattatatatgctcatagcatagccgatcagacagatctagtatgtatcagctaatactccgatactactctatattaagatattaaagcaagtagaatacaccaaacaggagcctaatgtacttaaatgcaacaagatcttaatataaagggcagatttaacatatcaattgagcgtataaaatagaagtagttaaatcagataagatcggctaaaactccgatactaccctaatcggcaaccagaaggcaggctagggattgaaattctaagcacgacttaatagatcaaactcaactgatgcagcattaagtatgaaaagaagaacaatatctagacaatcaagccgctggatattttatagggtggtagatatcttatataatctaagccaacgtcgctatttaacctaatcggccgccttctactaacagatgttagccgattataggttagataatgatattgtcagagattatatagaatatatggtaactcgatgaattacataaacaagattagagtatcataaagatggaagcactaatcccgagaacacaagtcgtcataacaagttttacctcttgttgaagatcgaaaccgatgcagctcaacccgaaagaaagaactcgtcgaaataaaactaaagcaaaagggtggcgatgcgccgaaattgtattgaacgtatgtgttaataattacatagggctcgaggtctatttatacccgagaattataagatatgtccatattggacacgactcttatctctaacaaactctaagataccataagtctttgcggcagacttttgcccacatttatctctaataaaatatcctaattaatagatacaattgccttcccaggactctatccatgcgtggcaatcatcttgaagcacatcaacttgaacccgatgtcgtacacaagtcgtattgtcggaatcggctgtatcacttaacccagtctgactcggatttagccgatcccagtcgtagccgacccggactccagccgattcttactctgtttccgcaacaatccttatcttcgattccgcttcgatcctatcttcatctccgatgctgatattaccaaatttggtcattaacaccttgctatcgcaatttttacttgtagcaatattgtatggtatgtgttcaaatggtatacatgatatttactcactcagtccaaaagtaaattcaaatgccatatgaccttgatctatcttctaagtcaatgaatggtttttagatatacccgacctatagtttgcccttataaaatatagtttctaaagaaattataatattacgttacgatagtatagatgtccgcgcatcgtgtgggccaccttcctagttattatatactaaaaatccattaaacttcctataaacattcctaagtcgccacatgtcttcctacaaatgctcttaattcgacacgtggcacttttaaataaggtggacccaccaatttcttttatttaacaaaggacccactattttccttcattgcatttactttaataataaaagaaaaggcccatggggcctgtacacatgtacgtgtgctgcaaactgcacatacgcatgcctataaccggccggtgcatctcctcttttttatttccatgccctattagattgaacatattttgtagtaaaaatttttttgaacaactataacatcttacatcatatatatagctaattttttatccatgtacactattagatcatttataacaaatatttataattcacgtcccaaattaactgtatttaacaagtaaaagaaatacattgctttggaccagctattggccactcaacacacatttttacatttttaatggaaaaacacatagatttttaaaccatgtgattaacaacatttagtttacactagacaatataaaacacataaaactaattaataacattaaaataataagaagttaattagaaaatacatattcccccgtcccaaaatataagaaatttttgttggatgcatggacatagatttagattcgtagtactatgatatcccattcaaccaaaatcatttatattttgtgccactacaaatatgtcattttagaaaaataccactactattcacgatattgcggatggcgtcaaggatggcggtggcggcggcacccaagacctcccatcgaagatgcgatcgaggacagagacggcggcggcggctcccgagcgctcccacgcggacccctgtcccaaaatataagaaatttttgttggattcatggacatggatttagattcgtagtactatgatatcccattcaaccaaaattacttatattttgtgctactacaaatatgtcattttagaaaaatgccactactattcatgatattgcggatggtgtcaaggatggcggcggcggcggcggcacccgagacctcccattgcggatgcgatcgaggacagagacggcgacagtggctcccgagcgctcccacgcggatggcgtcaaggacagcggcggctgcggctgcaggttccgagccctcccgtcgcggatggggtcaaggatagtgacggcggcaggggctcccgagccctccagtgtggatggcgttgaggacggctactcccgaacctcttgccacagacggcagcggcggcgacagctcccaaccctcccgccgcggatagggccgacaatagcggtgacggactgacggcagtggctcccgaggccttcacggaggtggtcgatgacggcggcagctacggtggtggtcgacgacattggtggagagagaggaaggggagagagaagagaggggagggaggtgaagatgaaactgacagctaggtcccacgtgcggttggggctaacggagatttttgacggaaaacgtgatggagtgatatgattctaattttctcaaattccagtggcacgtagccaatatcgtgaatagtaatgatatttttctaaaatggcatatttgtagtggcatagattcaattaacccttaaaaaatatcacttcatactgcatgcacgcaaccggccctcctcaccttctcttccctttcctttaatctttttttatagtagttgagataatatttgttatttatcataataaattctaaacaactataaattcaaaattacacatacaatttttacatacataaaatgtaatagttgagataggcttaaagtggtgctgacatattttaaattataataaataaataaatgttttgggtcatatattgacccttttcatcgtatatgacaaacaaatggcgacatatattattttatcatatatcacttttacaaacatgcataactaaattcactctactattgaaaacgaagtttagtccatcatattatttaccattaaattaatattttactatctgttttgaatatatttcaacttataaaataaaattatattttaggtcgcatttttattcttttcatgtaatccaaacatacatgaaaattatataacaaatgacaatataaagtatatttattagttgacaaatatttacgactaaataggatgacaaaaaccaaaaatgctattgacaaacgcccaatttcaacaaatgtcatcaacaattttatttataaatggaaaaagtacgaattacttcctcccgaactatcgcggtcgtctgaattaccctcccccaaaccacaaaaccaggcattcttcaccctcaactatacaaaccggacaaattaccccccttgacccaatccgcggtggttttggtccacgtggcgtacacatggcagtccagtcagcactctatttataaaaaaattgtgggacccacctgtcatctcctcatcctctcatcttctctttctcaaacgggaggacgcgcggtggcgtgcggggga

SEQ ID NO: 78508 - DNA, 2482 bp, Oryza sativa
ataactgcttcaacaaacgacactgtatatattatgtcaatcggggaagaaagtgctgctagcagctcctaattagttggccaatctgtcatgcgcgtgcatcatatggaaacatgcacttgcgtggctgtctgttgatgctcatgatgatcagaaaaataacttggcgactgacgtccggtcatgccgatcagagaaacaactcggcgacgacagtgattggatccatcgcttaaattaatcttgccggctagattggatccaagttggagaagaaaagcttagcgaattcgtcggcgacgagaaagttgcagctcccgaagtaaagaggaagccggcgactcgtgaagttgattccatcgtacttgtcgatagaaactcgacgcacccctacctagcgcgccaactgtcgaaacatgaattcggcaataataaaagggggtagcgcacgagacctaaaagtggatggatgcggagacaaggatttaaacaggtttaggccctctcaatgagaggtaataccctactcctgtttagggatttaaatccgccgggtgtagtatagatctgacgatcatatgtgctcatgccccctagagggcctcctgtccaccttatataggatgggagccaggattacaagatagaaaccttaaccaatacggtatcggtttcctaaatctattttacaatattgtcaaatcaggactttaggtcgctccataatataaaaggaaacgtaatacccaagtcatgatttgttacatattcctttgatataagctatcccctatgactagtcagataaccatgccgtatgggtatgaggtacccataatctccacatggcaaacacataattgccgatgaccgcttctctgtcctctgatgagatagcatgatcaggttctctccaaaatgttaggaaaaaatttcaatggcaaccatatatcgtaaacaggatacttgtttgatatgcaatgcccaaaccattgataacaggtaaagagtactatgatctgctcgtcaaagaccacgaagaaaaaatgatctacagatgtctgtaacacactaattcttgaggatatattagcaacaataaccttttggtatgcacttgtgttacaaattttataacatcgaatgaataacaggaaacctaaccattaccagaaggatattaatagtgtcagcaaataaagttgggtaaacattgcaaaaatcatctctcgggatcaaggtatattgcaatcatgttatcttacaggaatcctataaaaaaagcaaaataccagggcctatattgtccatgttggaagatttaaaaaattggttaaagcaaatgtaattggcacattaaaatgacaggaaggaataatatgagatatagcttaggaggttgacaaattacagattaattagcattctttaactgtagatagaaataaatgtaagatttgatgcagacgcctactcagtgctcatattacttccatagatactctccatgcactttagcttgttttcacttatagaaaatcggcatccttatgagagatttagagtctcatgggagcataaatctctactatctcataaccatttgtgataccttttttttcgagggtgctcatacctaaacacaaaaaactaaaatacattcctatccttgaaaattatcaaaggccattgatatgcagcttgaggtgccatggtagaaattaggcgagattccccatgttgatacatctgctgatgatctgcagttatgcacccatccacaacaaagtcaattagtatacctggggatactaccagctttttatgaatgataatcaaatagtgtgttcccaaattagataagatatattgagcactcaaccattgggagtttatatattgaaggacaataagtacaacgtatctgagagcatatttttagagtttatgaaaaattgggcggcgaccggccggcgatggaatcagtctgcggcgcgatgtagagagaccacttaacataatggttctagcatgtagatcatagaataatcaaataatttgatacccctggatacccctattctggaaatagtacaactgaataaattggctagactacagtacaaagaagaataattgaataaattggctagactacaatacagagcataataactgaatatgttggatagattatagtaccaaccaagtctaggtataattctgtccaacagaattaacagtgcacatgctattctctttcaaattcacatgattcataccaaaattaatggttcagacttagtaacattttaaacatggaatcaggtaggggaacatatatacatgatgagagttggggagaaacaaagacctttctagcaacttgtgttagggtctggcccgtttggcgtttgccacccaaatttagatccccaggagttcgaaaaagccaccatggccaatcccatggaactggaac

SEQ ID NO: 78509 - DNA, 2530 bp, Oryza sativa
ccactgcggcggtatcatgcgatcagcttcttcgccagcggcgtgaggaggagcttcctcctcgagccattgttcaccttgagggacgagttctacaccatctacttcaaccttgcagcctgacaagtgagtgacaacgacatggcaatctctctaattttttaaggtggtggaagataattaatttgggctaatttaattctttgatccttcaatgctcaatttagtaattagtacaaattagcatggcaagtagcagttgaatgggaaaatgagtttggtttacatgtacactctgcctctcagtgtttactggagtagcagtgatgttactctgcaatttcagctctttatcttgccattcttttcttagaaagagtatatacctcttgatgcagttgagtatacacaaaaagttctgcaaatgaaagagtacttaaggatcaaggatattcttgacctgattcctaaagcgtaacttctatgtgggttaaaataaaaatctgagcagattcagatattactttgtttgcacttcattcaaagctatctgatgttaagtggactatatgaaatctgagcaggttctgaatttactttgtttgtactctattcaagctatctgaattaaagtggacaatatgatatagtcaagtttgacttaaggtttatatgattccatgcatcgaggtgggtgaacaagtagagcaggttcttttcattatctgatgcctcattccaaatgcattatattaccatcttggtgtataaaacattatctggaggccatgattacaacatactcctctctttctcagataactatggatcatattgcactaatctgattggtgcaaattgctgcaagtctgcaattgtgatgcacccttttgtgtctagagaaaacttttgatgtgtcagccagtgaagaattgatcatcaagactgaaaatcaatcatacagttgcgacagatgagaatacgagatccaagatctggtgacagcgaggagacaatcgagacattcaatggcagatccacaatcaaaataaagaaaaagaacaaacatagaacataaatgaaaatttgtgtagctgtagcaagcgaagatattgatcacggaacctaacatttatgatattcaccttttgtttgatcttttttaccatctatttcatttagttgcatattcaaacctaacagacaaccaaaaatagatcacatagagaagctccacatgcaaaagtatatattccagtgtataatatccaggtaaagccaaagcctacacaaaccaaccacagaaccacattctcaccaggtcacctaaacttctaaacaagtctttgtgggagatatccaggtagtatatatattgtgaatcctcacccagagtttaccatgtagaagattgagatgtactgcacacaggaatggtcatcagtaccatataacggacgattgctgattactattactggttgcaatgtaacacttcggatacaatagtacattacagagctagctaaatgcgaagccacaataccgtcagcgcaagacgatcataaataaagcttacacaacatagccaacatgcaaaccattcggactgaccagagatgagggttcttgaagctgccgtggtgtgccatgcatcacaaatgccgaacaactagattgtagcagccaacatgaaaggaaaaggcatggataatgcagcaaagatggatgatgaagaccgcagattgtgacgcttcgttcaccaaccatatgaaacccctaaattttgtcaagtttctccgccttcaccaccggattagccttggcaatagcatccctagcagcggtccgatagtcaaactggcagtcatgcttatcggaatagcggtgcattgcgcagtacaagttgccacatcggcagttgaatccggtaagaccaaccctcttccgacaagtggagcaccgatttggtccttccctccccttggggttcaccgtgaccccctcactaggaccagcaatctcagcaggctgcgcaacaagcgtcttcacctcgacttgagcaacagctacttcagcgtgaccagcaataattggttccttcccggaatcaccaccattgacaatgctgtcgatagaggaggctgccagcttggcctgctcctgcttcattatcatctccttgtggcactttgagcacatgttcatggtagccgcactgccaaagaagccgcagttattgatgcaaaggatcgggccttctggctgctggcatccagtctccttgtgctccatggcttccttttaactataaatcagaagaagaaaaaatgcgtaaatacaagactaaagaagaaaaacaggttccatttttccactctctaaaagcaaatgcattacaatcaaatgttccacttcagggtagcaaaactgagcagacaatatctgccaatgatggcatatgttcttgattgcgcaaaatacaccgcgacaaaaacaagaagcatagcatacatgtcaaatttcactc

SEQ ID NO: 78510 - DNA, 2299 bp, Oryza sativa
  unsure (1)..(2299): unsure at all n locations
gacggcaaagccggtgaaggtggttgagcggcgcagcgacggctaggacggcagtggtggtctgctgaagacggcgtatggtggtggtggctcgggcgtgtggtgaaagtggcactaggcggttgttttggaaaggtggagtggcggctggcgtgcggcaaggtgtggcgaatgtggtgnaggcggtggtccggcatgaggtggctgggaacgccggcaagaggcagccggagaccgacacaggcggtggcggctcgggttgatggcgaagctggtggctcgggggtggattggaggattggaccggctgccggtgtgcggcgtgaggtggtaaagccggtggtggtggtttctcgatgcggcgacgacaggaacggcaacggcgcgctgttggagagctccagcgagcggcgcagctcggcctcgcgcggggagagcgggagaaggcgcgacgggctcgggaaatttggggaaatgggagaggagagcacgaggatcgtttttatgggctcggggtggtgagatcgtggctgtggagggtggaatcggccggcaacggccgacgacgtgggtgacattgtgggcgaagtggggactcgatttggcgcaaaaaattgcggaaaagtgggggatttggtggaggagatggaggggaaccgatttcactcggtttgggcgcgagggcgcgggtgggagggcgccggattcggcgggacgtgggcggcaacggccggccatgggcggcttcggcctgggaagccgaaggtagtaggaggacctgacaagtggggtcgccgggcccacctgtcggggagggagagaaggaggagaccgagggggttattcagactttgtgcgaggggaagtcgatcgcgccgagaagggtggggtcggcccgagagggaggagggaaggagagaggggcgagcaggctaaggagggggaaaagatctagggccgaaaatggcccaaggagaaaggggagattatttgattttctttttatttaattggttaaatgatatttgtaatagtaaaattagatattgagcttcgaaaattcgcgggaaatttcagaaagttcattagggcacaaagaatattacaaaatattctcggccatgatttttaaaggaaaattttaatttcctctataatttcacttgattaaattgatttaacttttatttaatttctagaaaatgcattattaaatgatttttaatcccgacgaaaatcggggcattacactatactattaatatatggtcccacctgttatacatatattacgtcttggagtccgcgctgcagctggctatatatctgtaacccactgctcttctctctctttttttatctttttaaaatatatgtttatagctggtttatagcatgctattgtacatgctcttagagcaccacaccatagctaataagtgttcctagaaagcttaataaattttaataaatttttatcgtatggtatatactccgtagatagaagataaattccgtcgacggatatctcgactcaccagtatggaaacaggagcgtatggtagtccatcattttctccgtgtgagacagaagtgtgacacccttgtttaatacctagggcaggccgccataaagtccgaaaataacatcccacctcccaaactaattagctaacttcctgtctgagctaggaatcccacaccggtattacctgagataacgaaaattcttcgcctcggacgaccggcgtgggggagcgaaatcgggcactcttcccccatgcgacacgcatgccagtgggccccaccatttatcttgccttcacctgccacgtgcccctatcaaacatgtttcaccaaaggtattcacaatgtttcactatgtatatatataatgttgtagtatattgaaatattcttttgcaacaaatcacccacatattttggaaaccctttattaatgaaattcgtttcattttttgttccacccaaatatgttcacctagtgtactcacaatgtttcactatgtatagatctattgttgcagtgaacgaaacattctcttacaacaaataacccacatattttggaaaccctttattagaggatccgttttatttttgtccaccacaaatgttcacccagtacctagaatatttacttggataagactaatatgcattgactgaaacatctttccttattgttgaacttatttttattaagtaaaccaagcccgattaaaccatagttccaccaaaagttttacccantgtcctcaaaatattactttggttc

SEQ ID NO: 78511 - DNA, 2028 bp, Oryza sativa
  unsure (1)..(2028): unsure at all n locations
ccgtcatgatgctctagnacccttgcannagncnngnncgacgagttcttgctttcgggttgagctgcatcggtttcgatcttcaacaagaggtatttcttgtttttacatgtaagtctctcgagtcaacgtataagtgcattgaagaactgcacagctagatgatactgaaagtgcattaatccccctagtgggttttggtgattaatgacaaatgtggttaagggactaatgagttcattgagtaactttcaggtgcattagtccaaaggtgtggaagatggatgcttggagaccccccaaaagtacaaaatcaaagcggactggaactcgagaagtgcataggatagtttatcttttgaaatcgagtttttaggaaaaaccgtactattaagaggggttccaggtgatgctctgagatatgtcaagtgctcttagtgtgaaccaagtgtcaagtttccctaggagtcatttctgcttatactccatctgtccaaaagtgcaggtccggaacttcctgtcttctaggtccggaagttccggtctgatgaaagaatttttccaaagtgttatccggaagttcctggcttccaggtccggaacttcctgtctagtttccagttcaaaattgtgagtaacggctagatgacgtcacctagtcattatacatatacagctcgtttccagctcgttctttggccattccactttcacttttcgaacctagagctgttgctagcctctcccaagtgtttcttgccttctccactcaatctagagcctaattcttgtgagatagagagattgagagggagagaagaagatttggagtggtgtgaagactaggaacttgtgtgagcacttgaatatctcgtgggctgtcatctcggtgcttattatctcctagacggttaggtatcacccgcgagaatccgttgcatattgtggatgtcccgggtaagtttgtgaaggatttcctttcctccgaaagggaacgaggtaagttagtgaagttcttgtgctgagattctagaggtcttccaagtagagcaacccacacttgtggtggatttttattagtaggttgagttggatcttggtggttacttaattttaaaaatttgcctaagggtgtttgggggtgaaagctgtggattttctttgggatttttgcacaagtgaagcaaggggttaaatgagaaccaatttttttggagcttcttaaagggagagtttgattgggagatccgaactttgggaaaaaaatgcttttggatctttctgggaagtttattggggatgaatttgggaaatattctttggttaagaataattggtggacaattttgtgaaagtttggctttaatattttggttttgaaaattggaatttaatttttgttcttgttacccggaaatttctgtgtttaaaacaatggaagttccgggcttgggaagggcggaagtttctggaatttcttttccaggaagttttcgagttttattttaattttaaagggttggaattttgtattttaaatatttaggggagaaacttatttaaacccgtcttttaagggttatattaaaaggggggagaaaaataaaataattaatattttaaggcatatgagtgtggctcagatatgaaaaatttaaacaagttttgggagaataataggtatataaaaagtgtgggtgggagacttttggcaattttattcaatcgggagaggaggggttttataaagatgtttgtttaaaaaataaaacaggtttaagttgaaaaagaaatgtgatatctacaaatgggtgtgtaaacacaaataaaaggtgttaaaagaaagaataaaaaaattttatatctggaggtcttaaaaagaaaatatacataaatatgggttttataatatgggaaattcgtggctgtgggggggcgtttatatggtaactagatttgtacaaattgtagtaaaatgggggttttttgtgggtaataaaaaagtggtgaattaggtatattggtctg

SEQ ID NO: 78512 - DNA, 3482 bp, Oryza sativa
tgcatcacagaaccccccatcaagaacccatcaagaaaaagaaaagaaaagaaaagaaaaaagaaaacccctcaaatcaacagcatcccggatcggccagggaggagcaccgggggcgagagatcgaggcgcgattgaatcgggggggggggggggaaagggagtaggaacgaaccctagaagggggaggacgaggaggcgaggggagaggaatcgcgaggaatggaattcggtgggcttcgaaatggggggcgaaacgtggggagttgggggagagagataaagcaaggaagaagagaaggtggaggccgcgaaattacggaaatgccccttcccttcccccggagcggtggggcccacctcgatttttccgtgcggggtgggccccccaccgtcaggttgccgggttacgattcttttgtgtgtgtgtgttcttttcttcttcttctgtagatggacagtgagggagaggagaaagagaaagtgccgtggctgtacaactcaaaagttggaggactatatgtctttttttttctttttgagaaaagatcttctgaaccttgttttagttaagttttttaaaacacacttttttattgaattattttttaaaaagggctatttgtcctgtcatagactttagcacatgtgacaatgttgttttactttgctaatagaatggtattgtggaatagagtagcttatactcttggttgactgtccatgaatttagagtttaagaacttgtgcgaaatgaagattttatgttgctgcaagaatcttgaacttactaaattaggaatgtaatcttcatatcataaatgaagctctctctttaacattgtcgagtttcatattaaatataaaaaaagggtattcaagggttttgtttttataattgtattaattatatggtttgttccatgggagaaaaaggtaaggttggaggtatagaaaccaaaaggttagtttagtagttggaagaaattgaaagatttaattatattcactttttttttacatttgacttaacacaatacacctcaaaaaaaaattatatctgccttccatcccgccacattgtatgcctattgtttccttgatgattaacacctgacctcttccttttttattccctaaggagctttatccctattgtcgcttaaattatcatccatatgttatacccatatatcaccggggtcttataatgggtgaccattcattgggcgtgcactagtggatcgcccacgcttgtgtatcatattagcatgtgcacgttccatagttaatcacaaggcaaatcataacctaagtgtcagatgaaactaaagtttgaattacaattttaatgaaaattagtcaaaaaaacatttttaatgaaacattttacctattaaccttttatatattatgtttacagacttttcatatataaaaacttttgactataaatcccattctaggaattaatagagctctcctgatttcagaactcgtttatagaagcattatactgtaaaaaaatacattaaatgtaaaagatatatattctctatgtgcaaattttagcacaaatttactataagtaaaggtagagatttccaaatgcaaagtttttttttgcaaaaaaacaaaaaactagaaattgaaacgaaaacaaaagcccaaaagcctatgcggctgaactacggccctgtactcggcttgcacaaagctgcttgagttgggaagcagcgccgaacacctaaaaatgtttgcgtgttattctcacgtatttttcaccctactttactgctccctctatcccaatgtttgacgccgttaacttttttaaatatgtttgaccgtttatcttattcaaaaaaattaagtaactattaattctttttctatcatttgattcattgttaaatatatttttatgtatacatatagttttacatatttcataaaagtttttgaataagacgaatggtcaaacatatttaaaaaagtcaacggtgtcaaacatttaaggaagaatggagtattttgatagtgcgatcacgcctcgctctcgatatgttgcctaggctaccttcatattaattattatgaacttctttttaacttttaaatatagcatttgaccattcattgattagaaagactgtacatgtttttatcgtgacttgtttatcattaaaaatattttaaacataaattttatatttatatttaattcgtttaaataaaatgatctatcaatgtaaaaaagaacggtagcatatatttgaaaacagagtatacgacgccctagccggcctatcgctagtacgttctaccctcaagcagcatcacgcgtacgtataaactactcttgcagatcggtcgagctgtgtgcatgctacgcggcagtacagcagcggacgagagatcgatgggaagaatgagatgagcgctgggcatatatgtatgcgatgatgcataggtggtggctggaaaggatggcgattttgtccgtctctagagcgttacgttttgtacgtggcgagctggcaatgatcatcttgtactacgtgtgtatggtagtagtccacctgcctgtacgtgcaccaactgcatctcccgcacccacatttctactgcctctactcatgcataaagtactccaagttttaggatcagccacgaatattagaacgaaaagtaaaaaaaatatagaaatatattctaggattcaattctagaaattgctatatttgagataaagaaactaaacaatagtcgaaatattttcctcttgtatgttaatcacattttacaccatacattctgcataaagattatcgcattagggcttgttccatccattgctaaaacgaactttgccatttgttggtaaagctaaaagttaggaatgttcttttttttttatttttccaaaatgagatatgtggaggtaatgtttggtttgacacttaccaagattttaatgtacttatacttatgtggcagtgtggcactactacaaaaatcatctttcatggcggccattttggcttttcgctggcggaaatcgcagccgccacaaaccaaaggccagtgaagatcacgatcttcgctagcggttttcgaccgccagcgataattcatttttgctggaagtcatcttaagccaaccgccagcaaagatccattttcgctagcggctgacttaagacgaccgccagcgaaaatgaattatcgctggcgggttacaatgtgctagccgccagtgttaattctggccaaatttaaaaaacggagcgacaccgctccgtccgccctccgtcaacgctccaccattcaaaaatttcacagtaatttatccaagtattcaaaaatccacaaaaaattacatgaaaaatttacaatcaacaatttccattcactcaagcattcaagtatcacaaaaatcaacacattaacaaaattttgaagtccgctgccgagccccg

SEQ ID NO: 78513 - DNA, 3200 bp, Oryza sativa
tggggtgttatcagtatagaccattgtaaaagatgtcatgtacggtactttgtaagggatttggaccgtctgtttgatccaacaaaactttcatactattttaaaaagaaagcatgaatctgatataaaactataaaaaattcaaacattcacagaagagaagtagcctaccttgataagctccgaggggcggaagccgcctatccagaggaagcattgctctacggcgcccttccacaggccggagaggaggtggagggggtcagcaccaaccagcctagccttgtgagccatcagcaccccatagtgtgacatggcttcatcgacatggggctgcagctcgccatccggtcggtgctcctccacagcggcccggagccggctgatcacttggtggtgtgcctcctgccaccgctcatactccaagttgaacaatgcagcgtctgaaacgccctcacataatgtatatataaatgcatttttgttagatgatatgacatatataaatacttatggtctttgcaccaagacatgcaaataactattgttgctaggcgtgttaagtttaacgtgagatggagcagtgtaaatctctttattatgattaaatgctagttcgaaagtgttaacctgggcttagaattccagcaccgcagaatgcaccctgcagggagatacagaaacacatcatataacttataaattgttttttttacaaacacaaattgttcgttcgagataatttgttcttaattttagatattgattatttgcctagtagtagaaacttcgattctcctacaaatattggtggtttataaattgcgagtagtaattaatatttcccaaaccaaatccgtcctctgtgagatgattcagttctttgctgcttattaattttcacctgagctcttgtgaattgtatctcctgttcaagatgcgccagcctgatcctgcctgtctctagctgctgaatgtaagcctgtcacacagacaaaaataaaaagagaacaaattaaggattaattacacatgataatatgaagcgaaggtatcagattctgcaaagaaaaaacaaatgcaaagcccatgcatgtgtctaacacacaactcccattaggtggtaggttaacttcactagctacttccaccatctctttgcttttcttgctagctccaaagatttttgtttatttaggcttctgagggctgactacttgttcatttgttgactgatattagtacaagagtactagtactaattaactagcttagcttgctattgagctggttaatcaatggggtatatagtaatagtagtaactatagtaagtaatcaccttcttccttagcctgctctttcttgcggcctctctattctgcgccagccttctcagcgttttggggtccggcgtcttgggccccttgagctctgaacttgctgacgctgccatggcgccgccgctgccactgccaccttctttctagttgccatatggatacaaaattatagtaacatctaagataatggaaactttatttaactcacccagttataccaatgtgatacaactatccttttttaattagataatggaaggtttattgaactcaaaagtctgagtatactcatagcctctgtaccacgaaagtgcacacagccaaaacacccaacatacacaactaaaagggaacacaagattgatcaaaagccatctatccaaagactagaacgccacccatatgatggggtaaaaaaatgatacaactgtctaaccgagaaaaattccggacaactacagaggcgtacgtgtgtaaaaaagttaaaaccttgaatgctgccttggaggtcttgcctagggtgagtggcctgccatctgccgccgctggcgccggcgatctcctggaaaagccggcgatgggcggcgctgacatcgaagccttaagaggagaactggcaccttgtgaacaacacgcttaaattgtgatagctagctagagatacatatgtgcacatattaacatatatacctttggtgttggagttggctctccatccattggctgggaggggaagatgttgagagtctctgcatgcacacatgaacaagttcagtaattatgcattatgacttagtaatttacatagtttgtaggcaggtgcttgcatgctttcatgcacacatgcaactgatgtgtctcccagatatatatctgtgctaatttttcaaatgcgtgtggccaagatcttcaaaaaagtggggcaaaaaatatgttctttttggttgcaatcttctagcaagatcctgcgaccatatcagctatgtttgttacgtgtcactcttctccaattagctaataaaatcatgtatgactataatgaccaaaaggaaaagaaagggaatgagaagattggtagccattcaaaatcttacacatctagctataagctaaagcaagtcaaatcacagaaatcaatgtatgcatgacattctttgtattttcttcgagccatgtgtgtaatatactatgacaaaatactcttaacagtagatcgaccttttacaaaattaagtggtttgtggggttcatcttaagtagatggcttatcttgttcctggccatcaaagtagaggaggatagcttgatccaaatcagatggcatgtcatatccttcagggttccttcttctgcatttacacattatgacaatataccattagtctctgttttgcatttagtacgtagctctactgcgactgatttagagcttgatttttcttaatggtatattgtccgaatgtggtccatggaattagaaaggccaatattgatgttggaaaagggtgcaaaaagttaaacatactcattgctttacaaaaaagagggggggggatggaattagaaagccgctcccgccgcccccaagctgagctcgccggctcccctcccctctccttctccactcttggctcttcctcttcttcctcttggctctccctcgtccttgcgacggagcgcggtggcggcaggccacggggtgggcggagcagcgacggacagtgcatggccggcggcgggcgacggcacgcgcggcggcgcgcgaggcacgtggggtcgatggcgacgtcgcgccgcgcgaggaggcggtggagcaagcggagcttctcgtcctcaccaccaccaccaccaccatgatg

SEQ ID NO: 78514 - DNA, 1506 bp, Oryza sativa
aggaaataagccaaacgatgggacctttctatctttgtgttaacaatggcttgacctgaccagaccttactctgactcaaatctaggaattaggatgcggcaaattttaggctttggcagtaagaaaatgacaaggaattaggatgcggcaatttcacctcgcaattctgtcgtttcagatacgacacatccaccttggataactcacctctatccacgtcacctgtttgttggtttgtttgttattatatattttgcttctcttcccgcgaatctcccctctataaaaccccgcgccccacctcacctcgccaccaccaccacgacgacgtacttttgctgatcgatcaatgacgcggaggaggagcctcgccgggggtgcggcggcggctgtggtggtgctcgcggcggcggcggcggcggcgttcctgtccctgctcgacggcgcggcggcgctgcacctgtgcacggacaggctgttcaacgacacgcaggggaggcactctgacgggctgccgcacctgaaccaggcggaggaggcgacgtggatgggcctcctgccccgccgcgccgggccccgggacgagctcgactggctcgcgctctaccggagcatcacccgcggcggcggcgacgtcggcggcgagccggcggggttcctctcgccggcgtcgctccacgacgtccgtgtcgacccgtacggcgccaacatgtactggcaggggcagcagaccaacctcgagtacctcctctacctcgaccccgaccgcctgacatggacgttccggcagcaggccaagctccccaccgtcggcgagccctacggcggctgggaggcgccggacggccagctccgcggccatttcacaggtctgtatcaccgtatgccattcttgatctcatcttgcggcgatcaattttgttcaccgtttttgtggtcacttcacttcgatcgatctctactccatctgaggtgtttgtgttgatttgcaggtcactacttgagcgcggcggcgcacatgtgggcgagcacgcacaacgacgcgctgagggagaagatgaccaaagtggtggacatcctctactcttgccagaagaagatgaacacgggttacctctcagcctaccctgaatccatgttcgacgcgtatgatgagctggccgaggcatggtcgccctattacaccatccacaaggtacattgtgatgaaaacttagatctgttcctgtaattactctgcatgatctgattctgattacataaacagagtggtgaacttagatcagctctttactctgcatgatctgattctgattacattacatagggatgaagttagatcagttctttactctgcatgctctgattctgattacactacatagtgatgaacttagatcagttatttaattgctctgtatgctctgattctgattacataacttgtccatctggtggtctgtcatctggtgttgtgtgttgctgtgggttgtgactcttgtgat

SEQ ID NO: 78515 - DNA, 7643 bp, Oryza sativa
  unsure (1)..(7643): unsure at all n locations
ggagagatggagagaaggagagagggagtgggagggtgggaaggaatataggctagcgattagagaagagtaagagatagggtaagtctatacggatacgaagtaggataggtataggctaaagaggaagtagagagaagagtaacagtataggtagagtagaaataagagtgagttaggatgaaggaaaggggagggtagggagagcaatagtcaaggagagggagtattgaaaaatgggtagcagggcaaagaataagagtacgtatacgagaactgaaggagaggagagaggaggacaggggggaggggaggagggtgtagcaagaaagaggagaggagagggtgggtagggatagggtaagtagaataagaaagagtatggtagagaggtaaatgggcggtcgagagtgaggaggagagggaggcgagattaagagactgaggtaaaagatacaagctaacgataaagcgaatgttgaataaagtgttagacagcaaggttcgaaatggcttaaggagacgacagatggtatgtcaagttgttacgcggggtttgacgaccacaaacatcggtgtacacgcagatagtagcgggtagggccccgaaatgcgttgaacgcaagaggaagagcttaagaggagatgacgactttattaatcatcggtgtgcttacaaagtgcaccagcagcactccgtcgaagaattttgactaaactcgaaaccataactcaaaagtcaaatcaattgctctataaagcgatagagggaagcttnnngntnnnnntntggtngnnttagttcntgnaattngatcctacagttgcaagccctattccatgacagttgataccaatgctaagctatcctccactgatggtaatcctgtgattgatctgaccgtctatcgtagtcttgatggtgccttggagtacctcacctccactcgatatattagatatctcttatgttgtccagcagattttataccgccataaagcgtattctatgctacctttgctgtactctggatcatggcctttacttccaaacattcctccacatttgacttagtggcatagtatgcagctgactaagctggttgtcccgacacgaagatgtttacttaaggctacgtcgcgtttttaggtgataaccttgtctctttgtcctccaaacgtcagaactatgtctcccgctccagttccaaggctgagtagagtgtcatggcaaatgctgtggccaaaatatgccgggtcaccgtgctctactgtgacaatgtcaccgtcgtctatctctccacaaacctagtacaacaccagcggatgaaacatgttgagattgatcttcactttgtttgtgattgggttgctgctggtgcggttcatggtcttcatgttccgacgccatcacagttcactgatatcttcactaaaaggttttcgtggtgctattttcttcgagttccattcaagtctcaacgttcggcctaccgactataaaacaaagggggtgttgtgtatctcgtgtatatggcgcacgactacaaaaaccgtttttgcaaacaggtggattgcattttcgcatgcggttggccggtacacatgcgcgagaaggtctgcaaagatcacgatctttgcatgcggccagtgcaaccgcatgcaaaaatcggattttcgcatgctgatgcttaagccggctgcatgcgaaaatgaaaaatcgcgaaaaaaaaataaaaatccccaaaaaaaaacccctagccctaggcgcccgagctcgccgctgccgctcgccaccacgccggatccatcgcgcccgagctcgccgacgtcgtcgtcgtctcggataggtcgtcgtggccgcacccaagctcgccgccgtcgtcgtcgccgaggttgtcgtcgccgtacctccgccacgctcgagctcgccgtcaccacccgtcgccgtcaatgtcgccaaggtcgtcgtcgccgcgaggaggtcgtcgtcgctgcacccgtgccggatctgccgccctcgagctcgtcgtcgccgaggggagctcgttgtcaccgcgggggagagtgccggtgccggatccgcgtggaaggagggcggctgaccccggatctgctcgggggagggctacagtcccaagatccgatctggccgcctcccgcccccgtgtgccttctttcaagctcaccgccgccgcctttcgagcccgcggcagccgcttttcgagccccacgccgtcggcctttcgagccccgtgggaccgccgccgccaacgcttcatgtacttcctggctctacgccatactgcccagccgagagggaggccgacgccgataccgacgagctccgcacacgtgcgggcgggctcgggcgcagaacccgccgcagaggagggcggacgccgatgcngacaagctccgcgcgcgtgcaagacggctccggcgctgcaaccgcgtgcccgcggcgcgcacgcacgccgccngcggccacgcgggcctcgtcggcctcgccaacgctccgtgtccccccctacctttgggccgcactgccccgccaaagaggaagcccgacgccgacgccgacaagctccgcgcgcgcgccggcggcctccggcgctgcaactgccggaaagggaggccgatgccgacgccgacgagctccgcgcgcgcgccaagcggctccggcgctgcaaccgcgcgcacgcggcgcgcgggcacgccacccgcggctgcgcgggcctcgtccgcctcgccaacgcacacctccgcgccgatgccgccgccctcagccgccgccccgcgtcaccgtccgccgctgccctcgtcgtcctcccgctgcagtgcacaggcgtggtcgtcgtcgttggcggcgatgttggcgctcacgaggcagccgagctccatcttggcgcggggctggagcgccgggtcatgggtgaccagcacagcgtcgccatagctccgtgccgaggccgccgcccccgcgtcagcgtcccccgcctgctgctgtctagagagagagagaggggaagagtggaggaggagtatgacatgcgggtcccacaatttttttaaaaatagaatgctgactggactgccacgtgtacgccacgaaggccaaacccaccacggattggattgagggggggtatttcgtccggtatgcatagttgggggtgaaaaatatccggttttgtggttcgggggggggtaattcggatgaccgcaaaagttcaggggggtaattcgtactttttcctatatgataactcacctcgatttccacaaacaagacccacatcgctatgcagatgaggcgaactttcgccgccaaaaactatttcttactttgtctgagtggaggttgcgatatgcccgtccacggtccgcctgcacaaacacttcttcactagtggagccttaaaccgtcctcctgatgtatgaattatcacaggcggaactaaaacacgaacgggttaagttgtcctcctgtaaaaatttttttatatatagtcttcttccttctcgaaccctgttcagtttaattagccgagatttttctctcccaaaacaaacaaattatagggtggggttttaaactcgaaacttttagtggattttcctaaggcggtcagatccatacattctcacacttgttatgaagtttttttttgctttttttttgtcttatctgtgatggatatcttttagagctctatgtgtgtgtgcatatttgtttttggcttttatgcttttttatattttaattttgtggcaggtgctcgcactcataattctatgcatgggaatcatgtgcctaacctgctttgaacctacacacatacacagagatatgtactgctagtagctcactatctcgttgaatttctgaatatattagtcaacacataatataaaataagcatgtgattagatttatttttgtaagggcaacatgccgttaaaaaagtgttgctaaaacaatcatatatatgtatgcttagataatcatgtattatcacagaagaatatgagctgggcaacctctgtaacatgttacagtatggtgtttgtgaattttcggccaaattctgaaagttttcgtctcaaggatattttcatcattagaacaaaattgtatgttactaatagaggctaactgaacagcgatggtaaatcgtagaagttaaacaaaaggcaatgacatattatggaactgaaaacagtcagtggcagattatggatctaggccatagacaatggtacacgatagattttctctaattagatcatgccattacaaatatacagtattaaaaaaataccactactaatcataaatcggctgccattagcattttctaaaatttgaaccatgcaaccatgtacacatcaggcacccgtgtactcgttttttacatacggcattttcgtatgaaccattttgcccttctctcccaagttccagccttccccctctcccccaccgccggcaagtacatcctcgaatcagatcggtcacccctgccttccgccgttgcagtggggactgggacaagacatggatccaattacatttagagaaaaataaacattaaaaccttcactaggtatatctaactggccttgatagacaggagttagagatgccaaaaggtaatcttcaattttttatatagaatacagttaacaatatttattctaaaaccagagattattacctctgttttaaaatgtttggagttgtttgcatttaaagccccccttgattcaaaagaaattcgtaagaattttacaggatttcatttctatagaaatttttacactttgaatcaaagaaatgaatcctatggaaatcctatgaaatacatatggaatgcctaatacaatgcaagtttggaggagttataacatgaggttctacctcatgaaaacttttctttgagtctttatctcttctctaattcctgtgtttttcctacggtctaatcaaacggccattcctgtattttgtaattatctgttttacatttatattcatatcaaaatcctgtgtttttcctattcttatattttctcaatcctgcaattcaaatgaccctaaatattacgatggatcattagtgttctttgaaaaacaacgtaaatatcgtttctcagcttgttgtgacttgtatcagtacgatttatatttttctatctgcactgattttttttaataagatacagtatatagttaatagggcgtttgtatttaatacagagtgtgtactatagtgaaagaaataaatacgataatacatgcatcctagtcacacgggttaaaataaaggacccaaaaaacgtgtaacacctgcaacatgtgtttgtttcttttcaatatatttgttttgtatctatggtgtgcattactgttgacgattggtcattgcaaatcttattacagcttactttaaatgacaacgtagttggtaggacagtatctcttaaatctttgacaaaatattcctaacgggggacactatcgcgaactgttagagattatacatacgcatgactggtttaggagtgtggttgtctgggaggcgaggcttcgttcgtttcacggtgagtttagaatatttacggtgcacgtgaaacgagcgtagctcaactaggtagttttaatttcttgtgatggaaccagctcaactagattcaaatcataaatttaacatggcgctcggtaggcgacatgcccgtagttactttgccaatcaggagatatgttagcccaatcttccggagatgttaattgggtagagtgtttgtgtgttcatagatttgaatacacacgtgttgtgagcgtctgcgtttatactgtgtttctaaaagaactaattagtatataattaattaaatattactaattacaaacttaatttttttaaaaaaaatcaaaaattattgtagactatgatcattttctacacctccatcaacatgactgaggtgcccgccattctcgttttcaatatccactgtaacataaaaccatttaccaaccgaatactttaataagactaataattaattgttatatatattcaaaagttaataatgttatgtgtttgaaaacacagggtgtattatagagaaaaaatggccaaatacgatgctgcatcatcatagcaaactcgcacgagcaaaaaatgaaaaccccgaacgaacgtgttgcacctggcaggcgtgttggtttcttttcaatattttttttatctacggagtgctttatcattgatggttggtcattacgaatcacagattactttaatcactagttgatactccctccatttaatcactagtttttttaattttattttagtcaaactttttaaaagtttgaacaaacttatagaagaatatggtaacacttataacaccaaattcacactactgcaaaatatcaaataagtgtcggcactataggtgccagaagtgctaaaaccagcacctataggctttttcccacctccgcgggttgaaatcgtaaaaaaccgacaccttgaagtaattataggtgtcggttataaataaaaaccaggtacattgtgtcggttttttaaaaaaaaacctaaacctttaataaaaaatggcacctataattaccgtatttttttaaaaaaatggcacttatgaattgagccaagccggagggccccaccacgacgcatcgaggagataaggtccgctcgctcgttcgaactctcttgtctcctctcgatctctcttgttctctcccctctctatctcgctcgtggcggctgaagaagcagcgtcgacggcgtcagtggcgcgcgccggaaaaaccgcgcccgcccgaaggcgttctccctccgccagatcaggcgggagaaagggcggcgacggcggcaacggcccggcaggtatgggaggaacgtcgggcgccctctcctccgccagatccggcaggaggggaggcacggtggtggcggacggcgtggaggcgggagggaggcaacaacgacgtattgcagcaggaggggaggcaacagcgacgtattgcagcaggaggggaggcggcaggcggtgacgcccatggagcggcggtgggcggcgcctcccctcagccatatccaatgactgccctccatggttacccaacggtgagtcttcaatttctttccgtgatttgggtggagatgaattgatgttgaatttatgtgatgcttctgtgatttgtgtggggatgaatcaatgttgaattatttctgtgatttgtgtgcggatgaatcgatgtgatggttctgtgatttgtgtggggatgaatcgatgttgaatttctatgatggtaagatgttgatattgatgaattgttgtatgtgggatggggagctggctcgtgcatcgagccggtttttttgcttttgtgcctctcaaaggtgccagttgtgacctagggtcatcagtgccgcctctgagatgctggttgggaaaaccggcacccaagggtttttcaatcagcacatttatacctttatgtagtagtgttgttttattaaaactgaatatattttgatagttttgttttatgttaaaactattactattattacgaggtcctcaantggcatcgggcg

SEQ ID NO: 78516 - DNA, 4187 bp, Oryza sativa
gctccaccccctcccggcgctggatccgccgcgtgcacccgaccaccgcttcgagccgctgctaccgctctctttgcagcgatcctctctgcagcgaagggataaagaagtatgaggtgaggagtgaagggataaggatagggtggggagatatattttttttatagctcgagtaattttttcgctggggctacgtggtgaaaccttttcagaagcggttgcatgagtggaccgcttgtaaaaaagacgaacgcaagtgaagatctgccatttttgctagcggtgtattaagtgtgccgccaacaaaaaccataatatctttgatggcggccctcttaaatcaaccgctaacgaagatcagtttttgctggcggttcgaaacttcctaccccttgttatattttctgttgtggttttcataaatattcgccataaaaaatgatagggtgacgctgtgaaaaattatttttttaagtaatgtgggttgaagtttctagaattaccaaatattcttttaataattgataaaattaccgaatgttagtagggattggtaatgttgcgaagataaagtttgtttagctcgttaccctatccaacttaatgttgttggtgattttgtcaacagaactattctgagctggagggagtgagacggagaataaaaaaccaagctagaatctgaccgaggatttaaactgttattattttttttaaaaaaaaactatagccgatgttcttcaaaattttcgatccagaccttggcacgaccataccgcagtccaccccccaacttgctcattttgacgaagggctcggagacacgatcgacggcgacccagcatcgatcgatttcgccgccaccgccgcctggcgcgacactgcagtaactgtgggcggccgccggcggcgcgagcacatgaaagccggcccgtgccgtgcgacgtgcgttgcgggcgtgatccgcacgcgacgcgggccgtgacagcgcccagtgggcccccctggtcggcgaccttttcttcctggtctggcgccgtgggcgggtgaaagctgatcttgggctttggctgacttctcgtccagtagccacttttttgggcctaacgcggcctgaagaacactttcaaactggacggattcaaaggagcacgagcacgagaactcacgtttgtgtatttttgttgttggcaataatgtgaaggaataagttcactctaggtccctctatttgtcacctagtccgattttcgtcacttggtcgcaaaaccggttacaacgcatccctcaacttacaaaaccgtgcaaaaaaggtccctcgacagtattgtgcctggttttggatgacgtggcgcctacgtggctccctttaactaggttctcgtcccacgtgacattgacgtggcaattggatcccggggaaatataaaaaaccgtgggacccacatgtcagctacacaaaaatatttttaaaaaggagggacccacgtggtctcacatgtcagcctccctcttctctctatcccctctctctctctccctacaaggcaggagaagtgcgagcggcagcgagcggtgggcatagcgatggcggcggcgggcggagggtagactagaggggcggcgggtggaagcagagcggcgacgggcggtgggctgagcaacaacgggcggcgggcggcgtggcgagagcgctgcgagggaggaggcaagctcgtcggggcggctggcgggagaggaggcaacgcgtgccgtccgacaggagggagggagaggagcatcggtgcgtgggggacgccggtcgacgggagggcggaagagtagcggcggctcgccggcctctccgcgctggtcggcatccccgtctcctccctttgcaatccagtgtagagctcgatggcggggcgccgtgggtgcggctcaacggtcacgggcagaggaagagttgcaccgggcggcggccagcgacagtctccgcccccttgccggtgatgcgtcgcgtcggccagccgcgccacgcacgcgccttcacccctctgctatggtgtcattctctcaccactgtcgcgctttgcttcggccgtcgccgctctgactggtgccaatcctccgccacagtccccaatccaccacgataccaccagtctgcttcgggaccgctgttgcctccgccttcgccaccggtaggcggcaacggaagcccggacgtcgagggcgtggcgctggccgacttcttcttcggccccaagttggatgacttgatgcagtggctaggagatggtgacgccgggcagaagggcacgctgccagcctcctcgtcatcgtcatcctacgcgcagcggggcggggcggagcgggcgggcggacggcggccctagaagaacggaacggagcggggcaccggtgggcggaaaggggagatgggaagaggggagaaagaagaggtagcggtgagaatgacatgtggggcccacgtgggccccaccatttttattaatttgtgtgtgaaactaacatgtgggtcccacatgatttaatatttttccgggatccaattgacacataagcgtcacgtcaatgccacgtgggatgatgacctagtcaaaggagccatgtaggcgccacgtcggtcaaaaccgccctccatactaccgagggaccttgtttgtctggttttcgtaaattgggggattggtagtatctggttttgcgatcaagggacgaaaattggattgggcgacaaatagaggaaactaaagtgaccttattcctaatgtgaaatgtctgactgttttctgaatcacagctcgaataaaggtgtaaacgatgatgcgattgctgaatgtacacggttgtttcttttcgtattttggatgctcatcctgacgccgttcgtctgtctgtgtccccctgctttcgctctgttttctctccctgacatcgtgttatctatcataccatttggtgacaaagcccaatgtatgctcagtccatcaatactaaagtttctaaaaaaaaagaggaaagtgtgcggtggaaacttccatgcgttaaatagtaatccccgataaaatcaatacaaatacaaaatattaattactgaactacttaagtacacccttcgcgttaaaatataaaaagttttggttacatgagatacatcaaaatataaaaaatattaattgctgaactacgaatctggacatgatatattctatccaaccaaaacatgtcaagatttgtatagtactagattgtgtctcatccaatcaaaactcatttttcggatggagggagtatatggttaacggaattactaatctcccgtcgacaaaaaaatgcattaccaaattttgcagattttggatcattagagtgcttcacggttcatgttccaagtgcttcttctccaactccaacaaccggcgacaacccaaactccgacagagggctggcaaattaagatcccagtgtgaggaggaggaggggtaagaaaagggagtcgtcgggcttagaggaatggtcatgggagttggcagcctggcggtgggcggcgggacaggtggacagtgccaaagctatggggatggaggagggcggtgagctgacgttggtggcaggagcatcctgctgtcgacggctcgaggagaaatgagagaggggggcgggggagggaaaggaggccggtggggagaggtgtctcactggtgctgatgacgtcttccggcgagaggccgagcggtggcacggttgggcggtagcggcgatgtaggaggggttaggttcactgcacgaattttaaagtgatataatggttcaaaattcacaagattttaagagatgtttttttagtatataccgtcccattaattaaaggaaaaagtacgaattacccccctgaactatcgaggtcgaccgaattacacccccaaacttgaaaaccagacattctacaccctcaactattgaaactggataaataacccccctgactcaatccggagtggttttgagtctacgtggcagtccagtcagcaatttttttttaaaaaaatcaatgggccccacctgtcagttcccctcccctctctacccctcactactctatcccaatctctcctctctctcctcaccagcacggtggcgaccgctcgagggcgggatcaggcggcgctgccggcggcgga

SEQ ID NO: 78517 - DNA, 13949 bp, Oryza sativa
tttggagactggcttccgaaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgacccccttaagagagatcgacgcccccgtcgatcaaccctaggccaagaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgatcactcgtgtgcacccgggaagaatttcccggtcggtcacccatcccaaattgctccaggccagactggcttccggaaaagaagttgcaacttgttgatatgagtattctattaatcctattaagccctaggccgggatgttacaacatcctataacagaaatagtaacatgcacatgcataataacaatgcaaaaactatacagtgttggaccttctttagcaagaagccaacaaaaacatttcaaagcaatttggcttcatagcatttgatggttatcttctctgatccccgtacgggattcggtccatatattcggggatttctagctgtgaacaaacaaccaaataccgcattatatcaattagttagacttttatatgcaaaatagaattattagtcgatcatgaagacaaaatcaaataattttaagaattaaccctacaccttaattagtgatgctacttaaaaagtcttttttcggacattaggcttttatcttcacatagacgatccaaaagaaaaaatacttgtggaaatggttgaggttgtcttagggtcataaccgcctgttaaaaaaactatttttacgggttggtctgaaattcccctttaaaaatatgtatactttttgggcagatcccaaagaaatccacctataaaatctattttcgtggaccatgcattctgtacaagacgttaaaactagaagccccactaaaatacgaaaaaaattataactttttcatgtgaagtcggatgatgacaaacttaatatgaaaattgtaggtcttgatgaaacctataactttgcagtttaaagttgtttcattttaggttgtttagtgtggcaaattttttgttactattctcgtaactactttttagttttccaaacaacgctggatggagaaatgttctatattgaaattatcgagctcggccagatctacaactttgttattaaaagctattataaatgagatcgttcaggtggctaatattcattacaggctttgatatatctattattacggggaattgttcagaaagttcaaagtttgaaaaattctagaaaattcatatttggcccaatcgaggtaaaccaaaagttttatagattgttatctttatttattattttctttgatatgagctacttaatatttcttttagtatgcccattcattatgcaatatatcaacatatagagactacaggacataagtgaacaatcatatcaaaagaagtattttaaggaaacatcgacccagaatgttgtaaggttgagaacttctgttcaccttaatcggacataaaatgaattttctaaaaaagtaaagtttagtcattatcaaagaataaagaaaaaagggttttgtcagcagacttcttaacgaaacaccctaaaatgatttttacaggcagacattttaaagagtcgcccttaaaatattttttatggtcggttcacataagggaaagccagtaaaattttgcgtctatagatgcctacaaaaatctaaaatattttttttggggggttcttttttacagttaaaaaaaatcaaaagcatgatattcatttttacatgtgattccttaagagagttgccagtgaaaatcaattttcacgggtggttgtggaatgcgtccataaaaatcatgtgatttttacatgccattagttataggccgattgaaaaacacccatgtaatgaattacggaccacatgcaaaatatttgggtcgtttggttcttaactaacattgccataactcactttaggcaatgttagacaagtgtggctttgccacatttttttgtggcctacaaattgtaagccacacttgtggcaaagttagacaaatgattgagtctatgacatgtggggtaagatgataagaaagtgtggcttgccataactatggcaatgaatcaaacataaggctaaggaggtgtggcatcctaaagtgtgatgtggcaagttgaagcattgaaccaaacagcccatactatctctatccaaaaatataagaacctatgatcggataagacatatcataatattacgaatatgaacaagctttctatttgtgctaagatgtctgaagcattgaaccaaacagcccatactatctcaatccaaaaatataagaacctatgatcggataagacatatcataatattacgaatatgaacaagctttttatttgtgctaagatgtctcatgtgatattatattattatattttggaagagagagtgagtattttcataccagtgtacgacaaagctaggatcgactccattggctccattttcaaattaagctttacaaagaagcagcaatattgctgtattttgcagcctatatgtatcaacttgcactttctttcgctgtcctgactttgttgtctttatggtttaccttttggactcatctgttacgaacatggaggccagctcgaagtgcatgcatatggaatgccagtccggtcctaatacttgcacagttgaccccgagcgcgtggttgccacgtgcacgcactcttgcacagcagtgtgtgccttctatttgacgctattttattttttttatttttagcccaagataatgacatgtcacggcagagtaaaaaagtgcagtgtgtagactcttctggaatgcctcgtacggatcagtttacacgcatcttataaatttcgtttagtcatcgctgatgacatatttgagtactacttatcccatgcggttatgcatgtacgagatccgtgtatacgaatacacgtattgccagtgcatatatgatcatacatgtgcatgtgccactgcccactgccatacgagactttggatcctccaagtgcatgcatgcaggcaggctccaattcgtgctgcaacttcaacaaaataaattgattcgcctcgcctagctgatgttacaaaatggcggacgtatccaaaacgaataatacttggatgaaacaactgaagctcaaaagagtcaggggaaaattaatgactacaagtttgttattgatctgttcgacttcatcgaaaaatcccagcctcggctcgcgccagaaatatgtttccaacacacagcaacgaacatagccttagtacagcacaaactagccacttctatcaacgacaaactggcctactagaaacagcgcgggaaagttaaaaagctcaagctcgggttagatagcactgctttcttcaaagcgcatgcctacaacaacttcggacgaacctccatcaaatcgatcaaggcggcaggcaccgaagtttctgaccacaacagcaaggcacaagtcatgttcaactattactcgctcatcctaggatctgctgaatccctgcaatggtctcactacttaaaaaaaaaacgtataagtcgacactatacctttaaacgaagataggtgtcgattttagagaaaaatcaacatcaataataataatataggtgccagttttttttaaaaaaatccggcacctataatgtgcccgtttttttaaaaaaggcacacatgaacacacattccatcaagaacacacatgaacaaacattccatcaagaacacacatgaacaaacatcaagaacacatatgaacataagaacacaacttgaacatatgcctcttccaccgtcccggccgccgtcgcccggcaacctctgccgcctccacgccatccgtcccctaccgtggatctagcggagggaaggacgtcgtggagacggctgcggcccggcgggggtgggagggtcggcgcctcccccccccccccctccgccagatccggcgggaggggacgtgcagtggcgacggcagaagaggcatatgttcatgttgtgtttttatgttcatatgtgttcttgatggaatgtgtgttcttgatggaatcagttatcggctcaactgcagtcgagccgaccttttttttttcaatcgtggaacctcaaaggtgccggttcctaaaccggcacctttgattcaccatatcagtgccgcctccggggtgtcgattgggaaatccggcacctttggaagtttcacaaccggcacttaagggcttttctgtagtagtgtcttttcagcttggaatgctctacgacacagttcagccttcagccttgagcagtctgatgggcggcttctccaaggaagaaacactctttgcaatcaggcagatggacagaaacaacgcccctggaccttatggcttcgggccaagtttttaccaagcaacgtggcatctcctcagcacagaagtgatgaatctccttgaaagattctcgctacaacatgtctatcttgaaaggataaatcggccatacattgttctgattctgaaacctggaaaagagaatacaccagatggtttcaggccgatctctctacaaaactgctcgatgaaaatcattacaaaagtgttggcaaacagacttcatcgtattctgcaagagctaatccatttcgatcagagaggttttctcaaaggaagaagtatcactaagaatttcatatttgcgactgaactgatgcaaacctgcttcgtcagaaaatgcccaaccctaatcctcaagctggattttgccaaggcattcaattccatcagctgggatagccgcctccagatcctcaccgccaggggcttcaacaccacttggaatacatggattcagaatattctttcaacctctaagtcagtaatccttctcaacggagtctcgggacgctggattaactgcaagcatggtcttcgccaaggagatcctctatcgccacacctgttcattcttgtagctgatgttctccaaagactcctccttcacaatgagaatctcacacccgatgtgcccagacagcccctttaatcatatgcaatgcttgggtcacaggtgccagatcaatgaaattctcaactgcaagaaggaaagcttccctttgtcgtacctagctaggactacctctgtctctccccataagctgcgagctcaggacctcaatccaacaattgctaaagtgtacaagtacctagctggatgggaggcaagcctgctctcatatgccgagcacatagtccttatcaacttagtcctgaacaatatcccagtctttgctatgttttcctctaagctcccaggttgcaaaacgacacactgctaatcaagatgttgttccatccacatagctcaaattcgtcgtggtctatgtggctctagtaggaagctgaggacaaatcgttggcggatgacttgaaccttggacccctctggcgctccctccaatctctcatcccgacggttcaagacctttcaagcgtccaggtgggggatggattccgcacgtccttctagtgtgactcatggctctgcaatcaacctctcaagcttcgcctcgctacccttttctctcatgcagtggatcagctagccactatcaggactgttctttgcagaggactagccacctgtcttgttcctcgcttgtccttagtagcccagtatgatttagctctacttaaagtggaattgtagcaggtcattcttcaaggctgccctaacaaaaggaaaagtaaaggaactccccatcttgaaatcatcctggccaaacaaaactatgactccaggataatgctgcactaaatctgtccaaactggagcttcgtctggaacaacagagcgccactaaaggtgcaattcttcgcctagcttctggcaaaagagcgactccctacaaagcataatctcatcaaaaagggaattgtttcagttgatacatgtgatatctgtgccaatgcctcggagaataccaggcacttcaacctgcactgccctcgggtcaggacaataatcagcgtgaatatgatgggtcaggacgtcaaaaacctggcgaacattaagccctctgggggattaccggcgctccattttcaagttttcttcatgttatatttttggacgctctggaaccatagacatgatgttgtctttcgaaatgcagccccctaacttcagttggttttgcttaagtgtgttgaagagtgtgggatatggctagaacgaattaagcgcaacgatcgctttgtaattgcgatttggaagaacattttctcctcttccctccaacctctaaatgttgtgtagaactgcctttgtaacatcaataaaattcaggtggggaatccccccggcccccgcgtgacttgtctaaaaaaaattagtacagaacaacaccgtataaaacgacaaattatcttctatttttgaaatagatcgagttaattttcttttggagaaaggctaatcaattataatgtgagttaaaaagtttttctctcagtttcacaacttgcgtcgagattgttgcaccacttgcgctccgtgtcagttcctgtctatctcatattgatctgtagctagttttcgtagtttcgttggaataaattttttagatgtttaggacatcgcaatgttgtaaaaaaaagtaacattaaagtctctaaggtgaacaatatagctattgtgacattgaagctaagtcataacaaaaaaaaataatcataagtttgcgattggtcgctagcgaataaaaagatcagagaatctctcttctccctctgctccattctctctccacctaataaaaggcttatttggatagtttttatttatttatgaatgagttacatatattatttatcgagaacttaatttcgtgctaaggtaacaactacgatcaactgacaataggacctattttaatgctatatgttgcgtaacaaatattagccttgcccttagatctatttagatatatggttttggccggttgtactccccgtgatgtttatggtggtattagaattgtttagaggttaaagtactctatgtacatctttatgaacaacggatgtgtttgcaaggtttttaacaaaagatttaaaaatttgtctcctaatttttgatcattcaatttatcggtggcactagctatatggtgaggatcattgactttcctatgtgctctgttggtttgctataagaatgaagttgttggccaaataagataatcaccgtaagaactaagatagccagataggagctattgtaagttgtaaccaaggcctcttatactaagtagagtaagagtatataatacttcctccgtcccaaaatataagcatttttagacttcaacacagtcttcgaggtgctactttgaccaataatatctataaaagtaagatgttttaaataaaaggagttgcatattatgatagtttgtttaatgataaatctagtaacatctaatttacattattgatcttttttttctattaatactcaaaattaaaaatgtttgacttgacactattctaaaaatgcttatattttgggacagaggaagtaatacttttcacagcgctcgtgttacatgaaaaaaatatgcatgatagaacatcatagctcttttttttttttgaatgtgttgaagtatatatgggactgtgtacaaaatactcgaatgttttagctaggtcaacgatcatattttctaggtataagatatatagatcaaacagttaagatatctcccttccggtcttctccttcatcctactttgctgtatcccatgccacctcctacctctctagtgacatctttggcgctaatgaggcccaacaattaaaccgtgctaccactcccaacggttaggccccttccaagccaccatcacttctctcccctatccttagctcgtgtccgttgtccatgtcacccactacaccaaagcatatgaatgcactttgtttagggcatcagcaatatgctcacaaaccgatagtaagcaataaatacatccttactaccgggtagtaaacattgtgagactagtacgtaattgcaaccgggtcatatccctactgccggaagcaaggaaatagaatatgcatgtgcacagtattttctgacagcaaaagcattgcttctcccaaccgttgcatgcatgcttcgtccttgctgcgatttttttaccccatggactccaccttactgccaactcacagaaataagcaatgtgaagcacgcctctctttattaccgcctgttatctaggcccacgctaatacccatgtagatagtatacattgctgatgcccaggtagaggcgttttaagacatgccgtacatgcatgtacctctcctctactcttgcagttgcagctgatcctgtcaagctccaccaccaaaccactttgtcctgtaagctcatctttcccacggttttcactgcccccactgccgtccctacatgtatacacaataaatcagtatgtcttttgatcataatatccaacatgtactgttattaattaacaatatgctactgtaggatgtagccgcaaaccgtgccatccttctcttattatatggatggaggtcttgagcatgaacagtgagacgtacaagagaccaattcggatagctacacacaaagacgtcgtcgatcgtacaacttttctccatagtttttaaagctacacacccttagaatcatcagtctctttcttgagcaacagcacacacgccagaaatgccagctgcccggccgacattggagtagagaggagtagagagcaccaagtcgtcttcttccccccggcaatgcaagacgacgtcacgacgaccctgctgggaaactagtgctccatatacaaatgtccagaaagaatcagttcggtcggtcagatccacctgatcgatcgagtagctctgaaaaagcgagaattttatcgttaaattattccaaaggcgcgtggcggacacgcacgggacatggatctcgggcctcggctggggggatgaactaattgtgggtgatcaaacagttgtagcgatgaaataatttagctgcaagtggaggtcagccaggctggttttcatctgccattctgcgttcacgcgggcgacggcaatgcaactgccgatgtcattgctcacattagcaccggctctttttttctaaagcttaattggttctctgaatttctgagaccacacggcattcgattattcgatcgatacatcgcttactatgggcgatcgagttcatgctactactgtcctgctactctctccattttaatttgtaacctaagattgaatgaaacttaacctattatactacgaatgtaatataaacataggatatgttcatattcatagtagtacatattgagtatcatctgaacttatgatactatattatgagatggggttaataatatatatactatctccgtctcaaaatataccaacataggtatagatgaaatacatcttaacactacgaatctgatatatgggctatctaaatttatattattaggatgtgtctcatccaatagtaagaggttttagcagattataggagtataggtcttttgaaaaagttgatgtgtgctttgatttgattatttaccacaccttctgaaagcaaatttaccacttgcaagaggcctgactagcatgtctgtcaatggcaggaaaattgatgtgggtaagtgcgactaaccagctgtaatcacgaacatcgatcacgactagataatgaacgtcgacaaggaactttttccaaggcgagtgatgcatatgtatgacatgtacgtccattcagaagcgtgtgctgtgagagttttctgcagctcgatctacgatcgatatgatcgaatccagagtagtatccaacaggcagtgccaatactgtacgcaagaccaaattaaaacgtactcatatccaacagcagtagtgtactatctctcgctgcaaaccatgacttctttctaatctttccagttgcaagccgatctactgataatataactaacatattgcatacgtacgtgaaataacgttatccatgcttagcttaattcaaagtttatttttatatatcaagcaggtgctcattgacattggtgagaaggacgtagaagtaacggcgacacaacaaaattagtactatacgttaatcttgctccgatcctctgccaccccttcatttctatacccaacattactttcactagctaagcatctattatttttcatatatatctgcaggcagcaagcgtacgtataatcacagcttaatcagccgacatgaaagtatttaatcatacagtaccacattaattaatctcccgcgaggaaacatctatcctggtcaaagcatgagtaaatacttaattaattaaactagctcctcttaatccatctacataaaaattcgtgcaaaagcatacacggcatgtactgttcgtccgtacgctgccgtctcatttcgctttcgtagaacttgctctaggaaaacaactatgctagctataaatacgtacaccaccatactcttcgtctccactccaagcaagctagaaaaaaaaccaagtgaaaacctcaaagcagctaggcacgcgtcaacgcatcatctccttcgatcgtctccttgtagtggctatagtgtgctcgatctgagctagctttgatctctttgccatgggaaactgcaactgcttggagagggcgagggcgaaggtgacggcgtggggcgcggaagagggcgacggcggcgaggacgagttctggggcgccacggcggcggagttctccggcggcggcggcggcggggcgcgaggtggtgtaccgtcgacgaggaagaaagagatcatcaaggacggcggcggcggcgagggttcttcttcgccgacgaggcgcgtgaagatccggatgaccaaggggcagctgcggcggctgctggccggcgccgggaggggggcggccgtcgaggacgtcgtcgcggagatcatgagcatgggcgacgtgcacgtcgagcccgtcaaggcggaggagggcggaggcggccgccgcccgccgccgtcgccgtccaagctggagccgatacaggaagacatggacgagtagcaggagcagccatgggaggaggatatgatggagatgagcgtgagatcgtcagatggatcgatcatctggagatggacggtggatgttgcttcaccgattttgcatgcatgctggttggccctgtttgttttggatcttgtttgtatcttttctttgctctagttaagttttgtaggacgtacgtatcatgccatattagaggtagaaattaggaggggatatgtatatagtaatagatgtgtacgcgtgcacatgtacatttttgtactggtatgtgtgatgatatatactacctccgtttcaggttataaaacgttttgactttggttaaagtcaaattgtttcaactttgactaagtttatagaaaaaacaataacattttcaacccaaaacaatatatttaattattgattaaatgaaactaatttgatattataaatattactatattcgtctataaacttagttaaacttaaagtagtttaaatttgaccaaagtcaaaatgtcttataacctgaaacgaacggaatagcatattctttctgtgttttttatatgggaaatatctagtgataacttcaaataggtgaaataccctgtgaaagccatgtctaaaaagttatctcaattttcacaaaaaaaattactaaatatagatataggttgataggcatgaaatatattcatgtaacaaggtaataaaatagcgtatagcgggttaatagcagattatattagtgtctgggtagcagatataagctccaataacggaattaatgaagcaaccttaaatttagattggactatatcaatactaactttaagtttcacttaaaatttataaatttagattacacacttaattactcatacattacatagcataaaaaaatatgaataaacctatagagggacaagataaagaagatacacaacgttaaattttcctatccatatatacgaggaaaacatcgttacatgttggattattgccaatcacaatcctaaataggggtttgtttgtaaaatttcatttcgctactggttacaatgcaaaactaagggtctttttgcaaacctttggatcgctaccaataattgtgatacaaattatgggaaatacgtagtgtaaactccctatgtagtgtaaatatgtaatagtactcgatagtgtaaacttgtacaggtttgcaccatatatgaagtttgcattatatattttccttacaaaaaataacctgtttttttaaggaaggaattgagtttctgtcgtttaatattggtaggagataaaaaaaaaggtttacagttttacatatctgttacatgcagtgcaaagaaaacaataaaacatttttcgccaaagccatagacaaaagttgtgttcgaactagtagtttctatgtgctaggccgagagcgtcgaattcttgcataattgcaaaaacaacctgctcttcgctttggcttgtatcttgaaaagttattctattcctctccagcgagatgagccactcctttctcatgttgtctggcttgactcttgagtttggtcagctaaatcactagctattttccctacaaaacagggcgcattttgtaaaggattgagtaaggctgcgttcggcaactgaagaaagtgagtgagtttgtttcgattttcgcgtgcacgcttcccaaactactcaatggtgtattttttaaaaaattttctatagcaaagttgctttaaaaattcatattaatctatttttcaaatttaaaatagttaatactcaattaatcatgcgctaatagctcacctcgttttgcgtatcttcccaatcttctcaatctcctcctcctcaaactacaccgaatctaatttttatccttgaaccccaaaaccaaatacaaccggtcgtccctgaattgtcaaaaccggtgcaaacgagatccctcgtcggtttgaaaggcggttttggctgacgtggcgcctacgtggctggtttgactaggtcttcgtcccacgtggcactgatatggcgctcacgtggtaattctatccccgaaaaataataaaaactatgggcccatatatcagttacacaaaacaataatttaaaaatggtggggcccacgtgggccccacatgtcagcctcactcatcccttcatccctcttccttctctctcttcttcctcatcctcactcctctcttctgccctctcccctctttttctctctcttcttcccggggaacgccggagcagacgggcgggtgggaggcggagcaggcgagcgaggcgggctgtccgagctccggcggcgatggtactgagtggaccgcgacaaggatccccaagacgatggacaacgacgccggcgacgggagcctcaaccgagggagaggaggcgccgcgatggccagagccggggtggtcggcgcaagagtcggagcgcttgaccgcgggctccgatgacgaggacgaccactctggtgccattgccaccgcccgcgccaagaaggcgccgccctccatcaccatcatgctcgagaaggagatatggagttcgacggcggcggcggcagcggcgg

SEQ ID NO: 78518 - DNA, 2938 bp, Oryza sativa
tgcgataatgacggccgcatagatgaactagcgctacgtccacaccacgaaagaagaaaaaaaacgaaaaaaagggcgagcagcaacagatggccaatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaacacaaattttttcataggccgggatcctttccacaccgggttggtccacgggggttgggtcatgaccccggccgttccgggtctaatcgaacatagccttatggaattagaaggcttataggtgttggcaaaactaaactaaggtcagggctatggcctaagcttatggcaaggtaaaaaaaaattcaaaacaatttattattttttgttttatcatgtgttcatttatatatcttcttccatttattccctttattgaaatatttgttgtggttttgaattcatatggtcttttatgttttttatcctattatgatgaatcttgatatagattggtgttcacaaacattttgggaaaaaaattgttactgataaggttttattagtgtttcacttatatgggtgtagtacaacttatagcaattatccgaagtgtcaatgaacctctattttaaaagataggttcaatgtgggctttcattttgctataaaccttgttttagattgtgtgggtgtgttatttataaatgcattcctgattttacccgttgtcatggagtttgatcattcgttctgattgttgtcatggatactgattacgatcaaatattgaatattgccttgtttattttatttcttgtacaatgtgaggcatgtgttgatattaatcacttacaatttattagtatatgcacttttagcttccttagggccaaaggtcaaacagaacattcacttataatttattttggcacaacatttatatccttaacacatttcaaattttaagtttcatgtcttagggttaaaagatatgaatcatcacattttagagttacgagcactagttaaaacatagataaacacaatttttagtgtggttaataattacctaatttggtatattttgcatactgtgcataaaataaacttttgaccaattttattcctgtttcaacagatagatcagcttgaattcacaaaattttagaaacaagtttcactcaatttggagttgatttgaattagttataaattttcttaggttaattcacttttttcttcattgaaataattataagtgtattacgcctattttttattcattttcccgaattagttttctaaaggaaaagtccccttacactgacaggtgggtcccagtcattttattaaagaaaatattatttttagtagaaaatgttgaaccatggtgacggtgaaactttaccatcaaatggcaatgggtccatgtgccaggaacgagagtttctttaccaaggatctggtcctagatgtcaatgtcccaaattttcattaggacatgagcatttgcatgagatattgatcaaaacatttcctggtgagctccttatatcatacgctcttttcttgggaaacttttattgcatagcgtaccggatgagactcctctaactttatgcagttggggctcacatgtcagtggcataactatatatttacatatatttacattgtaggaagtcagcgatccgtttccaacagcacctaagctgagagccatccgatgagcttttctattcgtgttgtacttcatgcattttgtttggcgcacggatccgatgaggcgacgaggcaacggcacatcgacgcgatggtgcgcaagcacaagtgcgactggttcggcctacctcgaagcagcaacgtgctggcgcaggtctgcatcatatgctacgtgaacgcgatgcaaggaaggagcaagtaagagagagcggtggtcctgcgcggcttgggttagggcacgacgggcggtacccctcaagcactgcagcagggtgcgaccggccggcccgggtcatcgacagaaagctcaacagagcagggtgtggtggcggagcttgccgagttgccggcacggtgagcacggctgccattgctgttaggaaacgatggagaaataaacgataaaaaacaatagatcaatcacagaagacacgagattttaacgtggaaaaccctcctaaaacaggagagaaaaaaccacgggcgctagccagcaaaatatcttcactatatctagggtgaggttacatcgccgtacggcggcttacaagaggtatatatatatggtggaacctaaaagggatgacgatccgtcttcagcctccactacgctccggcccaagccttccggagacgggcctccgctccattacagaaagtgcaaatgaatttgaatcacaagtcaacaattgcgaggcggcctattgactggaagccatgcgggcctaccggagctgtcttggttcgcttggtggcctgccggctctagtgggctgtttggcctattggctggggcattcttgtcaagccccactgctccggtaggcagccctggtaggaccaagggagggaaagaatggatgggtttgttgacataaaaagaaataagttcacttgtgcttcctcatcttaacatcgagatttttttcttttaccaataaaaaccaaaaatatatacacttaaactcaaccaaatagtcttatgattggtgtcaatgctactagagaaggtcttggagattagatactcgcatatcaccgtcaattcaatgacg

SEQ ID NO: 78519 - DNA, 3458 bp, Oryza sativa
  unsure (1)..(3458): unsure at all n locations
ccgcgcaattgaanctcttctnaatncactacaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccattggatgggtttgttgacataaaaaggaataagttcacctgtgcttcctcatcttaacatcgagatttttttctcttaacaataaaaaccagaaatatatacacctaaactcaaacaaatagtcctatgatagtatggggcccacatatcttatttctaccagcaaaaccacccatatatactgcttaggatcttgattgcacgatttgtttgagtttagggatactcatttctggttttatggttaggggacctcaaaaatctcgctgttaagttgagggaccttcggtgaacttattcctcatagaaaaagctatgaggttggacctttaaaattgatttctcgatttagggaaatattttacctcgatagtgatgagcacgggttccgatcttgtaaagataactgttgatttagcaaaaacatgatacacattacctcacttcagatcaatattatctgaaccctgcaatcgtagaaccatgtcccctttggttatcatttatctcgccgagaagactaatttctacatgtgaatcgaataatacaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctattttaaagataaaatattgttgggctgggcataattcttttattttattatataaaactaaagttacatgtggtgtttgaatctcctgaagatgaagatgaagttttttacgcaaaacgaggtggtaataacgtgtgattaattgagttttaattattataaacttggaaaatgtattaatctgatattttagaacaactttcatataaaaaggtttcgcatgaaacacaccgtttagcggtttgaaatacgtgccatgaaaatctttatctccatccaacttttgttggactaacgaacagggatatttacattgcacaggacgcaaggttcaaggaaagatgtaactaattgtccacagtgttttgtaaattgttcttcattggttcattccatcagtatgtaagagaacggccttctttttaaatctctggaaccatttttttgtggcacatcccctggaaaattaaatctttcatatgcttccaaatatgccatctaactagcaaaaagacctgcataaaacctgttcggttgaattgcattcttgcgagtaacactaccagaaagaagtttaattagatatggtattttctaagtattattctgaaaataatatgggattgcccgacctttatgtagaatcactccacagacctaaccacgcaatctgtgaaaatgtgactatggaaatgtattcctctgacattggcttaaacgttgtagacgtgtatgtagttcacttcatctctgccgttgaagcaatccgggggcattccaatcctgcatcttgccttctgtatcatgcggctcagtagcgcaccacgccgccagcaatggaaggacaaaatctaattcgtgcgctctctctgtattgccctatcgcgtgacatgttcaccggccgtccgcccgatcccacaagcactggtgcgtccgtctaaaccacacatggcctggcgattcacgtatgtggcattatcgagaagaatctgaatctgaagccatatgatgctctaggctacacctgcgagagggacacatccacctatacacctctacttcaaaaaattttttttcttaaactaatcatctgatctacgatctgattacaccgttgtgttcgtaagaattgaatctttataaaaagatctcacatgattatattttgataaaaaaatataaattacttttataatatatctaaattacttttagatttcactaaattacttcttagtcataaaagtaatttacccatattatagaagtaacttaaaacaaaaagtaaaagtaaagtaacttgttatggtattaaaagaaatctattgtgggggtaaaaacataaatctatccagaaattagatttaatcaatatatcatagttacccccacaacggatttatttctaatgttgtgacatgttaccttcattttgttttaagttacttctataatatatgtaaattaattttatattttattgaatttatttttatatgtctaagattcaacttaatgaaatctaaaactaatttatatttttttattaaaataaacatgtgagatcacgttataaagatttaattgttatgaacacaatggtataatcggatcaaagatcggataagtaagttaagagaacattttatttgaagcataggttttcttatacatttataatgttgtgagttgtttattttataatcatttttagttaatgacgtaatttatgctgatttaatttaatttctatatagactcatgtttttacctcataacggatttacttttaatgtcatgacaagttactttctttttgttttaagtttattctataatatatgtaaattacttttaggctttattgaatttacttttatggatccaagaagtaatttagtgaaatctaaaagtaatttagatatattataaaagtaatttatatttttttatcaaaatataatcatgtgagatctttttataaagattcaattcttacgaacacaacggtgtaatcagatcgtagatcagatgattagtttaagaaaaaaaattttttgaagtagaggtgtataggtggatgtgtccctctcgcaggtgtagcctagagcatcatatggcttcagattcagattcttctcgataatgccacatacgtgaatcgccaggccatgtgtggtttagacggacgcaccagtgcttgtgggatcgggcggacggccggtgaacatgt

SEQ ID NO: 78520 - DNA, 13123 bp, Oryza sativa
  unsure (1)..(13123): unsure at all n locations
aatcatttttttgttttataggttcaatgttttgttccccttttcgtgagctgaaaatatttcttgagaatacttatgaatgcccatctaatatgaaatttttggacataatgtaggggatagctttagcagcatccagtactagctcatgtgcaaaattgctatggataaatgttatgatgtgatgtttttatcaagctaaagcactacatttctttgcaacgcaagttctattgaagagatcggtttgtacatatgtcagaccaccttctaattgcgctttataaccacttagtttccctaatataatccactgtacgcatgcgccacttttctgtggttgctatttttgctcaagtgtacatgatcatatagatagcactccaaacaaaccgatcaaaacaactcatatttgaactttggtggtatggttcgaatgtaatgttggctatatctaccttctgttgcttttattatgacaaaccttctaatgtcagcaccggcacacgcagcgtagcgcgtggctctttctagtagatagtatagcgaaagtagtaagcacctcctgcttcatatagaggttatattgaatggttggcatgcatataactctgctcactctttggcaactggctagaatacgtgcaaaacttcagccaccggataatggtgcagactcatctgcttgtaatgaattgaatcacctgcagctggcatctggtgaatgatatgacatctggattttggaggcaccgtggcacatgtatggtgattggaggcacacatgcatgataaatcatgatgtgcagactctagagatgaaatcatataagctcgtagaagagaattaattaaggatattaaattccatgactctacatctaagtaactggtgaaagttgggggaaaaacgtacggctgttattactactatttagatcaattagaggaaagcaatcggacgaaagcatcaggtattaagttgaaatcgaatggcttgatgaggcaggttagtgtagtgccatgcatttgaatggacttaattagtgaggccattgatttgagagaagatgatgcgtcctcgctgcatgctgcagccagaggcacctctaacaaagagacgaatggtctcttgcactctcagctcacagtcagctgggcctacctgagaaatgggcctccaaggtgcatcagcagagatcatgctgcttagtatctaatccaacgcttagtagtagctgatatgaattgattcaacggcttcaattagctggtgacgtggaggcatgagatagcagctttgggtcttaactttaatgaaagaagggatacgcgtgtgggggcagcttggacttgaggcttacacgcatgagtgagaaaattgatattgtgtcatcgtcaaaagtgggttttgtccaaatgccactccgcaaaatagattcgataaaataccactatcgacacatggttacacggttacacgctacaatactactccctccttctaaaagtctaagtcctatttatttttcaccaagatcaaggtgcagttaactcattcatcatgtgataaaaccaatgaacatgcaaccaataagtactgaatgacttcttgggttccgataaaaaatttaatatagcacatagtgactgcaaataggacttagacttttgaaaaaaccaaagaatgaaataggatttagacttttagaaggagggagtatctcggaccaaattaccctactctcatcttcttcctccctccatcaccatcagctctcgccggcagccatcatcagctctctccattggcaccaccgccttcaaaacgctaaccctagcttgttgccttcgcgcgagctctcctccatagagaaccccaggccacaggcccctgcggggacccctcccatggctcccctccccgtgcccccaccccggccattgctgccgtcgcctccacctccgcggcggcaggaggtgggggcggcggtgaggctaactacgaggtttccgatgactaccgcgccaagtgggagcgccacgagcgcgctgtgtaggagctgctccagcgctgccgcgccttcaccatggccgtgcgcaccaacgactccgccgtgcgggcgcgcctccaccgcctggaaaaacgggagcggctgggacgacaggttggcacgaaagatggagactgccaacgtcggtgttggcggcgcggatggcgtggagcgcaaccacggggtcatcgggtgggggcggggaggaaggggagcgcaggtggaggccgatgaggcgagcacggcagaggcgagctggcggggcatccgtcctcatgtccttgtcagaggtggaagaaggtagcagcaagaggggcatttttgtccgttcagatattatagcgtgtagtcttcgattgaaagtgacatcctatcttactataaagttataacccacttactcctaaagtttaatatgcaaagatgccatatcatcatctactaacaagttgacaaatcatcatctactaataatcaatacatttaatatcatgcaaacatgctatattatctataatttaaaatttattatattttagagcttttaaaatgaaagcatgttaaatcatcatcccacataattcacataatatttcaatatatatcttcattattttttaaattttaaatatcttatgtacctatgtaagttcatcctcacttggttaatgttatttctctcttatctaattaagccatatcacatcaattgattttagtgcatatgtaagtttacgttgtttagctatcttacacattatttttacttattgttatcatactgaagtcccacagcaacgcacgagattttacctagttttaatgaagcccactcccagtttggcatttgagcaaaacccgttttcgaagatggcagaatatcaattttctccgcatgagcagatccaaggcccgatgaccctggacagccactactgcttacacgtcgaaaatattttatacatgtatttgcctaggttccaaaagatttcaaaatcgatctgctatactgcttacacgtcgaaggaaatttcaatggaaaaattctaaattgtacgtactttgaattttattagaacttttaaaactatatggtccagccattacgtacgtactcttggtaaaaatgtttgcctgtgctgctgattctttccattttccgttggtgagggggcgagggggaagagaggaagttttcttggaatggagattatgggcaacgagtttggttgtaaatgggccgatctttaatggctctcatggtccatatacactgtgacttcggttatatgggggtgtttaggttaggggtgtaaagttttggtgcgtcacatcggatattatttatggtgtcgggcactaataaaaaaattaattacagaatccgttagtaaactgcgagacgaatttattaagcctaattaattcgtcattagcaaatgtttactgtagcaccacatgctaaatcttggagcaattaggtttaaaagattcgtctcgtaaattagtcacaatatgtataattagtttttttagcatatatttaatactttatacgtttgttcaaatgttcgatgtgacatggtgtaatttttttacagggatctaaacaggccctaagacatttttggttttgaataaattcatgcataaatccgtgcatatgttttacatatgtatccaaattaataaggatattagtgatgctagacaaataatggagatgccaaaacgtgtggaacgaaaagagtaacaattagtgcggtggaggagctatggatgtccgacgttatccactaggatttaaatcttgtcatatatggttatatgcatcttttaattgatatatagtcatatagccttgctaaacaaaaaaaatataaactcgttcaccatgctttaaataaacttaatagagccatccacattgaaggtgtcctactgtccttacgacgttcacaatgcacacgatgttttattatagatgaagaaaataatgtttcattcatccactttaaaccaagatgaaatcatatctttctatatagttcgtatccactacgggcatttactcctataagacaagacatgcaaaaacctacattatcaacaaatttaaactattagatcatattagtacaaagataataatcgttggaccaagaagctacttattcatcctattcaattatttatgagttatccattcacctccatttgctccacctcacagtcacatatagcactgttatatattttgtgcataacaccatgtgttccaaatacaactcaaattagcgttcaatatgtgtgttttattttataatgcatgataagatggcttataattattagatatcgttacctgaatctattttcagaaaaaaagttgagtgaagtagagagatacaaattatctaactataacgatacacatattgtatatgaaaatattattcatatattataataatacacaatgacgcttggacaaagaaaacataaattgtattgtaataacataaggcatatataaatctacattatcgtatattttatatatacatagagttacacctaactatttaaaactagagttaagtccgatttacccccctaaactcgtacgaaagtacgctttacccccctaaactatgataccagatataatacccccttgaactattcaatagggacacttaaccccccctcgcgactaatttcggctggttttacccctttcgtctgacgtggaacacccatgtggtaaatgatgtggcagttacataaaaatatctctccccctctctctctccctctccctcgtgaaaaattccccacccaaacccctaaccctagcggcgcaggtggagctgggcggcgcggcggcgtggtgaagggtgacgcaggcgaggcggtgcagcacgagcggcggggtgctgcgcaggcacgacgctcgcatgacggcacgagacacgggcggcggtgtggcacaagcacaacggcgaggcacacgtgcacaagcgcagcggcaagacacacgcagtggcgaggcaagaagaactcctcaaaagtgaagacaaggatatgtttactggttgaaaatgttgactgaagcatatgttcccttgtgctttccaaatagcctcttgatcctcttgattgatttatactaactgcgcacacactttattgcacaaaacatgactatcacaaattgagaaacatgctggttcagatagccttcatgacatatatcggtactgattacatgcagtgattacatgctagcacactacatatacaggaagatcacagcttaacatacaaccccagaattacaaatacacatgctactaatgcatacagaagcacacatcttcccttctccgatatattatttttagcaactagattagtatttccagcatccttttgcttccctcattgcttccatctgttccttgtgcagttgtgcctagcaacattggcctccagctgcacctttgctgctttgcatcagtgacatgcttgagctctgtggcatacctgtgcgccgtcccgtgctcgcgccttgctgccgtgcgagcgttgcgctgctgcgcgtgtgcctcgccgctgcgcttgtgcgcgtgtcggcgtgtgcctcgccgccgcgcgtgtctcgctccgccgtgcgagcgtcgtgcctgcgcagcgccgcaccgctcgcgccgcacagcctcgcttacgtcgtccttcaccacgccccagcgccgccctcttcaccacgccgccgtgccgcccagctccacctgcgccgctagggttaggggtttgggtgaggaatttttcacgggggagagggagagagtagaatttagactatttaaggatatttttatgtaactgccacatcatttgccacatggatgtgccacatcggataaaggaggtaaaaccagctgaaattggtcgcggggggttaagtgtccggattgaatagttgaagggggtattatgtctggtatcatagtttagaggggtaaagcgtactttcgcaagagtttagggggtaaaacggacttaacccttaaaactatgattttgtttaaacataaagctacaaaacccaaggcaaagatgcggggtgccaactggttaagaattaagaaaccgcctagtcgcggcccatggaggaataggatgttaagtctattttaccaagtcatgcatagaaatcacatgaaattaagaactataagaagccaggttcctcatttgctctcccagtcccatttctatttactacgtaacatcaagcaacgcaaaaacagctttcacaacacatttttcccctgaatttcaaagtgaaaaagggatatacaaactctgctgcagtataggctgtaatctgaactcacatgaaaacagaggatatataaaatttatttctcagaaaataaagtagaagtttagtttaagccaaaattagaagtttgattgaaattggaacgatgtgatggaaaagttggaaatttatgtgtaggaaagttttatatgatgaaaaagttagaagtttgaaaaaaaagtttagaactaaactcagccttacaaatactgtttgccacgattaacggtgttgcatttgaaaagtaacgattggttcatattgacaactgagacatcatctgcttgacaggacaaataccagcaaaaatatttgtacatagcattcgaaactaaaatcttgtgccaaggcatcgtcaacagcatcccattctctcccatagtgtgaaatctgaacctgcaaggacaagctatagattttatatactaaggctgagtttagttccaaattttttcttcaaactttaaatttttctatcacatcaaaactttcctacacacacaaacttccaacttttccgtcacatcgttctaatttcaaccaaactttcaattttggcgtgaactaaacacaccctaagcaaattaaggttttgacaaaagaaaaaagaaactttgagatagtttactccatgcagtaacaaacgagagtgttgttgctttgctcatgccaaattggtgctcatgttggagcagaaagtaatgcaaccttgaaaaaaaatattgagatcttttatgctgtaaaaggtcaaaaggttctttttgggtcttttatgctgtgaagtgtaaacccaaataaatcagtttttggtttcttcagcaaagctcaagcctccacatgcaatggtgactggtgaaatggtgaggtgacatgcatcgctaaccatggccctcaacttacactgcacttcaaatggtacccctgcatatacagtaaacaacacagttatatttccatgagaaaaaacatcaggatagcaaacctgtgtcacaatccagatgatgctgcggattgtctgtgacagcacgacctacatttgaccaccctctgcataaaccgctcaaaaacagccctgaagacagcacatgtttagcactagttgacatatatcgagcacagatgtccgaagaaggatatcataatatatgggaactagaagtccactactattacataagagcagagttataaccattaaaagatcgatcatggagacaattatatcaacgacttggacaggcagtctgcacccttagctgcgacacacatcgctcgagcggctgcacgggctctgtccaagctggaagacgacactgtagctcggggatataaactatactttttcctggacttccatttccttgcttgggccggctgagacagagggacaacaaacagacttgcgcagagaaaaggggaaaggctgctggtttggctgggctgagggagagagttgggccagattaagcccaagaatttggaaaggattttaattacttcttcaattaaattaataactgaaatgatctttgaattgttgaaaatacttccaaagctcaaataattccaagaaaaatcttgcaactacgtggacactcaaagtatttttaaaaattaagatcatatcatttaatgactaatttaaaatttaattaattgttgaaatgtttttgttattattaaaattaggagttgagctctgaaaaatccgagaaaattccagagagtataattaatcatgaagaatttaataaaaattaaatccagccatgctttatatttaggaaattttatttcccacatttaaattcacttgtaaattaatgaacatttaatataaattataataataatttttttaaataatttataaatcctgaaacgaaaatcagatgcgacaacacaatggaacaaatacattatagtggcacaactacataatccagatccctcccaatcccagctcgcgtcatatctacaagcccttctcatgcatgcaaatatttctacattataaagttcaatatgttttaacattgattattagacaaataaaacaaaaacaaattgcaagacacataaacaaaatccttttatccaacttagaaatggttctataaatacatatcacttgcattacactactagaaaatgcattttttccaacgtagaggtctgattttcgtaggcggatataacccttgaagccaaatgaccgcctacaaaaatataaatcggggtgaagttcgctgtagattttcgcaggcggactacttaagcgacgcctgcgaaaatcagttttgcaagcgaaccactcaaaccgcgcctgcgaaaatgctacctaccccaaaaatttctaagtcttatcttctcctccacccctccccaccactcatttccctcactcagctctctctctctctccctcaaacacttacccctcctctcccctccccttccctcaacgcgcgtctgggcgccgtctccccctcccctccctccatctaccggcggcggcagcggcgcgggccggcggtgatgacgacggcggctcccctccccctccctcccagatctggccggaggaggaaggggggaggccggcaggggcggcggcgacggcgcacgtggggcggcggcgacgacgacggctcggcggcggctcccctccccctcccttccagatctggctggaggagggaggggggaggccggcaggggcggcggcgacgacgacggcggcgcggggcggcgacgacgacggctcggcggcggtggctctcctccccccttcctcccagatccggccggaggtgggaggggggaggccggcaggggcggcagcggcggctcccctccccccttccttccagatcttgccggaggagggaggggggagggcggcgggggaggcggcggcgacgacgacggcacggggcggcggcgacgacgatgacgcccggcgcggctccggtagggggagggcggcggcggcggcgcccgcgatttttttttttgctttttcattgcattttcgcaggcgggccattgcctcgactgcgaaaatcttcgcagtcgttgggctgcaggcggtcctcccctccgcctgaaaaagtcacttttggccgcctgcaaaaatactttttctagtagtgttagttccttgtcgaaacaagatttcggcaatactaaaagggggtggctatcaagcggaaaagtggatgggtttagagacaaggaattttatacaggttcaggccttcttaatcaagaagtaataccctactcctgtccggggattgatccgtcgagtgtatttttgatcgtatgatctgggaagaaaatcgtacctcaagaggcacccggacccctccttatataggggaaggggtccgtattacaaagtatagcccatatccctaacggaataggtagttacagataaaatacaatcgtaaccaactaggatcccggatatttccttgacatacaagtttggaatttaacccgagtccctttaaagatattctatctatatatggcaccccatacccagtcggatatacataccgtgtaggtatggggtatccataatctccacagtagcccctgagacttttacagtcgacgaaattgtcttctctcgtagtgcaaaatgataatccgagtgcttgaacttcttctgccttgatctcccgagtaccaaaatcaaagactgtgaagagctgaaaataaaaaatcgggtgcatcgactagatgcacctaattaggtgtagccccagactatgtgattagttaaaaactaaacatatagtcaaggtgcaaataacatccaaccgagtggtcttataactaaatcatccaaagtatcatacagctaagcatatgggacgtttagtaaaacattcagccgactgctttaactttattataccaaaaattgagatataaagaggcccgagtaaaaaatactctaaaggtccataaatcaacacatatgacaagaatccgagtaaaaactctcaaaaagatccatcaaatgtggtataaatcatgacaatcgatgagtctaaatagcctaggctatgactcacgccataatcaaaataagcatataacatgccgagagaatgactgttcaaaaaccagtcatctcaacaaaacccgaacagcttttgtagcctaaaaagacttacaaaattagtataacacttttccatcgggcacctttttatttgcatcatagtaattccaaaaaattatctaactgcgtccaaaaggattttagcagcattgggctaccctgttgcgagcaagtattgctgaagcaaaatgcctaagtccctaaggatcacaacttagccacgctgatagaaagaagtgggctgaagtaatgtttcgggcctaggcccattagtactcccgataccctaataataccaaaagccaaacatcgcgtcgtcttccccgccgagactctcgccactttccccattcccagctacagtgcgaaaccacaccggcgaagctagggttcgccgattcactccaatccgtcctccaaaactccacagaaatcttccacacaacctccgcatcaatctcccatccattcccacccacattctggaccaaatcataccatccagttcgcatccatggcggaagagagagaaagctttgaaagccagtgggtgtcctccgatgtaatggaggagaacttgaaggagatggtggcgcacggcgtccttccggcaaaagagatcatcaggtggcgtctagcatatggtgaaatgttcccggcccctgacacacacgaggtggtggtattctcccatttcttttatggcgggttttctcttccgacctcaagtttcttccgaggaattttggatttctatgggatcagcttgcatcacctaaaccccaattccatagtccatattgccaatttcatccatgcttgcgaagcttttatggggattaggccgcatttcgctttattccgccacatcttcttcctcaagccccagccaaacaaaaacaaaccatgcatagttgggggagccggatttcaactgagggggaccttgagccaaaaatacttctccatgccattcaagacctcgaacaaaggttggcgcgcaaactggttctatgtgcaaaaccccgagccagcgcttcccggatactcctgtcttccccagtctatcgcgatacctggaactcactgccaatgggagaagaggccgcccaagcgctcgacttgttggatcgcatgctaaagctgaaagaacaaggtctgcagggggaacaaatcacccggcacttcatcaagacccggctggcatcaatcaaggaaagatccagaacagccttcgagtttgacggcaagcatgaccccaaccgagagaacccagaatctgttgagttcaaaattatgcaggagaggatgtacaaaatcttctcgaatgctatcgtggtcagctattcacatttattgccagttgtgccatacaatgccttcaaccctcctccaccggtatgtattatacaactcagtttctctcaaagcatgcttttatcttccataaagtcgactgagaacctggaataccatgcacaggaattcgctttgatgaagtccgatcctccaatcgctcaacgctgctcacctcgccgacacactggccaagctagtggagggccaaagattcagtcggacgtccaacccaacgcctcaagatcgactaaccaatccgattcttgtaagaggaagctggtttcaagtgacgatgaaggtgatgatgcggaaaagacgggcaacaaaggggtgactggaaaacaaccaaagccaaccaatccgaagaagaaaatatccagtcgtcccataccaaaaatcaggaagtcatctaggtatgtattctctggcaatttcccctattttactatttactcacaattgaaacagagctgatagcgtgtctaaaatttgtagaaaaccatctgacatagatccctctggaaaagatcccactccgactggcacagagactggtccttcggtagaaactggaccgactgccaaaaaccacccgggtaataatcaaccggcaaccggcaatgtagataccagcaacgagcccccgactggaaaccagtcggctgaagctaaagccaatgctgatcaggagccctcgactggaagtcaatcgggtacagaacagaatcgagacatcccagaaatagaagctcaagccaacagccctcccaagacggacactggtgctggccctggaacgagttctcctattagggtgcaaggacctgctcgtccccgaccggaagttatcacaggtaaataagtcctccaaatctgctttgatccgacaacctttatccaattacttcaccattattcatgaatatacaaggaccaatgattggtgatgaagaggaggtcctctggatacgatcggctgaagattctcgcccaccaatattagtcaagtggtgggacgatgaaatgcgtccacaaggaattgtnataaataagtagagggaagacgaggaagtatgtctactgaagaagacactcggccaagctactcgtcttgtaaacgtaagtctacacttacatagccttaatcatcctgtcggtcaccttacttgaacaagg

SEQ ID NO: 78521 - DNA, 1143 bp, Oryza sativa
  unsure (1)..(1143): unsure at all n locations
acgtcattgannnctggctgtctcttcctaattttgtgcaccacttcctgattcatgctcatgatcttcatgttctagattttgtgcaccacttcttgatccttgatctccatgcttcacccaacatgtgtagcccttcatgaaatctctttgtatcagattagcgtgtacgtccactctgctgtaaaacatattctcatttttgcaatctgcacatggacaacacatgcaatcgttgtttcttcttttcctatcctcctccgcggcgttaataaaattcaatatgccatttctatacaccttggtatgacgtcgcatagttttcccatacatctaactttgatccatccccgagcttcataaaagtagaaaaatattagatatacattttgtaggtaagtatttactaaatttttgagaattgactactatttttcaattaaatttgcaatttatgattttcttggagaaaagagacaaaaatcaccgcctcatactcccaccaaaatagtgaacagtgggataaccattacactaggtagttggggtatttatactgtgcaataaatatctgtaacggccaaaaaaaatacgacggtaacaggtattttagttatctttgtcgggcctaagtaaaagctcatcaccgataacattcatcgtgatgggcctaatataatagttatttcaaccaagcctcaagttggagcccgtcaccaatgatggacatcagtgacgtgcttcttgtagggccccgacaagaaatcatcaagtatcttttgtcgccctcaagttggagcccgtcacaaaatggtgtcattcgtgaccggctcgatttttatgcacaatctaacatgtcttgtgcaagtattatctttgtccgcccttggtttgggccttgtttgagatgacttcaattgtgacggccccggaaaaacttagacttgtgaggagccgtcaccagaataagaatgatctgtccttgtgtattaaaagggaccgaatccaattgaattgntggattttttccaatcccgcagtgaataaaccctattatggaatcttaggtcaaaacaaaatcaagggctcattccataccggttnggttcaaaaaacccatgggaacgtgtaatttattttctt

SEQ ID NO: 78522 - DNA, 542 bp, Oryza sativa
  unsure (1)..(542): unsure at all n locations
gagtttggttcgtggctttaggctgcctaccccatgtataaatagagatgtgaatcgaataattcaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaatgaccgactatgtggctatgcggccgcactccttgctccctatgcggctatgcctcatccttgtgacgcaagagcgattatgttgtgttgttaccgtgctctctcatgtggtatgtagagcaccatccttttcaaaacgatatctcactcatagaacataaaggtcgtaggacaaaaactgatttatatggttggtctatttta

SEQ ID NO: 78523 - DNA, 1813 bp, Oryza sativa
ttgctacccctactttacttcaatataagatactctcaattaaaacaacaccataaatcactgctccactcttctaaaattctctgtatttgatctaatttaatctaaaaccaataggccatcaatgtcgttaattctaacaaaattgttaccatttcattaatatctccagtttcaattgcacaaacatatccttgataaagaattaagaatgtatccctatataagatagcccatatgtttcgtttacccacaattcccatacgtactgctcaatgcttaatgtaccattaatatgaaatcaggtgccagtcaataacaggttagtctgttcatatttcatcattttattttattttttatcttcttacacccccttcccataattatagtgtaatttccccttctgttttggacaatatgtttgcatgaaatattttctttagggtgtcagtgacactatgatgtgcccaattctcttccatataatatccaaaggatatacattttagagtgataaatggacacagagctattgtagcacaaactggtaacacttgactaaatgtgttacagggaatactgcagtagcacatagtatgtgttacatgaaaaggttgtaacacagtgtgaaacagtgttacagaaagagctgcagtgacatataataaaagttactaaggtttgattaccagtatttgcagtaccgtcggactcttgagcatattatattactttacttaaacaccgtgggaatggtggaagattaggtggccaactcatcaataactttacttaaacaccatgggaatggtggaagattaggttgccaactcatcaatattttcagaaacaaccctcatctctggttaattgtgttttggctcaggctatcaaggtccgttcgatctcgggctagcattgatctggccgtccacgtggcccagcgtggttgttctttcggagtcataggaacggtgagattagaatggacggttcagatcttcgagcagatccagggacaaaaacccaagccgcacatgtactcccggcccagccggcctcgctctcctcgcctttgtctcgcgagaggtggtgacggcggtggaagcgcgatgtatcggcaacagcggaagtgcgacgccacgcctgctgctggcgtgcagtgccgccgtcgttttcccagctcgcggctctcctctcctgacgatgtccttcccttcttccctctcttccattgatggctccatccatccccaatctcacccctaaccctaggttggcctaaacactaaagattgttgacgatggtgctgcttgcgcagcaggtggtcaggttttgccgacggtgcgccgtggatttgggcctcccatcctcaaaccttcaaggtcatttctatctcccagccaaggacactgttcaaatgtgctcctccattcccctccttccccaggtcagcagcagctatgcctcctttctccttctcacatttattctcctttttatgaacaacaatttagctttgctgtttatatatcacagaaacataataccatcccctcaattggacgatgggttagtcatattttttttccatttttacaaatccacttatccctggaattaacctgttaatattaattgcaggtagacatgtatcatgtgtttttgtatggtctggagaaggcatgctttagccatggtatgtcatatttgccaactctctcgcaacaagatgtaacacacacgttttagtattattattattggttttatatttcttggttgattgctggtaatgctactctaatg

SEQ ID NO: 78524 - DNA, 1088 bp, Oryza sativa
  unsure (1)..(1088): unsure at all n locations
gtgttggagtcaccgtggatggacgctcgggttacggagaatcgcacgatcgntatttcatgtgaccggtcagactgggctctggtagccggtcagaccggcgtgttatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactagggctagagttgatgcacgtggttgatggagattccatatggcatacgatggagttattgtgtgcgtgtgggatgcggagttgaatttggaaggagtccaaatttggtacgattggttatgtaaaggttctttcttgtactagagggttttctaaggtgtttaggactcctagtatgagtttggttcgtgggtttaggctgcctaccccatgtttaaattgaaggggagcggtgggctttcctgtattgctttaaagagcaattgagttgagttttgagtaagggttcgaggttatcgcaaaatttttggatgagtgcctgtggtgcactttgtcaaaccgtgggatcacttaaggtggcatctactttaaaggtctttcacttgggttaccgggtttcgggggtttaacgggacctaccggggggcaaaacgacggcaatcggacgtacaccggtgggaacagggcggtaaaaccgctgggtgcgatgctcaccacaagccaatccgggggtataccggtaataaaacctgtgcaaaactgcgctctctttgtgtaaaccggttatttactttgtgtcgaccattcttatcgaaatgggcggaattttattttcctttaaacgtttggtgttggtgtttacaaacatttacccttccctttctggtgg

SEQ ID NO: 78525 - DNA, 4601 bp, Oryza sativa
aaaaatcaaagagctaatgcaatggaggttaattgacgacaattgtaaaatgtaaaaaagatacttgtatggtgacgcattgttgaacttgtgctgaccaaaagtcgtagaatcaattttttttataataagcaagaatcatctcttctaaaaaaatatctgcatgtaattattcttcatgccatcgttacatcttatctaacattgtatcatatagctttccaaaggccatgttgacctgggcttagataacagggacatactcacatacacatatgaatcagctatcatgcctgatagtgtagttgacattgaagatagcgttgcattatccagttttcgacaagattgtaatagtcgaattagactcggttttctaagctagagaattggtccggaactcaaggaaagaagctgcaatcaaaattcattcctattttccttgactagaatttaacaatgggcacaaacacaagaatgcctatggacaataaagatataagctggaaggagataacttctgttgtctaaaccagaagctaaaaatgcaaagttccacgtatgaagttttgtatcatattttacacgagaaaactggtttcataacagaaatcctttccttgcaaagattctcaggtgatgaacttaaaaaaatggactaattccacatggtaattttttgtatatatatactactcttcaaattatattcgtacactcatttttagaaagtttaaaggaagaatgccaactgttttttcttcttttggagcatccttcactcattgtttccgttcactcattattgctcccttagaagcaaagaatgatgttctagcatttcaaaatcccacacatttcaaagtcctagatgatattaacaagtttaacaccaagatatactccctccgtttcataatgtaagactttttagcattgctcatattcatatagatgttaatgaatctagacacacatatatatatatctagattcattaacatctatatgaatatggataatgctagaaagatttacattatgaaacggaggaagtagttaacaatttttcagttttgtattagcaatgcctcaaaaaggaatgagataatgtcctacaattactaaccagtgaagtgtatttacacccatcaacttgtgcttagatggagtttttcactttagtcttttcataaatcaagggaattgaattgcgtaactcagaatcactgacctccaattttaacaaagtttattaaaaagaaaaattaaaaataatcctccttcctcctttgggccaagtctggcccaaagtcttcctctctcttcctcggctcgcagccgaagtccttcctttctccctccctttctcttctctctcgggcctccccctcctcccggcccacctggtccatgccactcggccgcctagcccaagctgagccgcccagcacctggcgcccctccccctcacctagggatggcagtcgggcacgacaggcactacccatgcccgtgcccgcgaggtaattcatgcccgcgggcatacccattactacatgacaggtaaggaacactacccatgggcatgcccgtttacccgttacagactcacagttcagcacttcaaccataaatctccacaagcagagacattatcacagtttaagaaagggtatagttccaccaagtttaaccatacaagtattacaagttcatcaatactagatggtggcattatactaatttgactgagggaccacatatcagttggtttttgcgggtaaacgggcgaagcgggcatgggtagtgactacccatgcccgtgcgcccgttgattataggttttgaccccacaaaaaacccatggatactaaatggagaacatacccaactctattagggtatttacccacgggtaaacggacaaacgattaaattaccatccctaccctcacccgtcgcatgcgcaacacacgtgcgcccgcacgcgctgaccacgcctcccgtgggtccattggttagaccccgtccccttcctcccgccgacctcctcttctctctccagtgaaaccctatgtgccgccggcccctaattctgctcccccatgcgagttctagccaaattaattgcaaaaatggaatccccatccccttctcattatttaccctaattttccccctctaatcccgtccccaatcgccaggatttgaagttcattcaaattaatgtcgccattgatgccgccggccacatcctccggcatcgttctcggtccctcccatggtcggcactccctccttggcctataaaacagggtcccctccctccccttgctccgttttgccctctcccgagtccctacccacctccccgcagtgctggcggttggatcgggaaccagagtccgccacgcggagtcctccctgtgccgacagcggttcgacggaggcggagcgccgcgcggagcaggcaccttccggcgacagcaacggcggatgacctcccagcaccagcagatgagacgagcggcaacggcaaggattgcaggattgttgatgaactcgtacttttatactactccctccgtttcacaatgtaagattttttagcattacccacatatatatatatatatatatatatatatgttaatgaatctaaacacatatatatatccagattcattaacatttaaatgaactaggcactctggcgcgctttgcggcgccccttcggaagttagtgtggtaatatttaggaaaaaagaaatcaatgtgatatagcgagtacatgagtattgtgggattaaaagcaacacatgacagcattgtattagatcaagtaaacaactaagcaacacaacttgattcgacgactatagataatggtttctaggtattgcaaggtaaaaaggtaggagataagattatttcaacatcacgattagcattgcaattagcggaatctattgttctttctaagctcttgaggtagacggcgtcgtggtgcagatgtggatgctgcttcggaaggcccttatttgagtccgctactcttggtgtccactgaaaattcatgatgataggaacccggcctggagtttgtttcctcatagtgtctcagcatctctccatctgtatcactgccactaccatcatcagagtagtcaaatagcttttcaatatgcactaagacagtagcagttgcagcctcacggtcccaatcaaccttgcttgtatgttgaggaccttttgtttcaatgttccagtccataatctttggtatcagattaacatctgttgtccaagctgcaagcctaaaaattgagacatcttgtatatgatactgctcatagatttcttctaccatacaactattgtccaatagttcaggtgttgcctcatcattccatgtttctgggggtataccttccagagcaatgataactctttgtctcaatgggttctttacactgtgcatgttaggcttgaaaggatcaaacgctaatcgagttgtctgaaacgtgtaagttttttgttcgattaatctttcggctgcttgttcctgctcatctttatccatgaacaaagctagatacatcctatgtttgaatggaagaagtgctatgtcgcctggttctaacttggatattgtagacaccatagctaccactttagtctttgtgggtgtgccagctcctaggacagtgacaacaactgcattgtgataaatgatatctgcaagtagctgagatagtggttttaatttgctaaacttggtgcctctaagtggtctgttggttccatatgacatcgctaaatctacatgaaagtatcttacataagtagcaggtttatgcatgaaggagacaaacactgaagtagacaggagaaagaaatgtagattgaatggttgagcttgttaccttttgttgaagacactgagcaaggagaaatcgctgaagcagcaacgcgggatagaggaaagctagtgtgacattgctcaaagggactcagcgttctatatagaggatgctttctacattgaatttgggttggtgtggtgtcttgtcaagtcctggtcaagaagctgcaacggttaaagtttatgctggatatgtttgaatgtagctatgttatctggttatgtctgtatagcgttggttgaaacgggtgaattccagaggaatcgttaattgtcggcctctgctttgttcattaagctgatggaaatgtgtgagcggtaaacgcagtgctcgctatgagtatgtgatatctttaagcagtaactatgattgacgaacgttggctattagattgtgaaacaaaaacatccagctgtatgttcgatgcactgagcagactaataaacagagattaaggaaggtgtttgaatccattagctaacttaaaccattccacatagcattcactattatcaaggtatagccatgataaccatgaatactgctagcaatggcagatgttgtttgcagcgttacaaattaagtttcagatcacatgaatagaaatggcattttcgtgcgatatatgaaatgatcgcatcaaatgcaggtttgcaaaaggggggtgcagga

SEQ ID NO: 78526 - DNA, 1523 bp, Oryza sativa
  unsure (1)..(1523): unsure at all n locations
cgggatgactccgctttcgatggaccactaggacgatctatgcaggcgctgaaccctcttcttcactgccgtcttcaggtgccggcttctcaaccaaaaaaccgaaaatacgcacggttcccatgccggcaataggcgccagcagcggctcctctggtgctgctccaacatcggccgcctctggccctgcctcaaccggtcgcaatgccgctgcctcggccggtgcagcggcttctgcagccgcctcttcctctgcctgatcatcctgtggcggcaatgccgctgcctcgttggccagcgcaagcagcgccggtgctgcaacttctgcacccaccaccattgacagtagtggtggctgatcaagtggttccgacgaagttacctcagcggcggccggagtaaggtccggcaaaggtggtggtccaagagagatgtgcttgctcagcgacattcggctccttctcgttcacggtcaccgtctccttagtttggtgcttcctcatgtggccgccgagcgcgaaacctgtcttccactccatgccgcattctctgcaccgatgcttgctgctgtcggcgccgccgtggcacccgtcggcccccgctccgctgctgccctgctcggaggccgccgccgccgctgccttgctcctgttctgggggccggcagcgtggccacctagcccctggtgcgtggggaacgccctgccgcagccctgcatcttgcacatgtatggtagacttttttgcggcgccccttcgacgacgacgacgacgccggcgttcggcgcggcagccgctggttggtgaccgacggcctgattatgattgggaggattggccggcgctggtggcgacggcggcgcgctgctgctcccgtgtggaccggaaagatcaagatcggttctgggctcagcgaccacagtgacacgagagntgtctgccgcattatacttgggggttgcaatggattgttgaccgtggacctcttatgtgccccgtcacgggcttccgggtgtcgaacttcttttcggcagatgcggnacgcgaacaccttccgcgccattgtcgacgccgcaacttcttgcgcggcngcaaccgaggccaatgcgacaattgcgctttccgtgcttggtgtcanaacccgccccgcagaggttggcggcccccgtacaacattgttcaaggccgcaccgtttgtgcttcccgcaaccatctccattgttcggggagggagcccggnccgttttggggcctgccgtcctcgcttcggaccccgaacgggaattgtacaaactttcctcttgattggcaatgncgccaatttggccgcgggagggtgaacacctccatgggccctggttggatatccacctctatagcgccaaatatttggggcttcttttgtgggcttagggggctcaatccaaaaggatacaaaaaacggcctcgccgaaaagctttgggnagaaaaaatctctcnctcgcggctgcgggtgttggtgtccacatataaacgtcggcgg

SEQ ID NO: 78527 - DNA, 1735 bp, Oryza sativa
ggctaaaaccctatgccggcaaatgggtgaaacagctgccatcagtactttggtctttgcgaactacacccagtcgggccacaggccaatcaccttttttccttgtctatggggcagaagcaatgttgccgagtgaagtcgaattcgagtctttgcgctttcgaaatttccgcgaagaacgatacgaagaggaccgagtggatgacttgcaccgattggaagaagtccgcgaagcggctttgattcagtcggctcgatacttacaagggctgcgacgttatcataatcgcaatgttcgatcccgtgcctttctagtcggcgacctggttttaaggaaaattcaaactacacgagatcggcacaagttatctcctttatgggaagggccatttatcatctctgaagtcacccggccaggttcctatcgactcaagcgcgaagacggtacacttgtcgacaattcttggaacatcgaacatcttcgtcgtttctacgcttaggcttatcattgtacttccctatcttgactgtcaacatcaagttttcttcttgaagttgtcagtcgggggctatcatcataataatggagtgtgattttttatcaatttaatttgcttacttggtctatcattgccttgtttggtttttctacttagtgtgcgaggactgaaagtttttaatagcttctttgggttttaggcttaataaagcttgataaaagcttttaagaaatcaaagacttggctagaattatcaagcacagcataaatacaccagtattgtacaagtatgcctccatttgctacatttatactcagtcagaatcagtcttttcatcatcagatttattactactcggctgaaggtcggcgttgcggaattgatccacaacgtcacttgcaatcttgtcagccgcattttgagcattgctgataagatcaagagcagcctctacgcttgtcccgtctgcaaagccatcaatggcgtcaatttcaattctcgggtacaaggacttggtcatcgccaatgccgtgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcttcttgatcttaccaaccaggacgtcaaattgagcttgagatttgattttgcagtctacaaaacacatttatgataaaaatcagctgcattgaaaagagagaagttcagattgttagctggcagtaccttcaacctccttcaaggccgagtccctttgcgcagccagttctaccttgtctctttccagggcttcaatttgtttctccatttgagccatcctggtggtttgcgctatttgaaatccaaatggttgaggatacagttacaacagcgtaaattaatgggacagatctagagattaccttttgatgaacctctcagctcgaagtttgaatcctggagctgagcaatttggtccctcaattccttctctgtctttttggcgagctccttggcctcgtgtagctggtccctaactgcttcaagagttcccaaatgaggaaccagcttttctaaagttgcggtcttggcctcattacgaagatggattctctgcatgatggttcatggtttagttttgctgaag

SEQ ID NO: 78528 - DNA, 942 bp, Oryza sativa
  unsure (1)..(942): unsure at all n locations
ttttgtcagatttgtatttgtagaactataattctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatatacaccctcgccatatttttttttgggaatgaagtggtaaatagcatttatgtgagaagggtttaggagaaattaaaattttagaccaagcagttgtgtttnnnnnnntngtttttgncgaggtgtgtatgagtataagataagaag

SEQ ID NO: 78529 - DNA, 22767 bp, Oryza sativa
  unsure (1)..(22767): unsure at all n locations
atattttatagtattcctgagcatattaagttgatcgatggatatttgttatagcttgcaaaggttgccatccctgccataccaaatctgtaatattttgatcctttttagagtgtttattactttatcactgacttggactgacattctgatttgggttttcttaccagtcgtgcgatgcctcacataaaaacttttactcgatacaatggtcaagacattgcgtaagcatccatataaactgttttgaactctagaattaataacagtatttccattgaatcattgtctggaatctttgtatatcctcatcagatggtttctactaacctcggcaaatttaagcaaagctgcttggggtgcgttgcagaagaataatacacaactgatgatacgctcatatgaggtggatgattttgttccattgttgaattgaggaaattttctgaacatccagacttttacaggaaaactgctctgcaacatagtgttggtcatcatggaatcgtagcttataccttgccatttgatctcttttcagttaggtgtactgttcttgcccaaaactcaccaatctgtaccacaattttcatgtacggggaagaacaattcaaacctggtactatctaatttctccttccttttgtattataataatgtgatcactttgcttttttttttcatcattttaagttccttacccagaataacctggcccctgggaaagagatcaaaaccaaactggtcacactctgctggaaaagcgacgaagaaaaagaacaatccacggaaattatcagattgccagtgccatatcaacttcctccaaagccttacggcacagaaggtgagctggattaatttaacgattgatacaacttcagtggagtaacaatagtaaaacacttagaaatgttttttttactttcagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagtactcctacagtccgtcgtcatccagcgatagcgatctgaaattttaacgtgcaaaggacgctacctaaaccagctttttccagaaatcccccgtgcttgttcttgcggctgtccttgccttgagccgctccatgaaagcagcaaattagtggtactgcgtaaaagaataggggcaattgactcgacgatctcgcttccgtcgtcctgttgtgatcctagacgagaatcgtcgtcggtgatcgatcgggtgatgcgaagcgttcgtccaaatcacggtgattcaatcaccaacccgccgtatgaacgaccacgagcacgggggtgtgcgacgcttccctcggccgcatccgccaaagggtaaacgccggcaccaccacccaccaagcgacacggggcgcgcgcgcaccgcatgaatcgcgtggtacgtacgtacgcccccatcccaccaacgggccaccacgcgacacgagacggcaccacgggttccgccccccgccgaccccttgcaccaagagcccacgtaccgcaccgcgcaccggtgccggtgcgtgctcgcttttgcctccctccgcgagccgggcgcgccacgcgacgcgcgcgcgcacacgtcgcacgccgtctcgacgtctcgctcgctagtcgctacccgcgtccgccccacgcaacgcaaggagtgaaagaacgcgatgccgcccgcccgcccgccgccacgtgaacgcgcggcgcccctatcaatccgcgggcggcggggtccgcgcgctcgcgggggccccgcgtggcggtggtggtgggtgggtgggtgtcaccgtcgcgaatctcgaatccgcgaaccgcgagtccgggggggaatcgggtccgtccatccatccctcccagtcgcgtctcgcgagtcgcgacggcttcgctctctcacctcctcggccaaggtgggccccgcctagtggctgctcgtatcgattcccggatacgggagatcgacgatgctccgctatgcgccgttgccgtttgggattgattgattgattaatataattaattttggtttaatcacgtacgtttcgtcgtaatcccggcatagaccgcgtctgatgctgcgggttggaatgaccattagcgtaggtcggtcgtctggtccggattctctgcaagtagcgggcacgtagtatgccttcattcctttaggaagaatcgtgtcaccatttcctcgtaatttttttctccatccgtctccgtcctaaaagaatgtagtagttagttttagttagttaagcaacatttcattaattaatacaaagagaatgaaggaaggaattactacttcttcgatgacaaaagagaaaaaatatgaagtattttctatgcaataattatagctattttttttattacgaaatagaggcatgttcgtacctagagagatctaatgggctctacttcaaaatacaaacaaatttttaaatatgttcatacacaatgtcctattttattttgttagagtatttaagaattctattataggtgtggtctaatatgaatttaattttaaagttaattggatccatatgccattgtactttgctaaattgaaaaaataccactactattcacaatatcggctaggtggcatcgatattttgtaaaatttgaaacagaccattatataaatcccaaacacagttgtaccaagttttttatattgtattttcatacttaccagaatgctccctatcccttagaggctgacaaggaggacccacacgttaaacttatcttcttccccgattattcctctagcttgacgattccgcctacaacaacaacagtggtgaagggccggcactagagcttaccagcgacgacgtccccgcacctggcttcccgatggtgtggtagatcctgcaacggtgtgcttgagcttgagcgtagattgcagccccagaggcgaacagcaacatctagattgtggcagcgagcaatagtagccccagtggcggcggtcggtcctcgtctcattatcgtcggtgagtcccagcaccgacccattcaccacatcactgccatggagttcgagggagttggcagcattcctcgtgtgaaaaccccatcgctagcctctcgacagcgtggcggcaaggtcaatgcaggcgggctagattggggcggtgaggagcagtagtagaagcaaccccagtggcggtgatcgtttctcgtgtcgctgtcatcgacaagccccaacgttgacctctccaccactgacaccaccttcaacctctccaccactatcgccactgccactctactcccgtcagtcttgctgtactagtggaagtgttagggaagaagataaggttgacatgtgggtcccactagttagcctataaggttttgggggcattttggtttatacgaaaatacggtatgaaaaaatcaagtccaactacgtccgggccgtatatagtggtatattttctcttacaatttcagaaattaaaatttttacaaaatataccaatggcacacgaccaatatcaacggatagtagtgatattttttcaattcaacaaatttgcaatggcatggattatagtaaccataattttaatttgtgctcatcagttcaatattgcttttttactttgtgcctcacacaagctatcttctctctggccatcactaacaataggggtgaaaacggtacggaaacggacgaaaacaacttttatcattttcgttttcatttttttttctgaatcggaatcagaaaccccggatatgaaaacggaatcgaatattatcgaaaccgaaaacggagcaaaaacgaaccggcgcgaatacggtatggaaatttatcggaatacaaaaacccctcaaactgataaatctaattctcaagtctcaacggtcaacaattcatcataaaacacaaattatataagttcaattgttaagtctcaacagtacatcacaaaacacaatgtatgaaataaattatctatgtttaagagagtaatgctgttgataaatcccaatgcgggaaaaaaaattcttatgtaacttcagatttgcataacaaatattttttaaaaataacatccaaacaccatggtattcactgttcagtgctaaaaaaaagaacccagggtatttcaatcataaaatttctagaagtttcgagaaaattccaaccgacagatttcattttcaaaaataggtccggaatccgaaaagtttccgcaccgtttttaccccctaactaacaatatagggaacgtgtgctaaatataaaataagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgagtaaaaaaaatctttctagctgaactcaatgggtaaagagagagatttttttttaaaaaaatagaatgaagatattctgaacgtatcggcaaagatttaaacatataattatataattttatagtttgtgcattcgtcatatcgcacgtcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaaccagcgacacatctctaatatcactcgcctatttaatacatttaggtagcaatatcggaattcaagcactccaccatcaccagaccacttttaataatatctaaaatacaaaaaataattttacagaatagcatgaaaagtatgaaacgaactatttaggtttttcacataaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctacggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccattttaattatatgaaatgaactgtagcataagcagtattcatttggattattttttttattagctctcaccccttcattattctgagctgaaagtctggtatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttcatgtctgatctcgacattcagatcccaactgccttcggtatgcatgttgttctcttccctctttgtgatggtctgagtgcctggaatatttgtgctcatcatgttttcctgaacatgtacagatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtgtgtgtaataaccgaaatttgtggtgcctgatctttacgtttttctatctttctgagctagtttttctgatcaatgcttcactctgtaggtcattcaacttcagggtgatcagaggaagaacgtatcaaattttcttgttcaggtagggatcattcttcttgtgcatgcttactgcaattagatgtacacatgctgtgatgtatgaaaagaatacgtcttgacttgttgtaacatgctatgtcccgcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttatccgtgtgttgaagtttgtaagaggcaccatcactatagatgatggcttgtgtccctctttcatcaagattgaataatatatgctactttgagagcgctatcctgcttgcctgattgtgttaatacttacatccgtcccacactcccacaatataaggaaataaggtattttggcagtttagagcaaaattcccttatatttttgggacggatgtcctcttttctgcatttttttatgttcatatgttcctgaagagtaaggtggatcttgatcaacctgtcggtttatggtgattgatttgagtggaatagaatgggccaacgtccggcatacagttatgcttcagctagctccaggagttgtggttttagattgctcattttctcattctttttcatggacgatagctgaactgctgaagtagtgaagtcggcatgcactggctactgtatatgtatggcaattgatactagtagtattgtcagctgaagctgcatgccttctactgtggagtactagctgttgatccaaactccagaccgtgaactgtttgttttttcattactgctgggtacggtacactagcttcattctgtgcatgagtcattctccggcatgtctgcaggacatctcatgatacttctggcacttcaacagtgatatttccagagtactgcaatgagtttattcttatggttatgtacagtactcgtgctagtaatagtgtattgtacgaaatgaatatgggtagtactagtagttacaggattcacaaagctgggtaagttagaaatgaacatgggtagtactagtagatcacaaaggttcaggattcagaaagttggatctgattctcgaagccttcagtgcttctacgtcgccttcatcagtcagcatgtatgtgtaccatcttttttgagtgatttcttcccccaagtttcaacaaacaaaatgatgttacgaccagaccatcaaggttgagaaatcaaatgcaatcttgtcccctgttcagtcagacgtgcacgtagtacatcacagcatttttcagtcccgaattcgctcatcctgctgctacaggtggtcaaacagtatagttcaacttcagactttcgtggtgcttcttctctgtcaatgtgtacaacctattgctcatgatgtgttcagatagataagattatagtgcaagatgttgccgtggaatccttgcaggtgcgtgcagtgacttgaacatgggctgcatgtgttcctgcccctgaaatacggtgagatcgatttggttaagataatcagtgttcctaaccacgtactgtagtagccgttaacgttgtcagccaattatcaaatacgctgggacatctctctgcatgacctggtgaccatcagagtagtcagtgcctcattgtgcttgtaattgatctactactagtattctcttcaaaataaactgcgaatcaaaccccaacatattcttttcttcagtaaaccccagacaaattttcatgccaggataaaatccttgtcacacgaaaacaaaaccaaaaatatgtagcttatgtctctgttagaacaacacgagatcactggagagtggagattatggccctccacggtcattcctgccgttgaaacggcgcacaatctttttggatgcttctttctttccccctctccatcttttctttttctcacacacatgcagatgcccacagatcgctcatcacttcatcagcagtagtaaccttttccttttgctatctccctttttcttccaattcgtgctcgccaaacgaaaggaacatctcgtcacattttccttttttcaagaacaatctcgtcacatcatgatgcattttccagcctatcctcaccttcatcacccagatctgtggcaggagagaaacattatttttttctctgacatccatgcctaacgagatgtgagatctggacgcatgtttcgcccatatgcctctgtactgtagtacatcttctgatcttcatcttggctgtcatctcgccattggatcaccactaaaattacccccacactaacacatgctttacaacgtcatttgtcaggctagtactacgatgcgtgtacactgaaagcagcaaaggaaaaaaaataattttatccatttcatcatccaaaaagaatatggtttccaacgtgacagccactctacgtggcccaatccaaaaatagtagtactgtagtagttacagtgaatctgagccgcacgatcgaaggacgatccgatcctggccgcacatcgtacggccatgtacgtcggcggcggcgccggcgatggcctcacgagctggtcgtccggagcaagcattcctccggcggggaggggaaccgcttgcggtcgtcgcagtagtcgtagatgacgaggttcctcgccacccaggcggagtcctcgcgctggccggcgtcgagcgcccacgccggcggctggtcccaccagctgttgccggtggacgccgcgcagctgggcgggctcgccgccgccgtgccccaggagcacgcgtcggcggtgaagtcgcggtaggaggagatgaacggcgccttggtccagtccgtcttctccagcccgccgcgcgtcgcccagtcgtcggcgttccagatgctggagaacacgtacatcggcttcatgatcgggaagaaggtgttgggcttgtccgagttccggtactcgcggatcggcaccttgtccacgaagaacctgatgatcaatcaccaccaccattgcaaagaacatcagaaatcgagattaattgacagaaaatggatttgggtgggcacggcacggggaagacgaaggtggtggcatggcattggcagccattgcttggtcctaaacagaatgtgtccaagtagcagcaacctggagtgctcgtacaagcggcagggtttggcaatatctgcaggttcaattaatcgccatcggagcgacccatttcaaggggtaggtaggtaggtgggcgcattcaactcgtagtcgtcgtcgtcgttgacggcggcggcggcggatgctatctccggcgagcccggatggccacggagtacgattgaaacaactagaagcttgattactattgttcggttgatcacttacacgatctgcttggggttccagaggatggagtaggagtggaagtcggcggtggggtcgaaccacagcgagtggcgcatctcccggccgccgacgccgctgcggtacacgttggtctggatgatgtagggctcacccgtccggttccccaggaactcgaagtccagctcgtcgcgctgcggcgccgcgtccacgtcggagcacatctgcagattacgccgtcgtcgaggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaacagttgttgtcactcatcagtcatcacgcatggtgttcgatcagatctggggcttggaccggtcagggtatctcatatatattctcatccgttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttgccctaccaatatttggtagcctaaatagtacccaccatttgtttgtttagattgatgccaacattttagtaatacccatcccaaatttgatataaatctagaactttcttcactatgatatcacaatttagctatattttaatagcaaaccaaataagatgaatacaaatttattctaccaaataattggtagtgccaaaatttatatatgttttagcactaaaaaaattagtagggcactgatccaaacaagcccttatttatttcatgcattgatgactggaaggggccgtgtttgaaagttgaaaccacacgcatgtttgttcatcggacggccacttgctctcatgcatccggaccgttgatccgtgctcgtgtactacacgtttactcgtgctgtacttgtaagtcatcttttacagtacactggcaatgctgttagatttttcacgtcccgtttttatttaccccctttcttttggacgtctgtcctttttatccctttcttgaaaggcaaaagagatgctttcttgcaaattgcgtgggtcgtgtctggctgtaggacctcggccgacactcctgacgagggcgcaacgaataaaggagcatttgttgtcttctgcgtgtggtgcacagttgcagtgttgcacaagggagatatctcaagactcgaggggcagtaaaggaaaaaaaatgtttcagcaggagaaagaaaaaggacaactcatgtagacatctatctggtctgaatttttcaccaatatctacaaatagatcccaaaaagtttattgtagaaatggacattttctcgacaccgacatacgccgtggtacaacatgacaacgctaatgaaattgacacctatttgtaaaagaattcaataaaatctatttgtaattaaaaaaaattaaaaataggtcatcgacgccaatgtatattattggcgtcgatgacctatttcatattagtgacttaacttccactagagggcaaggggagatgttagaccacgtgccaataacgttggcgccatgaaaatggtccatttttaaaataagttttttgggtctatttattaaatcagtttttttaattggtcaaaaggtgaaaaatccagcctacctagtactagtacattgcaagtgtactgtttcttataccttctactgtgcagctgtagcacagtacactcttctttagataatggaaaaatatatataatgcaacctatacattagtacaaatctggaaactactgtacaattaaaaaaaaagggcatatgagatgtgtttacgttactatgagtaaactttttaccatgataacatggataaatatcatacgtacatttttagattttgcggtattttcaggtttgcacttaatttttttctcagaaaacatatttggtacagtgcgagtaaagcgcgggagggggggggggttcagaaacttgaatgaactgagagtacttcggccgtttgggcaaccatgatatcgccatacttttgtccctccgatttcaggtgtactacactctaatcatgggtcaaagcctttatttggcaactttgataaattgggcctatgatagatggctagctagatgcaaccaaaaccaaatgggctttggttctcagttcaaggctcaggtggatggacgttgggccagttgagaagttgtcatccaagggcccttcacacggtatgggctgtagttggatcacatcaactcatgggccatcacctatcggtagtttggtcttaactcagcccatctagtctacttcggccacaaaacaccaattcaatgtgacgtgtgatagttttgcggtaacgccgtaacaatatactaccttgctaagaatgaaaattttttactccagaaagaattttccatgagagatatttctcgaactaaaggaccacgcagccatggttgctggcttgctgcttgtctgttcttgtacagaggtgacaaaatggtatggtagggccaggaaactgttggtgtatgtgccaaaaacgaaaacgaattggaaaggaatcaatgatggagatatgcttttgtcaccaatatcaaatttcgaatagtctggaatatcccactagctccagacatgctgaggttgctctggctaacattgttgtgaaaatgaaaattgctataaccttattctaaacctgattagtgactgattaattccttttcctgaaactgataaatgtgtgatactaagaagggatttagcatcaattattgagagagagaagaaaatggtgagaaaaccactgttgagatctgagaaggactcgaaagcagggcagctggccagtggctttgctcttgatagctttctatatcgaccgttctcattagtgactgattaactggaccttttgtttttcgacatatttccagtgaatagaaatgctgaatgcctccagatattatgggttctggctagattttctatgagctgttgcattttcttggtcatgtggtcatgctgctgttctaaaacaaaacagagtttctcactctgtccagtgtccacatataaaaacatgcagccatcatattagcatcaacctgaccaacaaatataatggcactgaatcatttttatttcctcatcctttttattcattcctcccagagagacggatccatggaagttttcttgccctcatcaggcaagcagagcacacacacacggtggcagtggaagtgctatgaacaagacgctaatcaacatccagagctaaaacaaacaaggggatcaaagcaaatcccgaaaaaaaaaacacaggggaaagtccacatcttcttctcgtccccaacgcctccgtgtcaccaccacgtcttgcggatttttttttaccctgttctattcgctcaggcgtccacgatctcgccgtcgtccttcgacgccaggatcagctccgggtgcgccgccgccgccgccgccttcttgatcgtgccgtcgatggcgttcggccggccgagcgccttcagcgccaggtgcgccgccttctggccggagatcatcatggctccgaacgtcgggccctgcaacaacgaatttgttcaattccaagaacgggggagagattatggtgaagagtttgatgtttttttggtgcgtaccattctcggggcgccgtcgatctcggcgacctccatgccggtgacgatcatgccggggacgacctcgcgggtgaggcggacgatctcgtcctcggcggtgttcatgtcgagggcgcgcatgccgggcacggcgtcgatcatgccgatgtcctgcagccgcttgacgcccgtggcgccgaacggcccgtcgtggccgcaggagctcaccaccaccctggactccatcacgttggggtccatgcacgactgcgtgtcgtggttcatcgacaccagcgcccagttggtgaccacgccgccgacgcggccctccttgacgatgaggtcctcgacggcgacggcgttgaacagcttcacgttggggcgcgccaggaggcggctcatgacggtggaggtgaagagcgcggcgtgcttgatgacgacgtagtcctcctgctcgtcgtacgcgacgccgagctcgtcgaggaacaggtgcgccggcttgcgcaccaccatggcggagaacagctgcccgccgagccacgcgccgccgccgggggacaccgactgctcgatgacggcgacgctgacggaggggtccttggagagctcgtacgcgcaggagagccccgcggagccggcgccgacgacgacgacgtcggtgtcggcgtaggtgatcatgtcggtcatgtaccgccgggtcatctcgcgggacacgatggactccttgatggggctgaacctgatggcgttgaggtcgtaggggggagtggacgacgacgacgagatggagttgcagatggcgccgccggtgcgcggcgcgacggagacggtggggttgcgggcggcggcggggaggcgcgcgccagcgaaggaggtcttgaggaggctggacgcggtggtggccatggctgccatgcgagaggaggaggagatgagcttcttgctctgggatgaggagtgtgtgcgtgagtggatagagcgtgggttggcgggggtataagaagaagaggagagcgcaaatatctgggagtgccgtccacgtgtcagcagtatgggcctctgggtttcggattgattggaggagatattttcggaaggtttagtgagggtttttggactgtcttcaggagaacgggacaagtgctgctaagtcacggactcacgggaacagtggtgctgtgttcagtgacagtgtccgtgataccgtgacgactaaggctgtgtttgcaatcccacgttcccaacccctctccctcgttttccgcgcgcatactattcaaactagtaaacggtgtgttttttttaaaaagtttctatacaaaaattgcttaaaaatcatattgatccatttttgaaaaaaaaattagcaaatatttaattaatcacgtgctaatgaaccgctccgttttccgtgtggaaagtttagctcccaaacttcccatatcggaacacaacctaataatggtttttggtgatcgattttttttatggctacctgtagtgaggggtactagtggtggagcccgggtggtcactcgacctgtacaggagctggctttgtcgctgactgtaataacatatcgagaattttttagtctgaaagaaatccaccataatatgttgttgatatcgtctaatatcgagaagtgcggttttaacttcttgtcacgcgttggtaaacctaagtgtctgtccctaagaaaactatctttgccaacttcttgatggatcgccttgactgttttgttgcacgacagtcgttgggaacaaagctcatcttcacaaattacatggaggcatggggtatactagtggtaaaggttccgggggatgaaaaccttctagttttttgggtttgacgatcgcgagcggggatcgcactacatgtttttgttgagcaacaatcatcgtttatttgttgaagttgtcatatttaggtctttggacgtagatctaggtctaatttcatatgatagcggctatctctgtttatgatagtaattgttttcccgaaaaaagttgctttgttaatatatcctatcaatcaattgttttaatttctctttttttctaaataattcttttagaacttagttgtatttctctgttttttttcctacatctttgttcctaataaaagatgagaaacacccaggggtctttcggctagctccacaaggtggtgggctagacgacttgggttcgaagcctcaacccttctaattatttgatattaggttattctctaatattcgcgttcctaataaaagataatgatacactttcagggataaataatggatgttttctgatctggtatatatttttttcctctcgaactaatctgatataaacgaaaagagacaaagtcatttttatttgttttttatcattgcagacaagcttaaatgatctacctaatttgaaatgtctcacagatcaatatgcatgatattgattataattagaatgattttactacagggacagtgaatttcataacttgaggctagtagatggtagcttttcttgcactgaaaaatctctggtaaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacagaggtatgattttgacttcagatattttacagcgaagtagtctgagtgggtttaaattattttacttttcttttttggaaatatcaaacctgagaagtaaaaaaaacagagacgaagttaagttttgagtgaaaagcacagggaaaagaacttttttttcttttataaagagaactacattcaggggttgcaaggtttgttttaagggtaattttaccatccttgagaaaaatactgggtgataagtttgggtgataagttaaagtgagttcaaatttaccctttcccaacttctgctctttcgtttttatgcacacatttcttgaactagtaactatatgttttttaaaatcttctatatgaaaattactttaaaatattatattaatccattttaagtttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacatcaatagacgtgaagtagatcccttttaaatcctcttctattcctttaggtagtgtttggttgcaagaatgggatgagatgggatagaatgaacccacttttaggggtgtttggttgagaggtgagtgggatgggatggtccttggagaggaatatttctctcagatccgggatgaaacggtccgccaaaatcggccggaccaatccatcccacttcgacggagcccacggcgttagctcccgtagcctcccgctcggctccgccgccgcctcatccgcgtcgacctccgcctccgcgactggccgtcacctcgtccgcgaccgcctccgcgaccgaccgccgccgctcgtcgtcagctcccacagcctcccgctcagctccgctgtggcaccgccccggctgcccgtccctcccccggcaccgttccctcccccagcgccgctccgtcctccttcgcctgctccctccacctcgcctcgcctccacgaccgggcgccgccttgtctgcgactgaccaccgtcgctcgtccgcgttcgcctccgcgactggccgtcgccttgtccgcgactggccgcccgtgctcgtctgcgcctcgtcgcctccgggaccggccgccactcgtatgcgcctcgcctccacgaccggtcgccgccttgtccgagaccgnctcccgggacgaccgccgtcgctagtacgagcgtcgcctngactttcctagnctncacgaccagtcgccggctagtccgcgaccgaccgacgncactcatccgcgcctcggctcacctcgcctncgcgaccggtcgncgacgctcgtacgcgcccgcctacgcatntnctncgctcacgccgacgagctcctccgtccccattctcaccactctctccaacctagccgttgggagcggacggacctaactgtccgtgaaacattgtccatcccatccgatctcaatcctttctaccaaacaaaaaactataaccatcccataccataaaccaaacacacaactagaaccattctatcctaaaaaactaggataggtctaacccatcccacttggtcaccaaaccaaacacacccggtggggggtaaatcaaccagacctacccagcctacaaggaaattcggatataagcctaaattttactacagaagaaattcttgggttcttcaagatagctgcacaacctgtatttcagtccttgcaaggagctatttgtcatatacttgtatagaaagcagggttgagaatatggttcacttggtgtaaatagcgcctacgagaacttgggcctaacaaaaagtgcaacagtttgtgtagcggttaattttggcccatggtagcggtccagatggtagctgtcctatttctatagagaaagtctatactcactcttgtccttaatcggatcgcttccctcaaccacaaaaccaggtataacgtcggagcttgctatctcgtgcgcgcaccaacaactaagctggcacgcgtgccggctggcggcccacgcccctcgcctacatgcgtttctttttttctttttttttttgcgattttctcctattttcaagcctcttatcctaggcgcgttttaatttctttcgtgttttttctaatttttttaatctgcaggcacacttgttttcaaatctttaagttgaaagattttaaattaagttgaaagttttggaatcttgacttgaaagttttccaatctaagctgaaagtttttaaatttcgagttgaaagttttcaaatccgagttgaaagtttcaaatttgagttgaaagtttttcaaatttcagatgaaaagttgaaagtttcaaatttgagttgaaattttttaaatttaagttgaaagttttcaaatcttaacttgaaagttttccaatctaagttgaaagttttcaaatttcgagttaaaagttttcaaatctaagttgaaagtttcaaatttcagttgaaatttttaacatttaagttgaaagttttcttgacttgaaagttttctaatccaaatcggaagttttcaaattttgaattgaaagtttccaaatctgagttgaaagtttcaaatttgacttgaaagttcaaatttcaagttgtaattttttaaaatttgactttacagtttcatattttaagttgaatttttaaatttcaggtatgttttaaagttttaatataaagttttaaatttgattttaatgtttctttcacgtgtagatttctttcagcctattagtaaaaaaatacttatagaaaaaagaaaaaaactaccttaaattttaggtttgtttttaattttcaatagaaagttttaaattttatttgaaagtttctttcatgtgtagatttctttcgatctgttagtaaaaaaactcccagacaaaaaaaaaacttaccttaaatatcatcaatatccaagactagacagagttagttacgagagttagttacagtagatgcgcgcgtctcccggaaaaaggaaaaagtccgattgcggattgggtgacatcgtgtgtgtgctacttctcttcccgacgtgtactcacggtacaagaattctgtgtaacgtctcccccaactcaaaaaaccggtgcaaaatcgattcctcgatggttcggtaagaggttgtgcggtgggcctcacctatcagttacactttttccccttaccccacctctccctctctcctctatcctcgcagacacagtagacgagataggctatagggaaagcggctgccgccgaggaacaccggcagtagagacgaaatggcgcatggaggaatacaggagggcagagaatgaaattttaaaatatgcactattttcctcgattttgtatatatatatatatgattttgaaaattttacagaaatatacatccgcatcaccgtgccgtcggcgcagctcgaagacgcgccgcagcgccaacacacgtgaccgggacggtcccgtgaggcccggcgccgcgtcggcccgttcctctgatgcacgtctgccagagcctggcagtggcgcagaactggcatgcactacgtgaatggtcagcgtagcacagtgatgcatatatagcatagtacagactgcattagcagcattaggaacaagagttttatttgattccgcttgaccattccgcggaaccgcgacctagtctgacgtttccacatcatgccgccgtcactcccggctgctaccacactaccacctgtgctcgggctggtggggacggcagtggtggtgatgagccggacgctcagtttttgttgtgactagggaagtaattaagtttttaaagcaatatcatccatgtatgtaaaggggtttcaagagcatcaaagctggaggacagaacattgt

SEQ ID NO: 78530 - DNA, 2853 bp, Oryza sativa
cgccacacgtcaacgggaacgccgccaggaggccaagagccgtcgtcctctctctgcggctggaggcaggagattagggttgggtagggttgtggggattttttgtgctttctaaaaatctcaaacaaagtctatcttagccctcccataggattagaattttagggggtattaagggggctctaatggttcattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagggggtagtggggtctaaagaccccctgccccacccccacgctgtctccgccatagattgtacaatcggctgcttactcctaaaatatcatgtcagtacaatactaaactattgtatagtagtccttatatcatatcatgctctatcctaacagtgggcattgtctgtcttggagtgtgtgtagctagtacttataggatccatatatagtactccctccatcccataatatagcaatctagtaccggatgggacacttgatagtacaatgaatccagacatgcttcctgtccagattcgttgtactataaagtgtcacatccagttctaggttactatattacgagacgaagggagtatatcatgcatgcatgggtattaaatgtggggcctatgtcaggcatagcaccccgtgagaactggtgcagtgtataaattgacgaaagatattatcacggccccatatagattaaaacaagataaagaaaaccagtcatctctcttcaacatactggcaaaagacataatttgtctgacatgtgggctcggtcacattctctttccattagaattggactatgattagtacccagctcttgctcgagattggccaaaaatgataccatgcacggtgtatgggtgtggctctatcttcctccccccccccccctctctctctctcgtagtgcctcctctaagtgcaacactgcatatgctcttagtcgctggtctgtgttgtctctcctcaagtcccatctctagcttacttttaaaaccaatgtggcagattttcagctagcaattatagttggtacttgctcgtaaagtcataagatatccataagagcagatttctagattccatgattattggaatcgtttaccaagagtcgatgttaaactactaaaattcagtgcgcggaacgtacgtttggaattttgtatcctagcacacatgtaaggccaagggtactctgtccaagagatgagagcaaatttttgtaactttgttaagcaacgtccaactttgacgtttcccgagcaatgtgtgcagttactcaagacttggtgaaatttcacctgagaaacaatctgtgtggcttggagtgggatctggtggaagtctatggcgcagcccaggtacaagcagctcgctttggtgagcaagcacactcacattaggacagccagaccataataatgacatgttgatgttgggtcgaatgaaaactggaggaaaattaagtaggctaattgtgttctcaaggaattttcaaattaaaaatagagcaattcatcgaacaaaagattaaggttctgtaagtgcattttggattgcttgaaaggaaaatttccttttgaaggaattctagcataaggtctaaccaatacaatattagtttcgtttgattatttaatattattgttttaaacaataaacatagttatgcataacagtcactaatattaggctcttaaaattgccactaaggcaaatttctgtggtatagcaaaggaagagtagagagaaaagtcgatgttgagcttaacatcgattattgatggctttccgtgcgtattgattgcaaccatggtagccacacaacgaaacactcgagtaaaagtaaaagaaagaaagttctagtctaacaggtcgtgtacatgacaacggctgatgtttgtgtgtactagtccaatgcttcttcctacaagttagttttaaatcaatctagtactccatctgttctatactacgagaaattttagagttgtacatgattattaagaaagtaggtagaagtgagtggtggagaattgtgattggttgggaagagaatgttggtggagaagttgttatatttgagacaaatcctaagggctaaaagttgttatattttgagacgggggactatgagatatggtcatatgacatatcctagtacgacaaatttaatatcacatctcatactaggttggtttattttgaaatggagggagtactaacgcaggaaattctaactttgcttcttcctccataggtgttactgctagccacacattcactattcactattcctatataattgtccccatgagctgtgattctaggctaccacatcatcttatttatttcaaccattacatcaacacaaattttgacaatttgaccctttgtaaaaactaattttacaaatgaaccgcggtcaaaacttatttcagaaat

SEQ ID NO: 78531 - DNA, 67834 bp, Oryza sativa
  unsure (1)..(67834): unsure at all n locations
gatagtatacattgctgatgcccaggtagaggcgtcttaagacatgccgacatgcatgtacctctcctctactcttgcagttgcagctgatcctgtcaagctccaccaccaaaccactttgtcctgtaagctcatctttcccacggttttcactgcccccactgccgtccctacatgtatacacaataaatcagtatgtcttttgatcataatatccaacatgtactgttattaattaacaatatgctactgtaggatgtagccgcaaaccgtgccatccttctcttattatatggatggaggtcttgagcatgaacagtgagacgtacaagagaccaattcggatagctacacacaaagacgtcgtcgatcgtacaacttttctccatagtttttaaagctacacacccttagaatcatcagtctctttcttgagcaacagcacacacgccagaaatgccagctgcccggccgacattggagtagagaggagtagagagcaccaagtcgtcttcttccccccggcaatgcaagacgacgtcacgacgaccctgctgggaaactagtgctccatatacaaatgtccagaaagaatcagttcggtcggtcagatccacctgatcgatcgagtagctctgaaaaagcgagaattttatcgttaaattattccaaaggcgcgtggcggacacgcacgggacatggatctcgggcctcggctggggggatgaactaattgtgggtgatcaaacagttgtagcgatgaaataatttagctgcaagtggaggtcagccaggctggttttcatctgccattctgcgttcacgcgggcgacggcaatgcaactgccgatgtcattgctcacattagcaccggctctttttttctaaagcttaattggttctctgaatttctgagaccacacggcattcgattattcgatcgatacatcgcttactatgggcgatcgagttcatgctactactgtcctgctactctctccattttaatttgtaacctaagattgaatgaaacttaacctattatactacgaatgtaatataaacataggatatgttcatattcatagtagtacatattgagtatcatctgaacttatgatactatattatgagatggggttaataatatatatactatctccgtctcaaaatataccaacataggtatagatgaaatacatcttaacactacgaatctgatatatgggctatctaaatttatattattaggatgtgtctcatccaatagtaagaggttttagcagattataggagtataggtcttttgaaaaagttgatgtgtgctttgatttgattatttaccacaccttctgaaagcaaatttaccacttgcaagaggcctgactagcatgtctgtcaatggcaggaaaactgatgtgggtaagtgcgactaaccagctgtaatcacgaacatcgatcacgactagataatgaacgtacgtcgacaaggaacttttttcaaggcgagtgatgcatatgtatgacatgtacgtccattcagaagcgtgtgctgtgagagttttctgcagctcgatctacgatcgatatgatcgaatccagagtagtatccaacaggcagtgccaatactgtacgcaagaccaaattaaaacgtactcatatccaacagcagcagtgtactatctctcgctgcaaaccatgacttctttctaatctttccagttgcaagccgatctactgataatataactaacatattgcatacgtacgtgaaataacgttatccatgcttagcttaattcaaagtttgtttttatatatcaagcaggtgctcattgacattggtgagaaggacgtagaagtaacggcgacacaacaaaattagtactatacgttaatcttgctccgatcctctgccgccaccccttcatttctatacccaacattactttcactagctaagcatctactccctccgtttcacagtgcaagattttctatcattgtccacatacatatgtttaaattcattaacatctaaatgaatataggcaatgctagaaagtcttacattatgaaacggaggaagtattatttttcatatatatctgcaggcagcaagcgtacgcataatcacagcttaatcagccgacatgaaagtatttaatcatacagtaccacattaattaatctcccgcgaggaaacatctatcccggtcaaagcctgagcatgtacacttaaatatagttaattaaactagctagctcctccgatcctcttaatccatcttcataaaaattcgtgcaaaagcatacacggcatgcactgttcgtccgtacgctgccgtctcatttcgctttcgtagaacttgctccagcaaacaaaccctgctataaatatgtacaccatactcttcgtctccactgcaagcaaagctagaaaaaccaagtgaaaacctcaaagctaggcaccacgcgtcaacgcatcatctccttcaatcgtctccttgtagtggctagtgtgctcgatctgagctagctttggtctctttgccatgggaaactgcaactgcttggagagggcgagggcgaaggtgacggcgtggggcgcggaagagggcgacggcggcgaggacgagttctggggcgccacggcggcggagttctccggcggcggcggcggcggggcgcgaggtggtgtaccgtcgacgaggaagaaagagatcatcaaggacggcggcggcggcggcgagggttcttcttcgccgacgaggcgcgtgaagatccggatgaccaaggggcagctgcggcggctgctggccggcgccgggaggggggcggccgtcgaggacgtcgtcgcggagatcatgagcatgggcgacgtgcacgtcgagcccgtgaaggcggaggagggagncgacgaccgccggccgccgctgtcgccgtccaagctggagccgatacaggaagacatggacgagtagcaggagcagccatggaggaggatatgatggagatgagcgtgagatcgtcggatggatcgatcatctggagatggacggtggatgtttcttcaccgattttgcatgcatgctggcctgcctgtttgttttggatcttgtttgtatcttttctttgctctagttaagttttgtaggacgtacgtatcatgctatattagaggtagaaattaggggatatgtatatactaatagatgtgtacgcgactacgcgtgcacatgtacatttttgtactggtatatgtgatgatatatactacctccgtttcaggttataatacgttttgactttggtcaaagtcaaactgtttcagctttaactaagtttatagaaaaaataataatattttcaacccaagataaatttattataaaaatatatttaattattgatttaatgaaactaatttggtattataaatattattatatttgtctacaaacttagtcaaacttaaaatagtttaactttgaccaaaatcaaaacgttttataatctgaaacggagggagtagcatattccttctgtgttttttatatgggaaatatctagtgataacttcaaataagtgaaataccctgtgaaaaccatgtctagaaagttatctcaattttcaaaaaaaaattactaaagatagacataggctgataggcatgaaatatattaacgtaacaagctaataaaatagcgtatagcgggttgataacagattatattagtgtctgggtagcggatgtaagctccaataatgaaattaatgaaacaaccttaaatttagattggactatatcaatactaacataagtttcacttaaaatttataaatttagattacacacttaattaattactcatacattacatagcataaaaaaatatgaataaacctatagagggaaaagataaagaagatacaccacgttaagttttcctatccatacgaggaaaacatcgttacatcttggattaatattgccattaatcacaatcctaaataggggtttgttcgtaaattttcatttcactactgattacaatgcaaaactaagggtctttttgcaaacctttggatcgctaccaataattgtgatacaaaatatgggaaatatgtaatgtaaactccctatgtagtgtaaatatgtaatagtataaactccatatacagtataaatctgcaaactaccgtttcatcctatggtagtttacaggtttacatcatatataaagtttgcattatattttttccttacaaaacatgccctgtttttttttttgatagaaacatgccctgttttttatgaaaggaattgaatttctgtcgttttatattggtaggaggagataaaagaaaaaaggtttacagttttacatatctgttacatgcagtgcaaaggaaacaacaaacatctttcgccaaagccatagacaaaagttgtgttttcgaactagtagattctatgtgctaggccgtgagcgtcgaattcttgcataattacaaaatcaacctgctcttcattttggcttgtatcttgaaaagttattctattcctctccagtgagatgagacactcctttctcatgttgtctggtgactcttgagtttggtcagagctaatcactacctattttcccgcgctacgtgtcgaacgtccggagatttttttgcaaatctctggacgatgttgcattatatgttgaaaaaatgttgcaatgttttattgctcgaaaaaaaaatgtttcaatatgaattgttttttgacgttacatctttcactgaagatagtttcaccgctttatcaaaaatgtttcaaacgaatgcagcacttaagaacgctgattgcaacgacaaaaaacacattaggtgcaacattcaaagaaatcaaatgcacagaacttttgaggaacatctagaaaacacattactgatttaagaaacgtattgaaaagacagattgcaacatcacaaacacactgtgtgcaacaaaaaaagaacacgtggtgtgcaacaatcctcgctagctcgaccttgtccgagcgccgccgccggagcccaggcacgatgaaggtgtgctccgtcgcctcctcccctcgagctgccgtaccgccgcgtcgtcctcgtccgagcaccgccacgctcctcctctccggcaccaccaccgcctcgtcgcaccgcgtctacccacttcgtgtcgatgctagcacaggcatggagagaggagaggaaaattgatggttggaaatgaggataaggttgactgccggggaaagaagatggagagagtagttaggtaggagtgggacccactaggttagcgtccgattttttatcgcgcgccggccgacgtacgagttaaagcattttcgctagaaaacaaggtgtattttgtaaaagttcggatcgtacggttccaaaatacctcggcccggcccatcataaaactttgagcaggtcaggtaagcgcatacgtcaacctgggcctcaaaagtttaatggtccttaacttggaagacccctcctgcccatcccggcccggcccatgatttcaccatccttctctgccatcgaccggccacgctcccactccgcacaccgccgccgccgccgccgccgccgatgacgacgaccgccgcgctcctccacctggtgatcccaggttagcgatctctacgcagtacccaggtatgcttcgttctctgttcgggccatctttctgcctctccaaacccctccggacagacggatcggagagctaatacagaaggagaaggggggcaatgccgaatgcgtgacggagatggggaaatctgattctggaaatagctatgggtaggagcggagagagtgatagcgatgatcccccatcgatgatcagtatctaggatttccagttcgacagggagatgcagcctttttcagaagaagcaactttgcctgtgcgaagactggagccagaaagacacacagcatatggtaggttaagtgatcatcagttcatcagtaggatttagtttataggatgattaccgattgcatctcattatctttgaattgtgtgtttgattaatttggatactggcacagggggcaagcatcatgcatcatgcttccgttttattttcccttctgtattctgaaactaacgcttagcattatgttcttgagttcttccattttatttttccttttatagctcataaccattatctatgcagatatctgttacgaataattcggattccttggaacacctttatgtaagtttctcgagataccaatttggttttatttacctttttaaattacaggaaggaactgccaacagggctgtttgagaaacacgtatcctccctccaccaccaaagtttgattactattgcttaatttgatccaaagtttctacatagtatctttgttttctttttctcgtatggtgatctaatgattgggaaaaaaatgaccagtagataatgcaaaatcagtcatctgatcaaaatttcaagtaattttcaggctccttttttcttttcgaaactgaccaacgtttttcctcagtttgttgagtttttttagataatggatttttcattaatccggtctctatatccacaaagatatacacaaccaaaacattacacgagttcttggactctaaatctcacacagaaaaacacactaacacaaaagagaaaagctagaagacttagcttcaaccttcatcgaatacttaatctatccaaccaagtgcgagagggggaagaggagaaacagaactagtccgtgctacccgttgccgcaccatctccgtctctgtagaactcaaccaacatatgctgccaactgctatgcctaatgtcctctgtcgctgtccaaaaccacttacgccgctgccgcattttgaacgcccatagtgcgtcacgaagccgccttgctgcgttaccaccgtcttccgcacaccatcgaactcaccgtagctcctagagcatcgtagagtcatccagcatgatatgcaccttgcctttactgccatcaacttgccaaagatgctccattgccgtccacacctatccgcaagcagaccttgacgccgacgctcacgtggcagcttccccctctaggacgccgccactgagaacctccgttgccatcatccttatctgcatcaagcaagtcgatgaccatcgcaccattagcccggccctgtcaccaagatatcgacgaccaccatcccccaccctcgcttggccgtgaacagaacggggcgtcggagctcgccaagtcactgctgcccctaggacgccgccatcgagaaccttcgccgccgtggtcatagactgtcgtggccacaccacaaccatcgaccaccaacaccatgctgtcgacctaccatcacgggtggagggctagcctcaccactgtccatggccgccggtggcagagtaaggggtggatgactagcctccgtcaccttccaatgccaccgccgcccaccaacacgccgacgcctcctgtacatcctagtcgccttagcaatcacgaccacacatcaccggagcaccacctccactatcagctccctcagccaccaccagcaccctcaccaccatcgcgccggcggaccgccaacgggcgtcaccgccatcgcctagccggccgcctaacgggcactgccgccaccaacatcggcacctccatcaccgttcgccggagcttcaccgccaccgcatagacgtccaccagagcgtccccgccacctcctggccggccgccaacaggccctgccaccaccaccatagcgttgctcgccagatcgaaagttgacccaccgcaccgccgccatcccagcaggcccgcacaccggcgagccgctctggcggcggcgaggttgaaaagcggcggcggtggctagggtttaatgggggagaggaagagtttggtttgggggagaggaagagtccaatcagtttgttgagttggcaatcaaaagtggtaaaatagaaacaatatggtagacccggatggcaaatagtgttatttgagaatgcacaattgagaagatgacaaacagtaaaaaaaacttctaaaatgcagagatctctaccacatacttcctccgtttcacaatgtaagtcattctactatttcccacattcatattgttgttaatgaatctagataaatatatatgtctagattcattaacatcagtatgaatatgagaaatgatagaatgacttacaatattgtgaaacggagggagtatatagtactgatttgttaaagggtgatccaaagcaaaccatactagtaagaaagaaaatcacacacaccccacacaggactcatatatgtccaggctttcaccggaccaaagatatgcacgttaattatattcctagtaattgacgacggagcacttcctccggacctcgccatcattccccggcggcggctggaggttccccatattcaccatggcctcgccgaagtcaccgaagaactccatgtcaaagagccccgtcgcgtgcttcttgacgtaggctccggtgaagtcgtcgtcgagcagcacggcgtcggaccggaacagcccgcggcgccgcgcgacctgcgtgtagtagcccgtgtcgaacttgggcgatctcttgggggagatctccaccatgacccccgggttgtcggcgttggcagtggcactggcagcggcgccgcacttggaccggagctcgttgaggtaggccgggtcgagctccgggtcgacgtcgttgagcctgttcccgccggtgtagttgtagaggcggtcgtggaacggctggcagtgcgagaagccgatggtgtgcgcacctagaatggtcacgttaagtaattaagatcgatgattgccgcagtcgatctgatgataattgatgatatcttgtggcggagctgcacccgataggacgacgagatccttggcagtcaagttcttatgggcgaacgctgcttgcagctgtgccatgcctgaatttggtggcgggagatcaaccgtctcggcggcgttcgatatttttccatcgagccgcccagttggtacaggccaaaacgggccattactctgaattaggagtgcacaaaattatatttagttgcatcatatttgtatgtactccatctcatagccgttgctataaactcgagtgctttcagattttagttctgcgttttctgattaggccagctttaacagagaaatggccttataggattttttttttccccgatgttgtatgccgcatgcatgcaggatggaaatggccggtaattgtggtttagggcctgttcactttaatgttattttcaacattactaaattttggtaaagttacttaaaaaaaatggctacatttagtttgctaccaaaatttggtaactatctaagaaatcctaccaaaattttggtaagttgccaaaattttgacagttatgctaaaatttggtaaggttttttttaacatcaaagtgaacatgcccttaagctcgaaatgtgtcccacaacaactgagatattgagtcgcatcaagatagctgagttacccaatgaacagcgtccctggcggcaagggcgaggatgtcagcacacgaaacagtcccaggacaagcctgctccagcttctccttgatgctgtcgatgacgtcgaaccctctcaggcctgcactcgtttcagcttctttctcggcgtcgacggcgccgccggccaccgagtccaacaggatcgacccgtcgcatccctgcttatatcacaagcacacacatgagtacattgacacatatcaacaccactgcataagcactactactcatctacaatctctgaactcagtatctactcaccctgacgaagcagtcgtggaaatggagcctcaggagagcgccggcgagatacggcgccacggatagaacagatgcaacctcctgcctcacggtctcttctgcgccgttgcatgtgtccccgtaatacccaactttgagctgtgcctgcgcagcgctggacgagacgagagctgctgctgctgctgctactaacacgacaaagattgctgccatcatcagggggcttcaattcctgagttatatatatgccccccagaaatttgtgctaatcgatgcaggatcgatcgagcactactatgttgcagcttatataggcagtagatacgttgacaaatcacaaatggatcgaggctggagtatcttcagtaaagtacgggctagctagctgttggaaccaaaccaagtactatcgtacatcgaggtaattgaatatgatgtattctttctttcggggtgccaaattgctagtttcatagaacttgcataattgggggtacacaaatgtcatcacttggaaatgatttttattatacctgtcgagcgtacagtgattatggttgtgcattcttacatataaatatttgtttattaacatcgagctgattgtcaaagcattttgtttaggattaactcaataattctcacacggaaagaaataagatggaagaatggcataaagttagttaggaactgcttaccgttacaggcatatatataaatatttgattactccaccccctctttgataagtctgtcgggcgcttggccgcctagagaggctggaacatgggaatcgccgggagaattacattcgtgcaaccggttctctcctcgcaaccggtatacctcctaaccgtgctagaagtgcacaacgagtcactggaggtcctagacaagcagtgcaagcattatttcctccgggcgggatgtgaaaaccttatgagaggaaaatcaaggtcaactcgacaaaaacctactcccccatcgctaatggcgccctaggagtgctcgacttggtgaagttctattgacggaaaacacggcggtctgaccgatgacatcatgctggtcggcctctgggtgaaaaacccgagccgccagagccgcagctggtcagaccgagccagcagcggtctgactgagccttggccggtctgaccggccgctctatggctgtctgatcagtccccgtgtctcagtgcatttaatgcattgcaacggctagttttctagccgttgtaaagtagtcaggtctgaccggaagtgcacttagttggggattttgaccccaaacggctagttttgtgagtgggagtataaatactcccccaccaacaacaaaggggctctcttggcacttgcttcacttacatacatcccttgcacactctctcacccactccagtgcttgtgttcatctatttggtgtgattgagggttgattagccaagagtcaagtgcgtttgcttcattatagagctagtgtggcacttgatcatctccaagccaggtcatcgcttgttactcttggaggttgccacctcctaaacggctcgtgaaggtgtttcccggtaacctctccaaggagattgtgcagaaggcccggcgcctgttgtgagtggtttggagttcaccaccttcggagtgaatgaagaactacccttagtgatcaaggcttgggtagtccacttcgtgggctgactccctccttgcccaccccttgacgaagagggcttgaggtggcttcgtggttttgaacggtgaagttgggctcgcctagaaaaccggcgagtttctgaaccttgggtgataaactccttgtctcttgtctcatttacttattgcatttacatttgtgcaatttactttaatagagacatatttgagcccatatcaccctaggattgcaaaacttaacttaggtgtgcaatttactttcacatagacatatttgagctcatatcaccttaggtttacaaaacataacttagttgcgtaattaactttgtacctcaccaagcctagcaacttaggttagttttaattatgtgtcgtttagttttaaatcgcttgttcacccccccccttcttgtcgacatcttgattctacagggtcagggacaaggaggaggaggcgttgttcccttcgcgcggcgagggcttgacaataaggctgttgatgaggggggcgcaagtgggggaaggtggcggcggttgctgcagcacggtgtcggcgtcgatctcggcactggtggcgggggtcggggatgagcacgccgctgccacggcggcatccgaggaggaggaggcgtcgttccccttgcgcggcgagggcttgacgacaaggctgctgaggggggcgcgagcgggggaggcggtgttggtctcggactccagcttcggctccggcatcggacttcctcgctcccccgccgccagcgtgaccgctcgcctccgccgccgccgctaactaggaggcgtcctgctgtgagtctgccgccacagcgttgctgcttaagcccgccaccctcgcgccgccgcttgaagaaacgggagatggggagagaggaggaagaagagatagggtgagaatggcatgtgggtttcacgtcgcccccaccattttttattaacttttttggtgtaactgacatgtggggttacaatttttattattttctaaatcaaattgccacacaagcaccatgtcaaagctacgttatatgaagaccgagtcaaattagccacgtaggcgccatgtcagctaaaactgtcatccaaaccgtcttgggacatatatattgtaccggttttgatatttgagggacccgttgtatctggttttctagttgaaggacaaaaatcggatttgttgataagttaagggaccttagatgaacttatttcgtaaaagttcggatcgtaaggttccaaaatatctcggcccggcccatcaaaaaactttgagcaggcaagtgcatacgtcaacctgggcctataaagtttaatgggctttgacttggaagacccttcctacccaacccggcccggcctatgatttcaccatccttctctgccatcgaccggccacgctcccgctccgcacaccgccgccgccgacgacgaccgccgcgctcctccacctggtgatcccaggttagcgatctgtacgcagtacccaggtatgcttcgttctctgttcgggccatctttctgcctctccaaacccctctccggacagacggatcggagggctaatacagaaggagaaggggggcaatgcgtgacggagatggggaaatctggttttggggaataggtgtaggtggcggcggagagggtgatagcgatgatcagtatctaggatttccagttcgacggggagatgcagccttttcagaagatgtaaactttgcctgtgcgaagactggagccagaaagacacacagcatatggtaggttaagtggtcatcagttcatcagtaggattcagttcaaaggatgattactgagtgcatctcattagctttgaaatgtgtgtttgattaatttggatattggcacagtgggcaagcatcatgcttccattttattttcccttctgtattctgaaactaacgcttagcatatgttcttgagttcttccattttattttttccttttagagctcataaccattattattcgattatctatgcagatatctgttatgaataattcggatgccttgaaacgcctttatgtaagtttctcgagataccaagttggttttatttatctttttaaattacaggaaggaattgccaacagagctgtttgagaaacacgtatcctccctccaccaccaaagtttgagtactattgattaatctgatccaaagtttctacatagtatctttcttttctttttctcggatggtgatctaatggttgggaaaaaaaatgacaagtagataatagcaaaatcagtcatctgatcaaaatttcaagtaactcaggctccatttttcttttcgaaactgaccaacatttggttgggattatatcatactagaagaaagcaaagactacataataacaagaaggagtcagtcttcttggcacgctcctgccaaaataaagttgcaacatattactgcgattactcaggaatcaaatatcaaatatcctcgtcatcgccggttagtaggcttgccagtccttttaacctcctgtttaccatgcccaagtttcttcgtgatccggtcaatgatgcgtgccgttgtggattcctcatcacggaacactctatcgtcccctttctttccaaatcttccaggtgatgaagactgatgtggatgaacatggatttaaccccattcttctcacttccacagtaatttgcagttcctgaactcccaagtaattttcagttcctgtactccactagtgaaggggatttcactcaccaattttcgtcgggcaagcttaggggcccagccaaactggtcctatatatctctctgctcttaggccacttctattttctttcattttctatgaagtgcccattcttttttccgactgaataaagcttagtgcagttggagcaagggcactcttatcatgccacatggtgatagatagtggtgtcacaatcgatttcctcacaccccacccagttctcagccatggacataaaagagcagctagctagtagcatgatgaacacgagaattaagaattatatagatactgctgctctaccaccctctttggtgcacgttattattcagagttgaaacgaccacttgagatcaatcccttttggggttttttttggctccatgataaagaaagagatcagaaagcactgcaaaagtgccattcatttcgtgctcgttgatcggtttcgttagagcaggtacaatagcaggctataagccagctataaacatattttaaagagataaaggaagacagagaagagcagcgggctacagatctgtagccagctgcagcacggactacaagacgtaatatgtgtatgacaggtgggaccaagtattaatagtatagtaagcaactattgtatgaattggctattacattggctatagaagatttggagctagtagtgggctgcactattgaccttgctcttagagcaggtacaatagcaggctataagccaactataaacataatttaaagagataaaggaagagagagaagagcagcgggctacagatctgtagccagctgcagcacggactccaaaacgtattgtgtgtacgacaggtaggaccaggtattaatagtatagtaagcaactattgaatgaattggctatagataatctggagctagtagttggctacactattaaacttgctcttatcgtgctgcacgaaaagcgccatggaagaaaggcaccatgagcatacctcgatcgcccaggcgttggttttatcagtcgacctgcaatttcagattctctgaacctttctggccggtcgaattctgaattgtctccatacggccatagtggagcacttggattcgttggaggacaccggccgtttacttggtaaacagtcactgctcactgctacatatgccaggtaaccctgtgtgtgtagcacatgaaagtaatggagtctgatctgtgtcactgtgttctgtgtggcctgtttcaggaaatgaccttggaaacagtctcttatctctgcgaaaatccaagaaaaatccttagagcaggtacaatagcaggttataagccagctataaccacatatcgagtagaaaagagaagagagagaagaaagcgggctacagatttgtagccggctgcaacacgaactccaatacgttatgagtgtatgagaggtaggaccagatattaatgatgtagtatatttttatagataactattgtatgaataggctattagattggctatagatgatttgaagccagcagttggctatactattgaacttgctcttagctccaaaatggactggaagtaccaagaggtaaagcaatgattggaaaaaacttttttttttgagtggacaatgatcggaaaaaacttggcttattattactgattttactactccctctggttctaaacatgagttactttagtcttctcaactccttcaaatgcgaattactccagaaatttcaagtcgtttaatttgtttacgctattctttcatccttgctgaaaataatcgctaccactcttgaataatgagtttagcatatatttttactactacactttgatcctgtttgggggagcttgtcccagctgcagcttttcccaaaagctgcttctgctagaagctgccctaaacagtccacatcttctgagaatctgtaattacaaattctgaaaaatgaactaagaacccagaagctggagaagctgggtttcagagcttttctagattctcagaagctggctaccaaacagctgcttctcagaatctaaaaactcccccaaacagaccctttgaatccaagctattacactttgaatccaagctattataccagattgtgaggttaactggccttcaatttattctttggtgaactggtggtgtactgcagatgaaacctcaaacagagctgttgatgtgctgaatgtgcttagagacccatagactggctctgtggagttggaattattttgttgcacacgtttctacgagtgacttctccacgtactccctccgtcaaaaaaaaaaaaacgacaaaccctggatttccatgtccaacgtttgattgtccgtcttatatgaaatttttttataattattattttcattgttgttagatgataaaacatgattaatattttatgcgtgacttgtctttttatttttttttcataattttttcaaataagacggacggtcaaacattggacacggaaacctagggtttgtctttttttgggacggagggagtagtcctaccttttgttttgcaaggaaggccatcatgtaagcaatcatattaattcttggaaatggtgatgtgataacactatataatcaagaatcctatactagtatgaggtaaacggtgatgagtcagctttaagccgaagatactgggattgattccagaatatgacgatagtccaagagaatgtgattatgtgatctccaaaagatggcacctcatggtttagataagaggagaaaaggtcagaaagtgacagcagccatgcattaatgcatatgaaaacaaattaacggtgaaagattacttgctcgatctgcatgctagcttaatccactgacgtaattgtccatgcacatcgcctcaaaagagttccaaaatcaattctttcctatggtgtaagctcacctttatccatatcctgatgacatgtcaaagcagcagaagatacaggcatttcagctgctgaaatttaattccttccaatacagaggccggcgatatgtaattccatataaattaatgaagaagatgaagatatgtgttggctttcagcagagttttgtacagactacttctgtttgtccacatccctcggatggatcaagagatccctgaatatttttatatctcatcttcagaatcaataatctccatgaatcctgatcagatcgaggtcgcctatctggcaatgattaacccgtacgtgacagacgatacagatcgatagcttccatttgcgctttcctcttctcttcctccctgaactgaactgcgtatcacactgtcacagaactgaactaaactgggctgaactgcaagagaagtcaaaggccagaggcctctcagtccagccacaagatgcggcgaagtttatacgctaagatcacgcgcgctgtggccccgtacgcatgtgcatctcatacattccgatccactactacttgattaagcatatgtttattatcatagtatcatatacagtaaataattatataatacctccgttttttaatacattataccgctgacttttgtcacacgttttatcattcgtcttatttaaaaaatttacgtaattataatttattttgttatgagttgttttatcatttaaagtactttaagcatgatttatattttatatatttatataaaatttttaataagatgaatggtgaaacatttgtttaaaagttaacgatgatatttattaaaatgagagggagtatgtatgtacgcagctagctaactcgtggattttagctgtgctgtcgtcagttcgatcttacagttgtaaagcacacaccattgttcccggcctgtaattaacctgtgaggcactagtccccgtgatgagtgccgcaagagatgctgagattaattgctgctacgagcataacatgcctggtattggtcctaacaagttaacaaaaagtgcacatattaattagcttttgaagccaggggagaaaaagaaataaaatgcaggtattttaggatattgtactatatattaataaaatgcaatggaggctatcagaaagctagctagtgatggggataagattacccttcatgatcatttcgctatcggaatggccaagtagagagcgccactgcaccatggtggatctattgggtgccatagaatggcccccaccaaatccgcaagtgcagtgaacgtaaacattctcccctcttcttcagggaacgcacgcctgagaatacaaccaagcctgtcagaccagagcaaagatcaactgatcaagcgtgcggcaaggaagaaacattgcaatcctagcatactcctctggttagtacatgaattggtaaatgcgcatgtaggtctcggccacggttttacttcattcgctggaacgatgatataggcatataggtgtttctttttttattaagatggagatgaagtccatgcccgtaaatgataaagtcgttagcatataattaattgagttttaattatttcaaacgtgaaaaatagatttattttatattttaaagtaacttttaagtttttatataagacgcgtattctagcagtttgaaaaacatgctaacgaaaaacaatgaaaaatctacatctaaattagaaaaaagagaaaagaacgggagagtatcaattttgcatgtcaatctaattaatttcctcaaataattttcttaaatatggtcacctcctaatccatgtccaaagctgccctgtgctaatccatgaagaggacattgcagtgtcctagagagtgcatttttatataaagaaaactaactgtattcaaaccaatttagccagtagatacagacatgcattatttcatttatcaaagggaaaacacataagtgcacacaccatcatacacatggcacatcgaagaatgtgtctcctatcacatggttaaaaagagatagagattaacgacgactctttaaccttactgaaaagttttattgaaaaatgcatctgtgtatgcttaatttatttttctctatttcgaatacttgactgtggtgttttatatccataatgtacttattttttcctattaatcaaatattcctttgcttttgcatcttggaaaagtgagagaaaagaaaaggggaaattggtgggtttggggaaaatactcacacgcttgctgaagaaaaagtgatggcaggcaaactggaaaagtggtagccatcgaatgcctgaggatatttgcctgccaaaagtgccaaatgttttctcccgataacgccctcggacccataaaaataagtgcattatctcttttgactcttttaatagatcagtccccaagaaacattggaatttgcagatctaaaattactttccaacgtcttggaaaccatctgagtatacaatgtttcatacgaataacatcgtatatgcttcactaaaacattttgaggtaaatattcatttcttgcttaatttagtaaggtaggagtattagcctctcaaaatgaaattgggataagctacaggttataagttataaccaattttaaatttcaggattactttacttttttttcactttcttcgcttaatctcaacttctaaatttctataaaaaggttttgtcttaaaaaagtcattcctgttgcttcaatcatatcctttcgcagtatgggcagccacgggaaaaaagacgccggacaaaccttgagcttctatgctaaatctttctactcggtctatttccaaatatgtttaaaatttctcataaccgttccgaatttaatttttgttcctccttaatctttgtgaagaacttagaggggtatatattttaagggtctattcattttgaagaaaaaccaaaagatttgggttcctaagaattaactcttatgagtatcattcggttcataggaatatactacatccgtcccaaaaaaaaagtaattctagtttgtttagcatatattaagattttataagaaagactataatgcccttattaaatgatgtataggtaagagtgagagggtagttaagggtaaaacagagagaaatttgagtgagaagtgattaatgggaccattggtactttacagtgacaactatttaggacagattcaaatcctagaaatacaattattatggggcataggtagtagatatagaaaaaccaaatgaaaattttctttccctatagacaaaacatagcaaatttttcatccactcaaacatcttgaaaaattcctatgaattaaagtgtggcattcttattcctccactttcctattcatatgtgttaaaattcctccaaaatgaatatcttatgatggagtacatggaaacattttgtaatttccatataactaccatgggcttctgtgaaaaatccatcatgtataaataacctgttctctcccattccccatcctctcctctgctctccatttgctcgcggcagattgagtgtgcccgtgtgagatagaatctttttgcccttcaaaaagagcaaagtggcagtgcttttccctccggttcctcgttttggtagtattccattgttcctattaccacttcccaacgaactaaccgaagccccggatacaacaaaagagaagacgcaaaggaatcatcagaagcagcagcagcacgcgaccatgggcgacgccgcctccaaccaacctgtaagttcatcttggtttttgccgttttgctttgtgtggttcttcgtcctgattaattgcgagaggtgaacgagttttttgaccttgtgtttactggaaaggatggaggattttgctttgtgtgttttttgctgaatttttttgttgggtgtttgcaggttcttgcggcgagcgatcttggccaatcgaacttggacgccggcgccggcgcgggagcagtcggcggcggcgggttcatcgccctcgacgtcagcgccctctcctcgctcgccggcgacggcccggacaccacggcggcgccaccacggacaccggtaagttggatagacgcgagcgcgcgcggcgatggcgacgtcggcgatgtacaattgtacatacatacgagcctccgtttcttccgttcgtttccaaagatttgattgattctttcctctttgtgtggttatgccgcggacgcgacgcaacagaaggtggtgaggtcgctgtcgaggaagggggaaaggaagccggccgacggcgacggcaatggcgccgccggtcagtccacctataaatctcatccaatcaaagatttcatcacttttgatatcaatatcttcagagttttctattttcgcttggcatttgttgggttttttttttcaattccatggagattttgtaatactcaattcgatcctgacagtgacagatcggttaccttgtcacaggatttagctagtaatccaagctgacaagtgacacctatggcgaattagtttacgtacgggtcaggattaatcgaggccgtgtgtgacttttggcactctcatgtgcagggacaggcaagaggccgccgctgtcgccgctcttcgtgcatgtggcggccgccgacgacatgggcggcctcggccggctcgtccacacgccggtggccggcacgccgggagggaagtcccggcggctcgggcggcagccggcggcgccgtggctcgatccccggagggtggtcttcttcttcgccacactgtaagtcaactggcaatagccacttatagcaaattttatagcagaggtgatactcatctctaattttgttcacgtcatttacttattattaattaatacaacaaattatctctaatacacttgctccaatttaccataatatttctttctttatttgttttcacttaattcattggtctgtttctcttatttctctgtaagtttgtatagaatttgtccggatgacttctcctttttttcccttctcttttccacttatcttttccacctcatcatgtgatccatagtatctcatagtatcttgatgcaagagctaagaagtccatagtacttgctctaatcatttacaagtgataatactgatagtataagaaaaagaataagttcaaaacggtaaatatctgaataaaatatttacgagttgtgcagtttcccaatagctagaagtagaaccatttcttttgagctgctacaagtacactcttgctaatttcttgctagtgattaggcgaaaaccgtggtacttaaagaaaaataattgacgaatttcctaaaccgtagggcacaagagtttaattgtcctgttgtccccaacaacgcaaaaaaaatgtggaacatggcctcgtattagcggctgcattaatctgcagccttttcagatcgtagtaggttcgctgcgaccggtggatgaatgaatgggtgatgcgtgcaggagtttgcagcacaaagagcggccgggtttctcgttggcgagtctacgtgtcagaactagttttagttgtcagctccggtttggctacagcgatatacgggagaaaagacggcgactgacgaacaaccgttctcgtgtacagtatgatgacccttgctttagaaaagaaaatccttcattttttgagtgacttttggacaaggtttactgaacctttaaaagtcactgaatactgcttccgagcgattttgttgataactgtgataaccccttggttacatgtgttctttccccttctttgccaactcaccctttttttttccacactcatgttatggaatgatgtgttttttaaaaaagaattataagaaaattacttaaaaaataatattaatctatatttcaaattttcttatattaacacttaattaatcacgtattaatgggtaacactgttttcgtgcgagaaggtgtagttcctaagtatggaggtgaacaattttagcaaactcaaccttactgacgaaaacagtataaagttgaacaattttaccaaaaagtttgacttctggtttgatttttttattcaacttgactagttatcgagcgatttatcaatgtgtacctattcggtaaatcagataatggagcggccatcgtcacatttatcaaccctcctttttttggtttggtttggttgatcttgtaggtagaactctgaatttacgaaatcgtttcattcatcagtactgcactcttcagagatggtgaatgctcatgtaggttttctgcttttctgcaggtcaagcgttggaacgttgatcctgctttacttcacactctccatgagcaagatgggcggcgacagcggcggcggcggcagcagcgatgctcggtgaaacgccggctgttgaaactgaagaaaaattttcgttttgttctcaaacctcaatgcaatctgtaaaggaggcatgatgttgctacaaagacccaggcatcaaaaaaactgatgctcttctaagggtcaaggaagaatatagagtgaatggcagtgaagagatcaggctgaatggggtctgatggtgaagtatgcgatggtagttgcattctcttctctgttgctgtcatgatttcttcagttatttttctcttcttttttttgcataaaaaggggtacatcatacatgtcgctttgaagcgatgatactagatttttcatccttgatgttgttgcagacacacaaacaatcaaaaatacaaatggacacagatgtatttgaaagaattgtcttttactcatatgtcatttccgtaagagtggtagtacatgacttcaacaaagagttaaacgaacgaacaaagaatatgacacacagctcacaaggtggtgatgatctacaaaatgaattaaaaccctctctatgcacaggtgatgctaacctaatatgggacacgtgaaaaatgccggatagtgggtagttttttagacttttggattcacttcacagctgcagaatagacttaaaagtccctagcaaaaatcttttgatactcaacgtgagtgttaaccatctctgacagataatcgtagattctaattggagccaccctgcaagaacagaaacagatttcttaagatattcagctcaatgcagacaaattcaggacacctaccttagcaacctaaaatgaacgcttttttttcagaagatttttcaacacaatgaaaataacaatgactatatccggcatttttcaggatgcaaccatgcagttgattgacagccacagctgccattacatactactcaggaaatagatgataaacgtatgtagtttgccatttgaaaagactgaattgtgaatttattcccactttttatcagacgcaaacatagtatcaagtgtgcaacaaggactatatctttggaacattttccccttgagctgctgctgcaatttccatctaaccagatttctgatcagctcaaccagacttcagtgactggaggtatggttcaggatggccctggtctagcagacaaactacaatattggttgaagcacatcttaccagagctccattctggtacttacaaccacatatccacaagataatttgcgtagtgcgaaaagcagccacaaaatagatgtcactccaaacaataacacccaccggaatgaatgcaacatgtgtcagaaaaatgatagggaaataaacaacagaaagaagaaaaagaagagtgaaagtagcacaggttagtttcaactttcaagtgtcctaattggaaactagacccactttcggcaacttctaaaaatccctcctgtctaatccaagagtgattcttcaacaaaagatcctagtggtcaaaactagaagacatcacaatgaaattcgtcatggaggatatctatatcttgtccacatgtaaacatatttactgatggctacttatttctctgaaagcattatgagtctagtttatctggcaaattttggacagtgcaacctagtgttttacctgattaattagcaatgaacttatgaccaaaacaatttctgctgttgaataactcagacaatgaaatatacatttatttgctgtgcactatgccttattcatttagatacagaagccacctagaaggtggtaacacaaattaagagttaataaaaataagtgcgggctaaggtactcttgacatttatcaaaacacatgtactttacaagacgcagaagagatagaacgtggtgctagtaccgttttgatatgcgtggcatggcgcacttctgtttcctatcatggaatatcctcacaacgacagcagctgtttcctctatagcttttccagtgacttctgcacaaacacaaaacaaactacacttcaacatatgaaagtacaaagaaaagtgtttccacaaagacaattaaattgatcgtaccgatgactggccatataggatgctgggcgaaaatttgattggcatgatccaactcccccctgacatgttccatttcagcataattgcttttttgcccatgaaatcctagagttttggcccttgccttcctgattgcttgaagaaccacagggtttattgtcaatccaaaaatcttgtcttgatcaatctcaaaaagggactttggaagattcactcccattacaattggaacatttgccactttataccctttttgagccagatatattgacaatggtgtctttccagtacgtgaaacaccaacaagtacaatgtgtgcacggttaaggttctgtggctgagcaccgtcatcttgtttgatggtaaaatcaatagcttcaattcgtcggaagtaatcctcagtaagttgacccttccggctaggagaacttcgtggaattccagatggagcaacaccaatatgggaagctatggcttcaatagtaggacgaagaatatcattggatggaacaccccaaagctcacaggccttcttagttgcctcagccattgaaggatcagcaagagtatataaaaccagtgctccttcttttgctgcttgctttactatctcaataagtctatccatgtcatcaatctaaagcaaatttgtagcaaaagacaaaataatcaatatcaagaaaactacacagctagcttcatttatcagtcaatgcaagtgcaaattagggtcagtgactaatacgcgaggtttctaaactaggaaaccagaataactccttttgtgcaatagtgattcaaccagacatacaatgatcatggcaaattggcaataagcacacctccatgcctgaatatccaaagtactatggtattcatttgttctgtgtcctaagatacgtgcaaacaagtgaacactaaattttcaccgatgaaacaaatagaagtgcatgaaggagtaaccaaccattcagttctcaatttacacaacttttagccatacacaactccatgatccacaaaaatgtcaatgtctgcatcactatttaataaaagtatgccgcatcaatattcatcttaagttccatgtggaaagtctttcctccattagagcacaagcaatttgtgcttctaactggaaagtctttcctccgttagaacacaagcaacctgtgcttctaactgcgagcatattttaatagcagccattatcatctagtagtgatagcatgaaataaattttatttcttccattctcaaacaaatataatgtgaagtaatcccaagtactcacacgctactgaccttactctaaatctgatctataaggctattaaaacaagctgaaaagaagcaggagacttatctccacaccattgattatggtgtagattaatcagacatatatatacagaacatcgctcttattatacaattgtattttcagagtaaacccaagagttgtataacaaataaaattatgctttcaattaaactatagtctagcttgtgaaagaagattcagctggttcttcgaaagctagatgctgataattaacagtgaaatcaagtatctcaaatccctaattagccaatcctgataatgtacagcaaggcaagggacaggtatgcagcaaccagtccgagagaataaagtgtacatgtgcaccgatcatcggtaaaggataacagtttatgttatacagcacaaatctacagctaaaatccaaaatcccctttattcccagaacaattgatatagtttctatgcactatgttggcatatcatgattttccagcaagaacgaaaaaattaaactattgtacgaagcagacatatctggctggacagtggagaccatatatatcccaaaaattgaagaatcaagtcaatagagggcggcaaaaaaaataataaaaaaaaagagacaaggagaaagaaatggatctttaccccgttgaagaggtgtgtgttgacggcgcagccgcggtcgacgaggcagtgctcgaactggccgagcgcggcgttgacggagtgctccgccgtccaccccgtcccgtcggacaccatgtagatcgacttcgccgcctcgtccctcccaaccaccccgtagccatcctcctcctccaccgcgaccttcgccgccgcggacgccgcctcgtcggacgacgggtgcggcctggtcggggtcggcggcgacgaggccccgccgctgccgcggtcccgtatcgtcggccactccagccgccgcccggaccggtgcgcgcgggcccgcgaccaccggtgcagctgcgagctcccgagctgcgcgggggagcgcggggtggtggccgacccggaccccgaccccgccgcctcccgctccggctccttgtccggccccgggctcggcagcgcggcgggggtgccgggcgtgcacgagggcggcgtcaggcggcggccctgtaggcgaggcgacggcgggaggagcagcgacggcggcggcgacgccagcttcgcgcttatcatcgagccgaaccgcggggacgtcgacgacgacgacgacatcctcgattcccctactgagcttgagcttactacgcgcgacgaccgtacgacgaggagagggattttttcttcttctcgttttcgcttcgtgttggcgacgagccgacgacgtttgggtggggttgtgaggcgcgcggcgtttttttatggccgagacgacggtgaaaagagaggaaaaacgtgggacgccgaccgggcgccaccggggttggactcggcgactagcggaatgaatagaaatgattggtgtttcgagacgatcgagctggtttttcggcgtctgctctgcttgccgttggaatctggtctggacagcgtgcgtttgcacgggtcgtacagcggtggtggtttcgttctttgttttggcctccggcgtcagtgcgtcagcccgtcaccatgttgattggatgcgggtggttttatggatcttcagggaatcagggctctgctccgctgatacactcgtcgttcatgtgttctctcttccacggctcgttagatatggatacgcatacgcctgttctattggagagtataattggacttggacccacatatatgttgtttccgtgattcaaaagtcatgtaggccaaacacagttgtgacagagtgaagtttgtgatgttttttaataccaagtataagtgaggtcctaaggttgagtattatccaagacttagtaattcgatactgtaatatataacttaaattttggatccttttatagtacacttggtggtagtagtatagtataatttaaatctaaccattgatttatcttgtgttttttttcctccatcaattaaaacgtaggcatatttttgccaaagattttagttgccgatgttgccgctgaaaaattcgtggccggagaagcctcaaccctgtagcagcatttgtgcgtttgtggtaaaaatatggctgaatgatgtcggggccaagggtgttggcctcgtttcttgtgtgttcagccgatgactaactgccgcgtcagagactgggtcatgtgttgtctcttatcatttttctcgccatctcagaaatgaaacgtcttaattaggaacaaaatatcttcaatacaccaactcagcaagcgtgagttcacggggtatcaactgttcgtcaacaagttaattcatatacatccacataaaatcaagttggtatgtattaagctgatggcaagatctagttgcgatggccacgatgcgtcgaaccagtgatatggtagtcgacggcggtgcaagagcgacagctgcctgacgatcgacgatgttgacgcggattctatcgaatcaaatgggttgtccatcagttccatcgtcactgttgcactctcaatacgcagtttgtgcccggttccatctaaccaccgataatatttagtttttctttactattttgtacccatgctcatctctactacacatactacaagtgggatgtagaaagagatttagtccatttgattgaatcgagtggacggcctatattcctccaagggtatctttgaaatgtcctagatttcacggtagctaagatgacagtatccctagaataaattatcactacaccttgttgattaataattcaataaataaataaatattgtttgctatgtactactcccccgttttaaaatatgtttctgattcgtagtaaaatatagatacatatatattttagaacggatagagtatgtattgtgccaaataaaaggtcaggaagcaaccctgtgtattttccaacctcataattttgcacatttttctcttaagtcaataataatttatgccggtaaaatattttaagcctagcattagtacataaatacatcaaggtgttgaaagttgtagagatagcccctctaactccaagactccaagagtatattagccaagtcttaaaaggttcgtattcctaaatatgttaattcttgcgtaaaatacaatctatattatcgtacaaacaataatattgtgccttacagttataaatataataatgtatagttttgtcgcccaattgtgacaaagaaggaattctgtcttaaaattttcagtaaaaacaaaacaatgaaaaaaaaaatcttatgctgccgctgaattgagctcttcaactatgactacgtaatgagctgcagtaaaatataacagtggcaaaaaacaaaacattatcacctttgccggttgcaattgcataatcagtatcctccttttttctcttttctcgattgcgcccgccctgccaaagtgccaagtgcgaaggttttactactagcggttggcacacaggatgacgcgtagtacgtctccggtcatatccaactcctccgtcacgagcttacaccccccaaatccccaatacctcaacatccctctcgccagttgaccaagacatttttccagcaactgatgtcatgacaacatcaggtgaagccacgaggatatcatcggtagcctggccccaaggcaacaaagacttgagccgcatgcagtgtcgacggcacagaaatctgccgcttcttctgccgcgttgcgcccaagcagcactgcagcagcagccgtgttcgcctgcaggtgagctcacacgcgggcgccgtacgtggagcgagtcgcaccgtttctgcggcagtcagcgccgagacctcgcggagacgcggacgcgcgtctgaaaaccgccaatctcccgccgcccctgccgacctcagcgcggcctgtggatttgggaggaaaataatgggcgcagcacgacgatttcggccgctttctgcctccgcccccgcccccacacacaccgaccgcgatcagcggcgacgtccctatcgcactactagtacgtactcctgcgtggcatagcgccgtagccattgtttcggcctgctagctgctgtcatcgcctgatcggtcgccgtgtccacgaaggattgaggttaaatgcacggtctttttatcaaaaaatccagtgactttggccgtatttagttgttttgataaaaaaaattgacgtgtactggtaagtatttgaagtattaaacgtaaactaatagcaaaataaattatagattctgtctataaattgcgagacgaatctattacggaaaagtatctagaacttcttccgctggcccttgcctaaatccgctatatatttgacacggatttgccgtaatgctggaactatggcgaatgcatctatcgtcattaatgcataaataaatataccaattagtagtgattgaattccttctatggttatacatgagaaaccagtacgaatataacctacatgtccaatcgaactatgagctagaggttttttgactttcgtttgagctatctgctcttccactgggagagggtttgattgggattgtttaagcaattctcgtaatcgtcgaccccttgccaattgattctgacttgttttatcgagagcagaggcgaattgtgcaaccgttgttatatcgctcgataatgggcatctcaagccttttccatttgaaggtacgaatataaaaggactatgtcaaacctacgaaatagagatggcctacaaggggccatgggattaaacaaagagaggcaacttatgatcaagaagggcattagtgactattttatcggtacctgccggtgatgatttgagaataaataaagaagcgattgaaacaactggcgagcgaatgtttggatcatatgctgccttgccgcctaattaatctgtcattagcaaatgtttactgtagcaccacattgtcaaatcatggcgtaattaggctcaaaagattcgtctcgcaatttacttgtaaactgtgcaatcggtttttttcgtccacatttaatactccatacatgtgtccaaacatttgatgtgacggaaaagttggaagtttgaaggaaaactaaacacagccttcaacagtagaggatcctgatcagtccatgaagacgtcgttgcatttgcctatgatccgcaaatgagtgtagacccaaaaatgttgtcctagaaaaatatgggaaacaaaataaactagtatatgttggtatatatatattctccctgtctttttcttttaatatgattaaccttttttattttataaagaatactaatatacattatttttttaccaggtactaatatacattattatatgctcgagtttaactcgagctcgaaccgagtttgcttgaaaactcgaagatggattgagctcatctcaagcttgtttcggtgaaaaccctagtccatggccaacggtgccaacctacttctcctatataggttcagtcaaggtgcatgttgccgtctataacgttattttgtcgtaagtcaatttcgtaggctatattcggttgcaactgctacaattcagccagcacacctgttgcgctgatacaaaatacaaaactacaaagtcatcgtcgtcttcgttacaagattgttctacctcataaatttcggtggttagtggcacactcgcatgttaacaccacttttccttgtatcctaattaaggttgtgttctaaggtgagggttgggaaccctcaccctagcatacaaaatagagtggtagattagtacataattaattaagtattagctaaaaacttaaaaaaatgaagtagttgtataatttttaaaaacaacttttctatagaaaattttggcaaaataagacatcgtttagtagtttgggaatcatgcgtgtcaaaaacgagcaagaggttgggaacgttcacatacgaactcagcctaagtatcaccacccaatttatcagtctttagtacactttgttagccaattacattgacgatttggaatacaaaaggaaatactagccatagacctcgccaaaaaaaatgctataacaacaaaaaaaatcttatagaaacttcataggactgtcacagaagaccgaaaaatgattaagttctacacggaacaagtaaattttgcaacaatccaaacagggttccgttgcaaataacctcgtagggtggcaaatgccacaacatcaatatttgcacatagatgtgcaatagttacatgtacgcacgtggtaatcattttaagctaacactagtacctctcactaacaaaaacatccccgcccactgatttctaatggagattagcttatttcttttcttttagaaaaaagttacggttgttcagaaagtatctcaagatacctaaattttacgctaaaaaattatagttgaggaacattacttagaggtatcaaattttacactagaaaatacattacctcctagtaaattgtatttaagatacataaatttgttcggtgggtataatccagtacatacacgaacttgttagaaggtgcgtgcaaaccaaaaccaaaagaacacaaggctaatcttgccaatttgagtgttaactaggatactacataaacatgtacacgagaaaaatgctacgtagacataaatttgtccagtaaaaagtttaatgcggcctaactattgtacagataaagacataaaaaagagaagcaatgcaaagatagaataaagaataataaagcacaaatcaaattgttatatcatgtctcatgccaacctatatgtatacgttgtgtcctaataaacgtttaacttggtaaaattagccatgacatgtccttttggttttggtttgcgagttcatacaccaaaatacattttacaaatttttatactaaattatactccctccgtactcgtaaaggaagtcattttggaatgcgacacggtctccaaaacacaactttgacttcttgtttctacaaaaatatttattgaaaagtgatatatgtatacttttatgaaagtatttttcaagacaaatctattcatatgatttttacattttcaaactcaacaacttaagagttattcatgatttatattcccaaggtttgacttaaacattgtcctaaactacttcctttgtgagtacggagggagtatccacctaataagtttgtgtaccgccaatgtatttttctctttttttaaccatagattagctttatctgtaataatggtgaagaaaagtccatttgagatttttctaaaagaaccaagtgatgaaaatccagttttgaatcacctaaaagaaatctagttctgaacctttagtaatgctttcccacacttaaatgatgtgcctcgaaatgatctagaattatctcgacgccacttaaatagaaaatcttggttaggagagggggaatgttttgctccatttcattctaggattcaaattttgtggaatttgatccataaaatgagtttgcttttgccccattttgtatttgattttttttgtcttgattgatgtatttgtaatattgcactacaatgtatatgttatttaattgaacttttaatatttgcctatcttaaaagagcggagtcatcatccttcgatcccttccttccaccatgtgcaacatgcatgtatgtggaacataaccactagattcaatgctttatcctcaaccactctctaggccatccctaattatatggacatgacgcgttacaagtcatggacatgttactagtctttataatattgtactaatgttgtaccaacatataaagtgaaccaacatgcctttcccaagtccaactgaatgcggagtctgtcaccaccaccaacatccacaagctcattcatatccaagccaaaagcatgatgtttcatttgaaactttatacttttctactagcttctttatttcttcaaagtcagtggttcagtattgtggacaaaaagttcaaataccaagtgaagattttttttcttatgaaacacaattgtcttagattgaaaattggtaaatcatatcaaacatttttgtacttgaagtttaagttcacattttctagatgcaaagaaatagacacattgcattccaaacaacattattttgaaaatgctcaaaactggggaggtgtgtgtgcctgacttgaacaagaaggtgaatgagacacaccttatagatgtctctatcctgtcaatttgaaaacccaaaagtattttctctgtttatcaagagacatgatttggttccttgagactacaagagcttatttcatgacaaactaagagaacttctggtattgtagtcttccaatgcacgaattaatcaaaacctttcaccattacttgccttgtaattctgacactaagaaatcagtaattcaagtattatgtgcaacgtggcaaaactattaaattgaaagtacattttgtagtgtgaatacaatcataaacctggatcgaatacaacaccactacatttataatagagtatatgttgaatttgccaaggaaatgaccttggtgcttcatgttttagaagtcaaaaacagaaaacaaaaggaacaaattatacacacatcatttttcatgaagagcccaatagaaatgttgctccaattagcccaatagtgtttttcttgttccatttgttctaggtccatataccttgggggttgtaagttcaagtgccttaatttggttttggtgattaataacaaatctaactatatgagactaacatttttatgagcttttctttgactagcctcatttggatatgaaaataaaaatgatgggaggtatgtattaaactccacatattctaatcttgtatctcttgtggatctaaaatatagtgtgagctctctcatttcttaattaattatgtgcatatgcattctttcatatccatatgtatgcacaaattgagggggaggttattctatattttgtttattgtaatatctctatcttgatttgaaatcatctttcatctcatctccctatattgtttatatcgggttattatccatcaccaaagagagaaaagattgaaagatcttggcttaaacaatttgtgtaattgttgctttggtgatagatgataaacccatgtttatgggattaacttctcctttacataagttgtcaattaggttatttcccaataatgagatgtagtagacatgcattcttttgtgatggaccttaatcatgacaaggatgaactgcatggaaataaagcgatatatatcactttttatctcctactttttgataggttcatatatatgatttccatgttattcgtatataagtgtgagactaatgtttacttgagtcttatcttatttagtctcatttacattaagaacatgaagatcatgaaggtatgtgtttttgtttatctttatcattgctacatgccttcgtgtataggataaactccattggttcttctttacttatgcatacacttacatctcttgtatatttttttgtatgcatatatttagggggagcaaatcctatacatttattgtgaatgttctagatccatattatttgcctattatttatatcggatatttgcacttgagcttgcgtacgagtatatgatacttgtggtgttaatgaatacctaacaaacatattcatatctttcatatgcaaccggttggtcatcaagtggatgatgataactgatttgttggtactaatgttctcctatgaactgtgcaaaggaataggtcccaccgtgatgaggctaatggatgacatcatgggttgatggtcaccaagccaaagacattgccatgttgataagaacgaagtaagcttatgatgagaagaaagtcttaacaaaggatgatcaagacctcggcataaacatgattcaaccgaatggtcataagtgttgatcttggctcaagcattaaccacaagttggatggcgcaaggcaaaggtataatcaagctaagaatgttttcttagtttgttcccggtcttggtgtttggtgtagatcagatttgttagataggcgttgtactatcaagacgggtctatgaagcgagcatgtttcatatgcatgtaggtgcatttggtgggattgtctagctaagtgtaatgagttttcttaagtcccaaacaaagaaagaagttggtacatcctataagtttgggtagcttaatgtggtattctccggtggagtatccttcggagtgtgagccctttctccttgctttaagttgtgtttcatggatggaaatttcatgagttggatatccctttgaataagcttttcatagagtccaagaacgtcaaattccgagacccgagtcaagagatatcatcattttactaacagctggttgtgctgaaaagtgaactgcggtatgaccgcagcccttatggcggtctgaccaatgtgtgttgtctggtctgaccgctgatcctgattttgaaggaggtctcatcttgacgatacagagccgaagacggtctgaccggagccgatggcggtctgaccggcatgcctatggcggtcagactggctagccatcgcccgtgcattaaatgcactgtaatgactagttttctagccattacaatagagagcggcatgaccggccaccccatggcggtatgaccgcccaacacctgggagttcgggtttcgcctccaacgactagttttggtggttgggggtttatatacccattccccagcagcaagggtagggttttggtactccattgcattatcttgaacccttgcaagagctctcacacccttgtgcatttagtttatctagtgaggtgttggagagtgagttaagccaatccaaatgcatttgcttctttgttagagctagtgtggcacttgatcatcatcggcaagcatcctagacttgttactcttggaggttgccacctcctagacggtttggaggagttgcccggtgacctctccaagaaggttgtgtaggaggcccggtgttgattgtgagtggctcggtgttcgccatctccagagtggaggaagaacgaccatagtgatagaggcttatgagaccactttgtggtttgagcggtgaagttggactcgcctcaacggtgacataggaagttggcaagctccgaacatcaggtgaaaaaattctttgtcacttgtcttctttattttgtgcaaatttactttgagcaagtttacatactagagtttatttgcgctattatcaccctaggcttgcaaatctcaacataggctagcttcttagtgcacttgcttgagattagttgatttagattttgaattgtgcaaaaccgttttgatttacgcttccgcatacaaaactcggttttagccaaaagttttaaaaccgcctagtcaacccctctaatcggcctcctatcctacaggggtctcagcccaaagtgaaccgtcacgcgctccatcctctataccctatctctactacctacccgctcctctctataccataaataatccccctccctcttcgccctcaaccattcttcacagccgccgccaaggctctaggttttgtcgagctccttcctttgccataggctcagctcgtcaaatatgtcttagagtcgcgaagatcctcttgaaacgcttcggatggggtaagttcttcaacttttaggtgcttcttttagatctattttattatattccttttcgagatgtattttccaatgatttcttctttagatgaactctagatgattcatttttggatagattcacgggtgacttctttttagatggatttttttagacaattccatttttagatggatgcgattctttgttagatggatttcttagacaacaccttcatagataggtgtttacatacttggttttatgttttacccttttttcatatataattctttcgtagataggtgtttacatatttggtatttatggtttacccacttttctttaggtaatgccttcgtagatatgtgtttgcatacttggtgtttatggtttaaccacttttccttaggtatctttttcgtagataagtgtttacatatttaatatttatggtttacccacttttgcttaagtaatttcttcgtagataggtgtttacatacttagtggtttacccactttttcttagatgattccttcgtagatatgtgtttacatatttgattatttatggtttaaccacttttccttaggtaatttcttagtagataggtgtttacatgtttaatacttatggtttacccttttttttttttgttgtatctacatcttttttatttataggtttacccctttttgttgtatccacatctttttatttatggtctacctgtttttgttgtatctgcatcttttttttatttatggtgtacgcactttttcctcacaattaatgttgtaggagcgactggtcaaccctgacggggtgcttggtgatgctgatcgccgagcgcctactggccaacgacgtcacggactacatccgcttccgcgccgtgtgcagcccctggaggcagcacaccgaggacccacgtgtcggcgacggcctccgccccaagtacctccccaggtcgtggatcatgctggaggagacccccccggcggcggcgccgttccgcaaccgcctcctcaacaccggcaccggcgccgtcctcgccgtcgacgtcccggagctcaaggaccacgacgtcatgggccccaccctgggcgggctcctcacgctgcgggagcgcggcggcgcccacgtgctccgcctcctccacccgttcacgcgccacctcaccgagctcccctcgctcgtcaccatgatccacgcggcgtcgcacgacccaaagatggtggagcccgagtaccaccagccgacggccatcggcctctccgacgaccacaaggcggtggccgtgttctgcggcctggtaaacaaggtcgccgtggccaggcccggcgacagccactggaagtgggtctacgtcccgcacttccacctggagtcggccgcgtcgctcgccggctgcttctacgccgtctcgcacgtctacatctaccagctcgagagcgacggcgcgcgcggggagccgaagctggtgcccgtggcgtacgtgcccgtggacgccccctcgttccgcctcacgctggtggcggacgacgagagggagaggctgatgctgatgaaggaggtgttctacgtgcacgcgggcgaggaggtgccaccggaagggcccgacatgctgacgatgcccagggtgtgcgtcgcgtacgcggtggacatggcggcgaggacgatcgcgctgtcgaggctgggcgcgcgcgcgctgttcatgggcgacgaccgcgcggtctgggcgtcgccgggggcgttctccccgggcgtcgcggcggacaccgtctacgccggccgccccaacaggctcttcaccgtgcacgagtgcggcatcgaggccgaccgcccgctgacggtcgtgctccacacgcacggcctcgtgagcgggctgacgcggcatgccgtgttcgagagcgacgacggcgaggacctgaaccccatgggcatcgtcgagaccgtctccagctacgtcgccagcgaccgcggcggcgcggcgcgcccgaccatgtatgtcgccagccatgcccgccgcggccgtggccgtggcgtgtagttcggctgataactgtggcggtgatgactgatgaggaattcgctctggaatttcctcctgaaataataaaaatagtggttggttcttcctgaaaaaatggcatgctgcgttcgtggtttctgtgaaaaaaaaaaagttccgtatgtcggtatgtgctggatagagtaatcaggtatactgatgatgatcatgatgagtaacagcagcagaaacgttacctgaaaccaggtcgccgtttgcagaaaagcaggaccagcgatcagtagtcttaccgcatagagaatgcaggtttacagggcaccggtgagttcccaactcacgcgcacgtttttcaaactattaaatggtattttttttaaaaaaaaatttatgcaaaagttgctttagaaaattatgttaatccattttttaaaaaaatagtaaatacttaattaatcataagaaaatgtgtcgctccgttttgcgtgcgaactcacctccccaacacagccatagaatgcacggtatgtgcaaataggaagcaaatgataagttctttgtgaagacattatattacacctcaattatgataaatgtcacggaggtactcatatgtggtaagtaaagcaggactaaggatcaaaaacaagatgagtccagaactgcctcaaattaacttgagtgtacatagatactcagatacaggctttcaggtctccactgtgatcccggtggccttcataagatgtttagaaacagagtaatatagcagcattcactcgaacaagtattcgttaaccgaaacctacataaacatgtttgggtctcatatatcatttcaacatggtaatttgacaatgaaagctaaactagttacagatcctcaacatcctgcttggatgatgtagggcgaccttgatactccagttttgtacctaaacttgctgtgataaccctgaatttcagtcttatcttctccattatatcttgaacttgctcgtcttctgggttcgacaacggatagcttctcaacagtgcagctagttgctcaatgtttttcctgacccgagctgagaatgcatcttgatcaattgaaaccaacgacgtccaaacatccagacatccctgataaaaacctagttcttcacctacctgaaaaccattctttaaaccaacctgccttccctcttcttttccagacaccaagccctcactataaccattcttgaaacccgtttgatagtgtgtctcatctaagagtactgatggttcaaggaaatcaaaatcatccttaggtttctgatccatggtattaataagaacctaaagatgttgcagtaaacagttccttagagagggattccaaaaggttgctcagtaagaaaatgtatgcatacctaaatgcaacaagacaaaaatattaatatcaaagaaacgagagatggaaaagtgcaaacagaacttctgctgagttatgaacaaaaatgtgttgcacgtcaaacaaagcaaaacaaaaaaatgatgattcactaaactacgtactctagacgtttgaaactttacaatttttttatgggtatatctaacattaacgtcatgttccacttcatcaagtaagagaaattaggatgtcaccattactattgactttttcttttgaaaaaggttatattgactattgaatgcagtgcgagccaaactgtatgatgtcaaatgttatgacttcaacaagcagagtcatacaacctcacacaaaaataagcactacacaactcattcgaaccatcataaatcccttgcgtagttgtgttggattaacgccaaggttggacagaagataaacaaggtggtagctattcaaacaaagtggtagctaaccttcaggattcaggaataaggatacactatattctagtaatattcaaaacttccagctcctaagtttcctaagcagcacgatcacatttttttggtagaaataccctatattaggctattactattagctttcaatataagctaggatcaacacttattatttaaaagaacaccatgatcactaaagcatagcattaattaagtcttcatcatacctctaaaccttcaattagtatgatattctaaggattgaaatgcccaaaaaggaaataaaaaaaaaggaagataaaacctacgtttctccagctttacagaacagtaagtttccccaaatctcgcttctatctttacgatgctcttggcttctactactaccaaacaaacaaaccaaaacaagatgtaggaaagccataatcacgctagatgtcacaactactcgagaattgaaagcagtcaagctgaattaggagtcatgatttcagttaccctttgctcactaaaaacaaaaaaaacaaaaaaaaagttaccctttgctcagttgctcccggaagaaggcgtcagtttccgcgatacttctggaacacgccgctgcagttggagtccttagccaccgcgctttccgccgcctactcagggcagaggcgaaggccgctgatagcaacggaactgcgctttccccggtctccgcgggcgaaagaggcggggcgccgcacggcccctccgccggtggaccaggcgaggcgccgcagctggcggggggacgacgcggtggcgcggccgctgggcgccgccgctacgaccggaggaggaaggagggtaggagactcacgtgtgtggcggcggctccagcccagtgacctctagatgaagcttttgggtctgatttagttgatgatgggcttttttgggccatggagtttctcgacgtcagccttgtagaagttgataaatgggctaaagcccatatagatttggtggttgggctgcaatcacggttcgcgcgactcgagctctcgaatggccttcgtcttcgtcttctccggttctctttcccttccccatcctcctccccattgcgctgggtaggattccaatgtgggggactagggtttagggtttggagtcaatcccagaccgcgcccatgacgtcctcgtctcgagtaagttgcgttctgtattatcttcctctctctctctctctctctctctccgcgcgtgcgattttttttgggggtgtggttttggcgatgatatgcgcgtgcgattttttctccccgggtgggtttggggatgggaggcgtgattagaatcagcgaatcgcttcagtgcattgcgctgtattctgatcagtgtttttccataggagatttaagattttgttgttgagctgatgtgtgaaaactggtgtattgcttaggtaagggttggcaatctagtccccctcaatgaaggaaatgcgagctcgtcaaatggatcggtgtcaagcattcctatctatctgggtgccaatgttgtagggaggaatcatttggtggtcgtcgacaagagagtcagccgcaagcatctgagcctacatgcctcggcggatggttccattgaagcggtagtggtgagtgtgataaggcatggggatattccaattaactgcgcagtattgttctgatggcttttttttcagaaaataacttgttgttcattggcattggatgtgcaggaaggaccaaatcctatcattgttcgatctgagggccagaggaggaaggtctgtgctcaagagagagtaaagattgcacatgatgatgtcctggaactcatccctggtgaatattttgtgaagtatttgaatgtgggcgataaccataaaagttccacatcaatgggttcaagtgattttaaaaaggggaagaggctctgtgaggatgatactgtagttatcaaaagaaatcgtcagattatggaagatgaggctttggcaagaagtttacaggtaacttaagtacttaacctttctagttgcactgcctgtattgtgcagtttgtttaacttagaagagagcaatccatggttttccgtgtatcatatttccgtttagtctgatcatggcttaatctgggcaatgctgtagttttaatataacataaatgatcctagtgctggacatagaatacttagggcacgtttggatctaaggctagcattagcctagcctggcctggcaaggcccagcgtttggaaccataaatatatcgcagcttctgggggcaagctagccctacgggcaaggaaaagctcgctcgcagtggagagccaattcggctctccttcgacgacaaacttctctttagactaactaactgcccgtcaaaaactaaacaaccaaacaactcagtaaagcaagcctagcaacgcagcaacaacctggtttgcctagctgggctatagctcaaggtgacaaacaaccaaacatacccttaaagaatgcctttaaaagaagggattttccagtgtatattctgataactttatcgtggataaactaatttaaattatgtcagacaattgtttatgaaattgatcagtggctatctttatatatttctggtaggaaaataaagtctttacgtcttaattcatagactccaggctgtgacactgaaagatcctgattcataaatataccactgaaagatcctggtacacttaaataccatccaaaggtgcaagcgtttagaaatgtacttatctgtggtgaatatttatcaaatagtatctaagtattggatgtttggatttgctttctgaaactcagcattggatatgctatccttgtatgcttctgttgtttagtgttggcatattttatattttgcattgtaaaaaatggtgccccttagcttgctgaatattagtttagctgtatgttttctttccttgtgtaaaattaccagtatactattgaattgtagtatagtacattaccatcttagtttcattactatttcctgtcctattccagaaaagctttgcagaagaaagttcaactatttccggtttgggttgtgatcaaatgttaagttcacttgatagtgctggtttttctgagagaaataacgagagaatacactctgttgattatctgaaagatgtactttcattgacttttcggctcatgcgtgtccaaggtcttccttcatggactaatacttcctcagttaccattcaagatgtcatacaggtatcatccatttaacaggagctcttgcggaagttatgtggttgatttcgtttaacatggcgtgccacaacatcttttagatatgatctgttcaggacacaaatgttgcataagaacaaatttcttagcctgctcatcattaccaacatatttgttcaaaaagaaaatcattaccaacacaaactcttgctcatataccatttgtgatttatcactatatagcctcaactcatgtagtctgctgtttgaaagatggaattgttctctagttggaccttgtaaagatttctgtctatattgtcaatggtatcgtgtatggtgggggagcaaaggctagttcttattctgctgatctgttcagttttcagggatactgtgttgcatatcatttcccaaccatttctctaaaacaaatgttctcttatgttcacactctattcatgcattgccagattcatcaaagaagtatactagttcttacatgatgaatgaattattagggtgaagtgcttcttgctgtactctcaaattatatggtggacatggaatggctgcttacaggtgggttattgtggtggaaatcatacaagtaatattgtttgtccttgtatgagggctgcttcctttttaccataagtagtgaccttttttgcaaacaaaataaatttggcgcctctgccactttacagtttcagaagtcagaacactcaatcatgaaaccaactacgatcctgtgctatttatatttgtctgctccttttaattttttttgtactgcacaattaatactaaattctacgtgcttgttggtaagaggaaaagcagtcctttctttgttgctgaaagtaatctgccacatttttttcattgaataagcatttagtttctgccatcctggtagctttcccctcaatgttttgtttgctgtaactattcattggtataattctttttgaagtgaaagtagctgctggtaacaacctaactcatctcatattcttcattactgataaattgatgtaactatattggtcactctctattggtttctagaatcatagtcatttatgttattgatttacctaaattgtttcctgtgcaataattttggaagctcatctttctgagcctctatggctaggattacaatttgtatgtttactagttaattgtaaagcataatatatttgtggaataaaaaaactggactacaaagataagcaaaacatgtacttttggccttttattttgctatttttgattatgattctcatttgtcttctattttccactacttcatgtatctttttgttgacatgcacttagttatgaaatgtatgtatttactaaggagtttggcaaccagcgcccatctgtgttccctatgctatgtggtgaaatatcactgtgctttcttttccagtcattgccattatctacatcctttagttttaatgtaaataacattgcactgtgcagcatgtccaagcttaaggaaagttcgacatgtcctagttatacatggagaagatggtgcatcagtggagcttctgaaggtgacaacattactagagtaattcatgatatttttgtatttcctttttctcatctcatattcatggttgggtgacagaaagtgaagccagccaattggatccttcacaagcctccacttccaatttcatttggaacacatcattcaaaggccatgctgcttgtatatcctcaagggattcgtgttgttgtgcacacagcaaatttgatacatgtcgactggaataacaaaactcaggggctatggatgcaagattttccctggaaagatgcaaaagatgtgaatagaagtgtttcctttgaaaacgatttggttgattatctgagtgcaattaaggtagcagctagcagggcacttgtctttgcttcttgattaacgtatcactccaattgtgtttcacttttttagaaaagaagttaaatgttgttttcttactgatatattttaaattatcatcataatgtgttttgccggaggttaccagaataaaaattaacaaataactgtgcacttctcgaacaatcacagttaacactggcaacttctgtttctactcttctgctactcaataaaaagaaatcatattaaatactactgaattggttcacaaggggatccactgttctcatgttagtaaaacactgaattggtaaaatatgcatatcatgattttgttagagagagatcttggaattgctggcaacatgttgcaaacttatagtaagacagtagctgtctcattgctaaaagcaatgagccatgttaaagaataccttaaaataagtataatgaaagtttcagcaaatcacaaaacatggtcttattttctgtggaacattgtacagagttctgtaataagtacctctaaattggagtgaatgaaaataggatgtctcgggctgtctagcttcgaaaagccccagttcattctaactattacttttgttctagtttaattccctaccgttgcagtgtactaaacacatcttctctatgtatgttgtaatgtattattctcttcatgacaatgcagtggcctgagttcagggtaaatttaccagtggttggtgatgtcaacatcaatgcagcattctttaggaagtttgattataagagctcatcggttagtataatccattaatcttagtttacacttagtgtgcagtgctcagctgtaaacatctcgttttttttttctccatgcaataggctgacatgaaaaagaaaaaaaattgaagtccgctttgcatgataaatgctggcaattacttaatcacgtgatcactgatttatgcttgtgcctccgccgtaaataggctgctttatgcaaaagttcccttttcttcaataaatgaacagatttcatcatcttttagcactgtttttattgcttgtcctacaaagtatttactgttctgaaggattttcagttcacaagaaaccattctattgctccttttgttatccattttaaaatcttatgttggaccttaccagtttggttgcatttgaaattaatctatgcattttttttctgcaccttctgtattgcgtgtttagtgataaagtccacatatgccactgaaaacttgcccaatcctcctattgtcagtaagacatcaatggcaaataaggaatgaagtgatatttaaagcgaaaaatgaggaattgcctcatcattttggcccttgatctttctctccctgttggatgcacaaaaactaaataaactgtacatggaagctcagcagcactcgcaaaaggtctattagttttacatagaagcaaacatactagcacacacaccagttctcctctctcgtgtattcataatttagtctcagctgattttacatcttataggtcaggttgattggatccgttcctggttatcatgttggccccaatattaaaaagtggggtcatatgaagcttaggagtgttcttgaagggtgcacatttgaacaacagttttgcaaggctcccatgatttatcaggtatctttgaatgtgtgagttatttatccatttatcttagcatttagcacaggcaacttttcgaagtgatgtagtgaatgccttaataaccctgttaaggttgaagcagaaatgcttaagattgagaaacaaaaatcacatggtgcctagtttaccttaggaaagaccttctagtaccttaaccctgcactttgtagcacactaatgccattaatagaagctgtaaaaaaatttgcactaatggtcaaaggaatatgtacttagttaatagctgtttcttgttttgtattgcaagaatgagcgagactataaggagtgcgggatatgttatattgtcacctgcatcatcacggattaattggacttaaaatctggcattcatctcccctttctgtttcactgaaagtttatattgtaattttttactcgcctattacttcccaggcttgttctccttaaaggacatttagcattttaattctcttgtatgcagttctcttccttggggtcacttgatgagaaatggatgagtgagtttgcattctcactatcagctggtaaatcagataatggttcacctttgggtattggtaaaccactgattgtctggcctacagtggaggatgttaggacatcaatagaggtataaacctaacatctgtaaaaattctctaatcatacttcctgtatattgcatcgtaaaacacacgagcatgaaagctccttgtgctttcttgatctgttgagaaccttcttcagatatgatgtcctatgatagatcagtgctggccccaaaataacaaaaaagaagtataaaccgattgtgttccctctcaaaatcagcatgttccatgacctgaattttttctaatccttttacccgagtactagtatcaccgcttatctgattttcttttatgtcaaatgtttcttatgtagggttatgcagctggtagttgcattccaagccctcaaaagaatgttgaaaaagatttcttgaggaagtattgggccaggtggaaagcggaccatgtgggtcgttggtatgttccctgattccttcaattatctaacaagctattgtcttgttcaaatggaacttcctaatggttaccttgcccgtatggtgctgcatatcacaagaaattgtttggtgatgtttctttaatcacgacagccatgtttggaggaacggtcatttgtgaccaaacattaaattgataggttggtgctgttcaaccttaattatgtgtccatgtgtaggatcaaggactagagagagagggggaggggtgaataggcgatttttaaaataaatgatacctaatcaaaactaacctaagttgctaggtttggttaggaagaagtctaaccaagcaactagattaagttttgcaatcctagggtgataagggctcaaaaaatctgtataaaagtaaattacacaaatgtaaatgcaataagtaaatagaacaagagacaaggtgtttttcaccgaggtccggaaactcgctggtttcctaatccctgttgaggtgagccctacttcaccgctcaaaccacaaaacctcgatcactagggtagttccttcgctctgaaggaggtgaatttcgaaccactcacacccaacaccgggtctcctccacaaccttctcggagaggccaccggacaactcctccaagccgtctagaaggtgtcaacctccaagagtaacaagtagcaaccaaactcgtagatgatcaagtggcacactagctcaatcgatgatgcaatgcacttgacttcgctcaaactattctcaaacacccacaaaggatgaagaagtgctcaagtggtgtgagagtgaatgcaagaggtttatacaattgaacaatgtgccaagagaacctccttgctgctggtgggggagtatatatacccccacacataaaaactagctattgggggctgaaacacgactcacaggagtctgtcggtcgaaccaccaagggatgttcggttagactggcctctagtgcaacggatagaaaactagccgttgcagtacatttaatgcaccttcagtctaaccgccataggctggccggttagaccgcgggtggctccggttagattgagctaccaccgatcagaccgtcttaagctctagtggctctagagcgccaagtccaggcctcctattttgctccaagtgctcccgatcagaccgggctgggcccggtcagaccgcagcggttagaccaccacaagggcgccggtcagatcggctttcaggacttggagcctgaggcaaccgcgagaatagaactctatggtctaaccgcccacaaggcctcggtcagaccggagcacataccacggtcagaccggcatgaaaccttcggtcaaaccacctgaggtcagagaataaaagcagatttggaccaagagaagcacccacatgcatgtgacctaatatggcattttgataatttcctcaccaaggttaccacccctatacagcaaagctattaagaaacctagcaaatttgatcatccaacacctcaattgataaaaacgaaaagctatatttatcacattcatctcattgcttggccatcagtttttaatccgtggtaatcatccttcatatgcacatcatgtggtcctaactcaaactcttactcaaattgaataggtagtccataattagcgcttgtcattaattaccaaaatcaataccacataccaggggcctaatgtttcttctatatgatctgtagtgctgtgcaaaatgagttttatattttctctacccccaaggttaggcaaggcaaatttatatttaattgcaaagatagcgaagaatatcattgtaatctaaaaagcagcagttcattgaagtagtcatatatactaataaaaacaagagggagtaatgattatgattgtctatattttatagtattccttgagcatatttagttgatcgatggatatttgttatagcttgcaaaggttggcatccctgccatacctagatctgtaatattttgatcctttttagagtgtttattactttatcactgacttggactgacattctgatttgggttttcttaccagtcgtgcgatgcctcacataaaaacttttactcgatacaatggtcaagacattgcgtaagcatccatataaactgttttgaactctagaattaataacagtatttccattgaatcattgtctggaatctttgtatatcctcatcagatggtttctactaacctcggcaaatttaagcaaagctgcttggggtgcgttgcagaagaataatacacaactgatgatacgctcatatgaggtggatgattttgttccattgttgaattgaggaaattttctgaacatccagacttttacaggaaaactgctctgcaacatagtgttggtcatcatggaatcgtagcttataccttgccatttgatctcttttcagttaggtgtactgttcttgcccaaaactcaccaatctgtaccacaattttcatgtacggggaagaacaattcaaacctggtactatctaatttctccttccttttgtattataataatgtgatcactttgcttttttttttcatcattttaagttccttacccagaataacctggcccctgggaaagagatcaaaaccaaactggtcacactctgctggaaaagcgacgaagaaaaagaacaatccacggaaattatcagattgccagtgccatatcaacttcctccaaagccttacggcacagaaggtgagctggattaatttaacgattgatacaacttcagtggagtaacaatagtaaaacacttagaaatgttttttttactttcagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagtactcctacagtccgtcgtcatccagcgatagcgatctgaaattttaacgtgcaaaggacgctacctaaaccagctttttccagaaatcccccgtgcttgttcttgcggctgtccttgccttgagccgctccatgaaagcagcaaattagtggtactgcgtaaaagaataggggcaattgactcgacgatctcgcttccgtcgtcctgttgtgatcctagacgagaatcgtcgtcggtgatcgatcgggtgatgcgaagcgttcgtccaaatcacggtgattcaatcaccaacccgccgtatgaacgaccacgagcacgggggtgtgcgacgcttccctcggccgcatccgccaaagggtaaacgccgccaccaccacccaccaagcgacacggcgcgcgcgcgcaccgcatgaatcgcgtggtacgtacgtacgcccccatcccaccaacgggccaccacgcgacacgagacggcaccacggcttccgccccccgccgacccctcgcaccaagagcccacgtaccgcaccgcgcaccggtgccggtgcgtgctcgcttttgcctccctccgcgagccgggcgcgccacgcgacgcgcgcgcgcacacgtcgcacgccgtctcgacgtctcgctcgctagtcgctacccgcgtccgccccacgcaacgcaaggagtgaaagaacgcgatgccgcccgcccgcccgccgccacgtgaacgcgcggcgcccctatcaatccgcgggcggcggggtccgcgcgctcgcgggggccccgcgtggcggtggtggtgggtgggtgggtgtcaccgtcgcgaatctcgaatccgcgaaccgcgagtccgggggggaatcgggtccgtccatccatccctcccagtcgcgtctcgcgagtcgcgacggcttcgctctctcacctcctcggccaaggtgggccccgcctagtggctgctcgtatcgattcccggatacgggagatcgacgatgctccgctatgcgccgttgccgtttgggattgattgattgattaatataattaattttggtttaatcacgtacgtttcgtcgtaatcccggcatagaccgcgtctgatgctgcgggttggaatgaccattagcgtaggtcggtcgtctggtccggattctctgcaagtagcgggcacgtagtatgcttcattcctttaggaagaatcgtgtcaccatttcctcgtaatttttttctccatccgtctccgtcctaaaagaatgtagtagttagttttagttagttaagcaacatttcattaattaatacaaagagaatgaaggaaggaattactacttcttcgatgacaaaagagaaaaaaatatgaagtattttctatgcaataattatagctatttttttattacgaaatagaggcatgttcgtacctagagagatctaatgggctctacttaaaaatacaaacaaatttttaaatatgttcatacacaatgtcctattttattttgttagagtatttaagaattctattataggtgtggtctaatatgaatttaattttaaagttaattggatccatatgccattgtactttgataaattgaaaaaataccactactattcacaatatcggctaggtggcatcgatattttgtaaaatttgaaacagaccattatatacatcccaaacacagttgtaccaagttttttatattgtattttcatacttaccagaatgctccctatcccttagaggctgacaaggaggacccacacgttaaacttatcttcttccccgattattcctctagcttgacgattccgactgcaacaacaacagtggtggagggctggcactagagcttaccagtgatgacgtccccgcacctggcttcccgatggtgtggtagatcctgcaacggtgtgcttgagcttgagcgtagattgcagccccagaggcgaacagcaacatctagattgtggcagcgagcaatagtagccccagtggcggcggtcggtcctcgtctcattatcgtcggtgagtcccagcaccgacccattcaccacatcactgccacggagttcgagggagttggcagcattcctcgtgtgaaaaccccatcgctagcctctcgacaacgtggcggcaaggtcaatgcaggcgggctagattggggcggtgaggagcagtagtagaagcaaccccagtggcggtggtcgtttctcgtgtcgctgtcatcgacaagccccaacgttgacctctccaccactgacaccaccttcaatctctccaccactgtcgccactgccactctactcccgtcagtcttgctgtactagtggaagtgttagggaagataaggttgacatgtgggttccactagttagcctataaggttttgggggcattttggtttatacgaaaatacggtatgaaaaaatcaagtccaactacgtccgggccgtatatagtggtatattttctcttacaatttgagaaattaaaatttttacaaaatataccaatggcacacgaccaatatcaacggatagtagtgatattttttcaattcaacaaatttgcaatggcatggattatagtaaccataattttaatttgtgctcatcagttcaatattgcttttttactttgtgcctcacacaagctatcttctctctggccatcactaacaataggggtgaaaacggtacggaaacggacgaaaacaacttttatcattttcgttttcattttttttttctgaatcggaatcagaaaccccggatatgaaaacggaatcgaatattattgaaaccgaaaacggagcaaaaacgaaccgacgcgaatacggtatggaaatttatcggaatacaaaaacccctcaaactgataaatctaattctcaagtttcaacgatcaacaattcatcataaaacacaaattatataagttcaattgttaagtctcaacagtacatcacaaaacacaatgtatgaaataaattatctatatttaagagagtaatgctgttgataaatcccaaatgcgggaaaaaaaaattcttatgtaacttcagatttgcataacaaatattttttaaaaataacatctaaacaccatggtattcactgttcagtgctaaaaaaaagaacccagggtatttcagtcataaaattttcagaagtttcgagaaaattccaaccgacagattttattttcaaaaataggtccggaatccgaaaagtttccgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccgtctataaattcctccccccttttcccctctctatataggaggcatccaagccaagaagagggagagcaccaaggacacgcgactagcagaagccgagcgaccgcctcctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacatttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatgaaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccatttttaattatatgaaatgaactgtagcataagcagtattcatttggattattttttttattagctttcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttcatgtctgatctcgacattcagatcccaactgccttcggtatgcatgttgttctcttccctctttgtgatggtctgagtgcctggaatatttgtgctcatcatgttttcctgaacatgtacagatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtgtgtgtaataaccgaaatttgtggtgcctgatctttacgtttttctatctttctgagctagtttttctgatcaatgcttcactctgtaggtcattcaacttcagggtgatcagaggaaaaacgtatcaaattttcttgttcaggtagggatcattcttcttgtgcatgcttactgcaattagatgtacacatgctgtgatgtatgaaaagaatacgtcttgacttgttgtaacatgctatgtcccgcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttacccgtgtgttgaagtttgtaagaggcaccatcactatagatgatggcttgtgtccctctttcatcaagattgaataatatatgctactttgagagcgctatcctgcttgcctgattgtgttaatacttacatccgtcccacactcccacaatataaggaaataaggtattttggcagtttagagcaaaattcccttatatttttgggacggatgtcctcttttctgcatttttttatgttcatatgttcctgaagagtaaggtggatcttgatcaacctgtcggtttatggtgattgatttgagtggaatagaatgggccaacgtccggcatacagttatgcttcagctagctccaggagttgtggttttagattgctcattttctcattctttttcatggacgatagctgaactgctgaagtagtgaagtcggcatgcactggctactgtatatgtatatggcaattgatactagtagtagtgtcagctgaagctgcatgccttctactgtggagtactagctgttgatccaaactccagaccgtgaactgtttgttttttcattactgctgggtacggtacactagcttcattctgtgcatgagtcattctccggcatgtctgcaggacatctcatgatacttctggcacttcaacagtgatatttccagtgtactgcaatgagtttattcttatggttatgtacagtactcgtgctagtaatagtgtattgtacgaaatgaatatgggtagtactagtagttacaggattcacaaagctgggtaagttagaaatgaacatgggtagtactagtagatcacaaaggttcaggattcagaaagttggatctgattctcgaagccttcagtgcttctacgtcgccttcatcagtcagcatgtatgtgtaccatcttttttgagtgatttcttcccccaagtttcaacaaacaaaatgatgttacgaccagaccatcaaggttgagaaatcaaatgcaatcttgtcccctgttcagtcagacgtgcacgtagtacatcacagcatttttcagtcccgaattcgctcatcctgctgctacaggtggtcaaacagtatagttcaacttcagactttcgtggtgcttcttctctgtcaatgtgtacaacctattgctcatgatgtgttcagatagataagattatagtgcaagatgttgccgtggaatccttgcaggtgcgtgcagtgacttgaacatgggctgcatgtgttcctgcccctgaaatacggtgagatcgatttggttaagataatcagtgttcctaaccacgtactgtagtagccgttaacgttgtcagccaattatcaaatacgctgggacatctctctgcatgacctggtgaccatcagagtagtcagtgcctcattgtgcttgtaattgatctactactagtattctcttcaaaataaactgcgaatcaaaccccaacatattcttttcttcagtaaaccccagacaaattttcatgccaggataaaatccttgtcacacgaaaacaaaaccaaaaatatgtagcttatgtctctgttagaacaacacgagatcactggagagtggagattatggccctccacggtcattcctgccgttgaaacggcgcacaatctttttggatgcttctttctttccccctctccatcttttctttttctcacacacatgcagatgcccacagatcgctcatcacttcatcagcagtagtaaccttttccttttgctatctccctttttcttccgattcgtgctcgccaaacgaaaggaacatctcgtcacattttccttttttcaagaacaatctcgtcacatcatgatgcattttccagcctatcctcaccttcatcacccagatctgtggcaggagagaaacattatttttttctctgacatccatgcctaacgagatgtgagatctggacgcatgtttcgcccatatgcctctgtactgtagtacatcttctgatcttcatcttggctgtcatctcgccattggatcaccactaaaattacccccacactaacacatgctttacaacgtcatttgtcaggctagtactacgatgcgtgtacactgaaagcagcaaaggaaaaataataattttatccatttcatcatccaaaaagaatatggtttccaacgtgacagccactctacgtggcccaatccaaaaatagtagtactgtagtagttacagtgaatctgagccgcacgatcgaaggacgatccgatcctggccgcacatcgtacggccatgtacgtcggcggcggcgccggcgatggcctcacgagctggtcgtccggagcaagcattcctccggcggggaggggaaccgcttgcggtcgtcgcagtagtcgtagatgacgaggttcctcgccacccaggcggagtcctcgcgctggccggcgtcgagcgcccacgccggcggctggtcccaccagctgttgccggtggacgccgcgcagctgggcgggctcgccgccgccgtgccccaggagcacgcgtcggcggtgaagtcgcggtaggaggagatgaacggcgccttggtccagtccgtcttctccagcccgccgcgcgtcgcccagtcgtcggcgttccagatgctggagaacacgtacatcggcttcatgatcgggaagaaggtgttgggcttgtccgagttccggtactcgcggatcggcaccttgtccacgaagaacctgatgatcaatcaccaccaccattgcaaagaacatcagaaatcgagattaattgacagaaaatggatttgggtgggcacggcacggggaagacgaaggtggtggcatggcattggcagccattgcttggttctaaacagaatgtggccaagtagcagcaacctggagtgctcgtacaagcggcagggtttggcaatatctgcaggttcaattaatcgccatcggagcgacccatttcaaggggtaggtaggtaggtgggcgcattcaactcgtagtcgtcgtcgtcgttgacggcggcggcggcggatgctatctccggcgagcccggatggccacggagtacgattgaaacaactagaagcttgattactattgttcggttgatcacttacacgatctgcttggggttccagaggatggagtaggagtggaagtcggcggtggggtcgaaccacagcgagtggcgcatctcccggccgccgacgccgctgcggtacacgttggtctggatgatgtagggctcacccgtccggttccccaggaactcgaagtccagctcgtcgcgctgcggcgccgcgtccacgtcggagcacatctgcagattacgccgtcgtcgaggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaactagttgttgtcactcatcagtcatcacgcatggtgttcgatcagatctggggcttggaccggtcagggtatctcatatatattctcatcagttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttcttcactatgatatcacaatttagctatattttaatagcaaaccaaataagatgaatataaatttattctaccaagtaattggtagtgccaaaatttacatatgttttagcactaaaaaaattagtagggcactgatccaaacaagcccttatttatttcatgcattgatgactggaaggggccgtgtttgaaagttgaaaccacacgcatgtttgttcatcggacggccacgtgctctcatgcatccggaccgttgatccgtgctcgtgtactacacgtttactcgtgctgtacttgtaagtcatcttttacagtacactggcaatgctgttagatttttcacgtcccgtttttatttaccccctttcttttggacgtctgtcctttttatccctttcttgaaaggcaaaagagatgctttcttgcaaattgcgtgggtcgtgtctggctgtaggacctcggccgacactcctgacgagggcgcaacgaataaaggagcatttgttggcttctgcgtgtggtgcacagttgcagtgttgcacaagggagatatctcaagactcgaggggcagtaaaggaaaaaaaaatgtttcagcaggagaaagaaaaaggacaactcatgtagacatctatctggtctgaatttttcaccaatatctacaaataggtcccaaaaagtttattgtagaaatggacattttctcgacaccaacatacgccgtggtacaacatgacaacgctaatgaaattgacacctatttgtaaaagaattcaataaaatctatttgtaattaaaaaaaattaaaaataggtcatcgacgccaataatatgacctatttcatattagtgacttaacttccactagagggcaaggggagatgttagaccacgtgccaataacattggcgccatgaaaatggtccatttttaaaataagttttttgggtctatttattaaatcagtttttttaattggtcaaaaggtgaaaaatccagcctacctagtactagtacattgcaagtgtactgtttcttataccttctactgtgcagctgtagcacagtacactcttctttagataatggaaaaatatatataatgcaacctatacataagtagtataaatctggaaactactgtacaattaaaaaaaagggcatatgagatgtgtttacgttactatgagtaaactttttactatgataacatggataaatatcatacgtacatttttagattttgcggtattttcaggtttgcacttaatttttttctcagaaaacatatttggtacagtacgagtaaagcgcgggaggggggggggggggttcagaaacctgaatgaactgcgagtacttcggccgtttgggcaaccatgatatcgccatacttttgtccctccgatttcaggtgtactacactctaatcatgggtcaaagcctttatttgcaactttgataaattgggcctatgatagatggctagctagatgcaaccaaaaccaaacgggctttggttctcagttcaaggctcaggtggatggacgttgggccagttgagaagttgtcatccaagggcccttcacacggtatgggctgtagttggatcacatcaactcatgggccatcacccatcggtagtttggtcttaactcagcccatctagtctacttcggccacaaaacaccaattcaatgtgacgtgtgatagttttgcggtaacgccgtaacaatatactaccttgctaagaatgaaaattttttactccagaaagaattttccatgagagatatttctcgaactaaaggaccacgcagccatggttgctggcttgctgcttgtctgttcttgtacagaggtgacaaaatggtatggtagggccaggaaactgttggtgtatgtgccaaaaacgaaaacgaattggaaaggaatcaatgatggagatatgcctttgtcaccaatatcaaatttcgaatagtctggaatatcccactagctccagacatgctgaggttgctctggctaacattgttgtgaaaatgaaaattgctataaccttattctaaacctgattagtgactgattaattcctttttctgaaactgataaatgtgtgatactaagaagggatttagcatcaattattgagagagagaagaaaatggtgagaaaaccactgttgagatttgagaaggactcgaaagcagggcagctggccagtggctttgctcttgatagctttctatatcgaccgttctcattagtgactgattaactggaccttttgtttttcgacatatttccagtgaatagaaatgctgaatgcctccagatattatgggttctggctagattttctatgagctgttgcattttcttggtcatgtggtcatgctgctgttctaaaacaaaacagagtttctcactctgtccagtgtccacatataaaaacatgcagccatcatattagcatcaacctgaccaacaaatataatggcactgaatcatttttatttcctcatcctttttattcattcctcccagagagacggatccatggaagttttcttgccctcatcaggcaagcagagcacacacacacggtggcagtggaagtgctatgaacaagacgctaatcaacatccagagctaaaacaaacaaggggatcaatgcaaatcccgaaaaaaaaacacaggggaaagtccacatcttcttctcgtccccaactcctccgtgtcaccaccacgtcttgcggatttttttttaccctgttctattcgctcaggcgtccacgatctcgccgtcgtccttcgacgccaggatcagctccgggtgcgccgccgccgccgccgccttcttgatcgtgccgtcgatggcgttcggccggccgagcgccttcagcgccaggtgcgccgccttctggccggagatcatcatggctccgaacgtcgggccctgcaacaacgaatttgttcaaatccaagaacgggggagagattatggtgaagagtttgatgtttttttggtgcgtaccattctcggggcgccgtcgatctcggcgacctccatgccggtgacgatcatgccggggacgacctcgcgggtgaggcggacgatctcgtcctcggcggtgttcatgtcgagggcgcgcatgccggcacggcgtcgatcatgccgatgtcctgcagccgcttgacgcccgtggcgccgaacggcccgtcgtggccgcaggagctcaccaccaccctggactccatcacgt

SEQ ID NO: 78532 - DNA, 668 bp, Oryza sativa
aaatttttcatttaccttaaccaaacctgtagcgagaacggcacttgttgcagcatcaccaaaaataattgattcagtcttagatgccttctttagggagaagaaccaatttttatcaccggtcatgtgccgcgaacaaccggaatccacgatccacacgttctccttccttgccaccaaagcctacacacaagcagaagtcgaagcctcagtactggggttagatgataataaaaatttaggaatccagtactgagacgcacgaccagaagatccaataggcatatatccacgtgtaaaatcaactttagaattttcagaaaaattcctccgaggccagtctgaccgggggctggtctgaccgagagctctgcagccggtctgaccggtcgccggtctgaccgcgggacccactgcggtttgaccgggttcctcgagggaaaaccagttttttgccactttgattttgcaaaagcaatctctctctcctttttctgtttatgagctaatctgaaacaaaaaccaacaatatgtccatctttgccacaaaaagaacaagtatatttttcatgatgattagacacattggaagcattagaagatttagcaacacaagcaacaagaggagattttgcatgctcaacattggattttgaagaagatgcact

SEQ ID NO: 78533 - DNA, 1670 bp, Oryza sativa
atgcaaatttgattgatgggaaatgtctcccatgtctttttaaaaccttctggtatggctagctggttctttttgtaggaaagaaacaaatctgaaacaagaacatgtagatgacagattgtacatactggaatacaaacatttggtattgactggaggaccgcaacaattcgttctttcccaactttcaattccatatatatattgaagcatgtcctggtaatacttccttcacaattcgttcttttctcatttgtcagattacgagctccaaaaaatttggtgcaaagtttgttatgggaacctggtatggagtgtgcacgtgaaaaagttataacaacagaatgcttaatttgttatttgctttgagatatcgagaagtaactgaacccactacttggatttgatattaggcaagcattttctgactagtaccagcattttaatttcttttttctgattgcccatgcaggaacttagtattcacttttgacgtttcatttgtttgtttcaaccatattgtacagttcatccctgcctatatatatcctctccatgtttatctaaaaaaggaaaaagtattctccagtcgggcctctggtggaggcagcgctagacattagcactttgcttttttgaagttatcttttttccgttgaactcattggttataatcatgcttgccaaatttattgaacataagctacagctaaaaactcattggttatgatcatgcttgccaatttcattgttttttgttactgtcatgcatttgtaacataacttgaattattctcttagctagataaatagcacagagaatggatcagtgcttctgagacaccatgtaataaagatgtggtcaatgtggttcccgaactttggggtgtaaaatataaaatcaagcagctttccaaaacttattagacacaagatttttgaacttggtaaatgtttttgaacattgaagatcgatccctgctacttctttaactgtaggttgcacaactggtaaaccattgatgaatgttgtgtcagttgcatccacagctacctcaacaacaccacccggaagaacggcaagggcttcgccaacccgggcaacaccaggtacttcagtttggacgacaagcgcacaggattttggaaatattgctaagtcccaggtaacactctagacaagcaaagatcgtgatggattttggaaccgttcaagcatcagataaatggacaagttcataactgttcaaactaattcagagagcacagaaatgttcagaacctagatgcgatcaccaacaagtcttgtttcactgatcactctttatgttgcaacacaactttaaaaagacttcaaagttttacacaaggcgtgctatggttcttttatttcagtaaaacactcgttgctatgtgtatttatttgcccttttgatgcagaattatattggtaaatcgatcagttttcttaaaaagttaaagtccgtactctagatgcaatgctatttggcttcgaatggaataggtgcaattattttcgttagtaattaatgttctaaaatagcactcatgtttcttgtatttgagaaaattgattgcttagaagttgcataatgcacttatgctatttaggtggatgaatattttgatcaagttttttgttttttggg

SEQ ID NO: 78534 - DNA, 3037 bp, Oryza sativa
  unsure (1)..(3037): unsure at all n locations
cgccgctagtcaagcgaaggggaaaggggcggccatcgagacatctgtttcggagtattctcttgcggcgccccgtttcgcccctggcgattttgagacccgagcagaccttattccctttgtggagggagtaagtaatcttgtcttacctgccagcaccccgagcttgttcaccgaactgaatgagttcgatgaggtgtgttctgctattaaaagcttggcagttcgagtatgctttttctctattcttggttttcctctgcttttttacatgtcccataattaacatttgctctcttcgccgttcctttcttttttttgcatccagattcttgcagctcactgttcgacagagcgaaccgtgcgggctcgtcttgatggatttaagaaccgtcttcgggtcaaggatgacgaaataggccgtaagaacttggagatggaggccctcgccaacaccctgaaagaggcgaaagccgaaaacaagcggctccaatccgagttggagaaaggaagtgaggctacggccgaggtcgatcgcctcaaggccgaactggagaaagggagagaagccatagctgaggttgatcgcctccagaccgaattaaagaaagaaaaggcccattccgccgtgctgacggattattataaccttactgagccgaagatggaggctcttcgcctggaggtcagcaaggccgaagcgagcgctatggaggagtcgcggcggttttcgcgggagatggcgaaaactaccgaatccgcaagaacggcgtgccaaacgctttgccttgcccttactgacatgggtgcaaaagtgccgaggggtccctgccgaagatgcctcggccttcaacttcttcgagtggacccaacaggttagtggttcggtttcggactgcgccactacgtacggcgattgctgtgcgcgtgtatcagcggcctttactatgggtctcctgcaacagttcagctacgagcacgtcgccgagttccctaactatgcgaagggggattgggagattggcgcacaggacatttcgcccgcacttcgtgcatggcggaagcagttctggcagaaggacggtcgttctaccgccaaggcgcgccttttggagcaactagcgaaggcagaggcggcagacctttgcgaagaagaggacgcggtggctgaagggggtggaggcgatgcccaggatcacctagaggtgtgatgccctccgccctttccttagatttttgtagtttttctttttcgttttgtgttcgccagatgtggcgaacgaagtgtatttggcgggctgccgccaatcctccttattgtagctgaaaaaggggcccttggtcattttaaatatatatgactcactcttagccactttttgatggtcaaaatctttggcgtatttatgattacgcccatttctcattatgcattacttttttctttctttgcctattcttactatgcaattcgtcttttgccctttttgcactgtctaccagggtgttcgccaaaagttgtgcattcggcccccttctgggagttggcgaaaccaaaacgagaaatttgtggcattaaaggatttgccaaaggtgcgatgcccatttcggcctgtttatcgtgaaatggtgataaacggacgcagctataaggtttttaaggttgccgggtggcttcgggcgcaccctgggcgaaccttggaagactacgattttgttcattcaagacgtttggaagacatggctcgcttttggcgaaaccatcagaagactgatcggcaggaggcgatctcccagcgtcgttacagtctagtctctatttcgctcccttctcctcttagggttgtgtatgatattagtagtgatgacgaacctagttcgcccgatcgctccttagagagagagagagcgctggggcgaagatgtaatttatctgtaagccaggctgtaacgccattgctcctttctcttcatttgcaccattgtgatgatacatttttatttaaaatcaataaaggtgcgttttatttccttttcgctatttttgcattgtcacttcacgtgcttttcgttgggtccgaacatgtcggccccttttcatatcttagcgaaataggttttgactattcagctttcggcttccgttttcgatccgttttgttctatgttgcaggaagcactcgtgctttcctttcgatcgagtgtgacggtgttcggctaattgttttccgaaacaagctgttgcggtttcaatcgttcggcgagcgatgcttcggctgattcgtttcgccccgtggcctttttcgctgatcaggcgtttgtcttggggtttttccgcaaattgtcaatcgcacaaacaaataaaaatgaggcagaggacacaaagattttatactggttcgggcctccgttgtggataatagccctacatccagttttttttgtcttttttcattttcctcttttttttttctttttttttcatgccgaaaggcttacatagtgccgaagggcttacataacgatatatacatttttacaagttggcgatttgggtgccacccgttctaaacatagaaacgcttgagagaggcagcgttccaggaatggtcgaactcttcgccttccagtgtcgccagtcgaaaggatcccgtcctggatttgtgcttgatgaggtacggtccttcccatttcgattcaagtttgccaacggctatcgggttcgcctttttccttaggacaagatgaccaggcaatagctccgttggtcgaacttttttgttgtaagttgccgaagtgcctgtggcatacttttgcatgtgttcgagtgcttcgactcttaccccttccaagagttcgagcgacacctcgcgcccccccttcgtccccggagaacgtcacccttggtgagttagcccctagctctgttgaggtcattgcttcgtcaccataaagtagcatgaacgggctgaacttggttggtcttgtgggggtcgttcgcagggcccagagataacaggngatcaacagggcgcgg

SEQ ID NO: 78535 - DNA, 2845 bp, Oryza sativa
ctgcacccccaatggataagagagctatagatacccatggtttactattaatctagtctattgctgagatgtacatgttttgtagatagcaccttactttaccattgcgggtgctcttagccagtttatattgcctagaaaaatgaaatggggcattatcaaaagctctgatcatttaatctcctgaactatctatgcccatgtaatagacactctatatgatagacttgactaatagaagtcttaagatatatttgcaaattcctctagaaaaaagaacatttcaacaaatagggatgccatgtgatccacaatgtcttccgttcagttcccgtagactataagagcagcttaattattcgagtatctatgcatatataaatttgctgacaacatgttgttgtgtttctaagtgttgaatgagatagcatcactgctagcatcccagctaagatgttaaggtatacgcatacattcaatacgctcaatttgagctggcccatctactgttgcgcgactttgccgcgggtactttctagtcaaaccttaaaagcgttccaactggaaaaaaaagaaaattaaaaaacaaagcaagagaaaaggtaaaacgaaaaaaaagtcacatggatggtctatggtatagatgggatgtgatcaagccaacagattcatatgctcaaacggatcacatgaccacatgtgtcagtgtgagttagaaatccttgtgcaggaaaggtgaaacgctagccccaccacgtagtcagaaatcatgggtgtatctgatcggtgatcgaaaaaacgtttgccttatattaacttttaagttatcctgttcccacgtaatgctgttatgtagattttctgtttaagaattggtctcgtcaggttgtcttttttataatttttagaattcctattatacgtcactactacacttcattacggtccgcttactctcctcttaattctggctgcagcttggccgagcttcaacttttaacttttctatcacattaaaacttttctacatacaaattttcaatttttctgtcacatcgttctaatttcgatcaaacttttaaatttagcgtgagctaaacacacccctttataacagcgaaagcaaagaacccaccaatttgagcaaaaacaacagtcctatgcacagttattaagaccggaccggaccgaaccggcgatcggaccggaaaaaaccggaaccagagcccccaccggtccggtccaggtggtcctatactcctatggggaaaagggaaaaaaagaaaaaaaaaagaaacgacccaggcggttcggcgtgaactgggccttgggcgggttgggctcgagcgaagacgttccctcatggcaccgcttcccctccccttctcgctcgctctcctccgacggcgccgcttcggcgcttcccgacttccagcggcgagcagccggctgcggatgcgcccgcgctgctccaggaggatctggatcccgctggcgtagtctccgtggcatcggcggcggcggccgggcggtgggaagcttcagctccggccaggtcgacggcgcgctcgccgccggcttcagcgaagaccaccaggtatgccccgcctctactccctaggtagggtctgcgcggcgtctgtaggctctcggactgaatcgcgtccagctatcgagttttgtcccacatcgccaattttgagagcgagcgacctgtttatcaacgcggttcgattctactccatcgcctccccagaggcacccaccccgaccgaatacagcgaaaagatcccaaatgtgggcatcggctgggtgtgtatccccttccggttaatggctgtaaaaaaaaaaagataaaggagcagtgaaaagatcccctcccgttatggggcacggcaggcgaccccctgccggttagctgcatccacgttaagatgtcaatacggcaacggtaagttgtcaaatacggcatatgcatgcagtcgggcctttggtggaaggcagcgctagacactagcgcttagcttttttaaaatttggatgaaatttttatttctgttgaatcgttttttaattccttgtcttaagccaagagaagcttaaataaggtgaatttggatgaacttttttttttctgttgaatcgtttttcaattccttgtcttaagccaagagaagcttaaataaagtcttaaaacattaagatagggtaggagatgagaggagatacttgctgtgttgatatgcccttactgctagcaatttcgccttaagacgcaaaacttctaaccgactgcatttccaagtttcgactggatgccggtcagagatgacttggcagatgaataattttgatcttactctgcagatactatggttagcatagtattagtaatgctttgtcatttgttcactgaattttggcttgtatgtagttttgtttttaatagtaaatttctctgtaaaatttgcacttatatctgaattaatttacgctgcaagactatgacggtaaagatttggctggaacatccaatattttcagccaattgtctgaagatgtgattaccaaagttgcaaataactagcaacaagatcaggtatgtgcagagttgcagacaaccgttgagactgaaccaaattcgtcctggcatggacagggaaaaatagaccatagcagcatagttttgatcaggtagatgaagaatcctacattttgaaaagtattttatgatgctcagggattcatgtaagcaataattctgatccttgagtcaaatgattttctcaatttttatttgtaaaaatgactgtccttttctttgtaaatatgctgaaggaaatag

SEQ ID NO: 78536 - DNA, 2725 bp, Oryza sativa
ttttctttagcgcttctaggattttgccgtttgtgcgttcggccgccccgtttggtatgttccagcttcattcggtcatgcatagagatgccttggtgaattcacccctgctgcttacgacgactgttgagtttgttaaacatgaccaagggccaaactggcgtacttgccattttaaccgggaaggctggttccttcttttggatttgctgctggatttcgttgatcatcaccatataaatctagcggttgcctcttttggttagctcactttctggctagatagagagtgtttgtgcgagcaaaatttagggatcttgactctgtgccccgaaagatagtgttgcaggatcctttgggtaatggcggtggaggtgaatcttggactatttcggtttttgtcctggatggagattttgttgatattccacctgaagaggatttacctactgctgggccgcagccagggcctaatgatgatgatgctaatgacccagatgatggaaatatttggcagttaggacaccctggtaatcaggggggtggtgattgggataactttgtgcagcaacagtaggctgcagaagcaaaaatagaggatgcttggggtaaggatcacccaatgggccagattgaggaaaaccctaggcaactgattgtgttgcctaatcaagtgttagaagaacataatctgatggataaggatcaacaggtgcagcttttcctggctaggctcaaaggagatagctgacagggaagggccaaagcatccatccttttatcctatggaaggtctattggaaaagattgatcatttgtgcaaagctagaaatcatgcatacaactttgaattctggcccttcagctctgccctatggaagccctttcatgaacttgatcatgcccctcctgtagttaaaagagcacattccagctgggccctattgccttcctctcctgatgatggacttactcatcaagagatttagatgccatgactttgcaagcccagtcttcaagtccagaagtcacccctgcagtgattctgattcctaaagctcatgtgaagaaaagggatgagaagactactttatacaaccctaccagaaggcacaattccaggattcttaaagccagccaagagcttaagatagatcatcgaatgggaattggcaaaccaagggggatatctgctaaaaagttgaacgagttggtaggtatatcgaaaattcttattcctggcagcaagattaatgaatctgatttctctgctctggatgatgatataaatttagattcatccccttctgattgttctttgtctttattgtaaaagttgggggtggacctatgtggcctacatcctgaggacgtggctgaatcgagtttagcgggagagaaaagaaagacgcttccccgggcagacatggatgattaagaatgaatagtgttaatttgttcagaactatgtcttttgtctttcagtgctgttggactttggacagtgtgagtggactttacaattgttctggatttatgttatgtgggcctcttcaggctaatttatttagctcttcttctttgtgcactcccatatgttttttttatcatgcgtaatgtttttaaatcttggaatgtgctgtgctggaatataagaggcatgaatgctgacacgaagttgttatctttgaggcaaaagatagaggaaagtggttgtcatgttttctatgtccaagagaccaagaaacaaaatttcactattcctgatataaagacttttgctcctaaacgttttgatgcttttgcattctcgccttcaagaggcgcttcaggtggaatcctagtggtatgggtttcaaatgtttttttgggaactccaggggaaataaacagtttttctgtcacagttaactttgtttcaaggcagtcttcagaagcttggaccctaacttgtatttatggcccatgtagtggcccagaacgttcagattttgttgcttggctaaagaatttttcttttgggtcagttgataacatgattctcctaggagactttaatttctacagattagttgaggacagaaacaagccgggagctgatatgaatgatatattcatttttaatgatataattagttctctcggtctgctagaaatccctttaaaagaaagaagatttacttggagtaatatgcagagcagtcccctcttggagcggcttgattgggtttttacaagtccatcttggactttggcttttccaaacaccactgttcatcccctggcccacaatatatcccaaagtctccaatttttagatttgagaattattgggttgaaatggaaggcttcttcgagcttgtcagcagagtttggtcaatggacactagttatgaagatccggcaagatgcatcagtttcaagctaaaatttttgagaaaaagtttgctgcaattgagtaaaaacttgtctcagttaactgctctcttggtcaattgtaatgctgtgattaatttcctagacctaatagaagagcataggcccttgaccatgtttgaatggaatttcagagaaattgtcaagtcgcaaacttttaagctccttgagtttaaaaagctttattgcgaaaaaaggtgcacgaataggtggatgctgctgggtgaagagaacactaattttttcaaagccattgcatccatcacacggcggcgtgccacaaagcgct

SEQ ID NO: 78537 - DNA, 573 bp, Oryza sativa
caccttcgagcttttaggcaagctcggctcgagctcgttcgagctcgagctaagctaccgagctcagtaataagtagtgtaagatatattttagtgataatccattgataagtataattattttctaattaattaataaaagagtaaaaaatgattaaaataaatatattgtgctaacacatgctaatttattgtgtaaatagatactaattaatatatatatatatatatatatatatatatatatatatatatatatatatatatatatatatatatatccattagtttattaaatcaataaggtaaacaaacaatataaactatacgctatgtataagctcggtaaactcagtagaagctcacgctcggctcgataaagctcgcaagtttttgctcaagctcgggtttggctcgtctggagctcgaatcgagcctagaattagccaagctcgagctacttgcaagcttcgaccttttttgacagccctaacagagactattattatacaacgtctccctcgtaatctactccattcaaatgtatattactaacatatgggtaatttatac

SEQ ID NO: 78538 - DNA, 2115 bp, Oryza sativa
ttaataagaaaggtttcttcagctttgcaaaaaagtttgtccaatggccctagttataagatcgcgcaaaaagcaacatttcaagcttaaatttttaaaaaaattttgcgcgaattaataaaaactgtttccagttaacggctctttgggacaattgtaaatgctggaattatttgcctaggcctataagaagagcaaagggcctttaccctgtttaaatgaatttcaaaagaaattgtcaaattcccaaacttttaagctccttaattttaaaagctttattgcaaaaaaaggtgccccaatagttggatgtgttgggtaaaaaaaacactaattttttcaaagcctttcgacttaaaggttcagatcaatttctatcgcacaggtgctggatcaaaatgaataggtagtcactttacacaatcagaaaagctgatatgttattccatagtttcaaaaacagaatggggatttttcttttgcctcaaatggactttaatctaatggatctttttcccaatccggtgaacctgaattgcttggtggatcagttctatactcaagaggtggacaatctaattaaggtaattcaaccagataaggcacctagccctgatgggattaatgggtattttcttaagaaatgttggcccatcatatcacaggaattttactggttagcagcacacttccatgcctgttatactgatctgcagccgataaacaaatccttcataactttagtgccaaaaaagtcctctccagaaacagttaatgattataggccaatctctctgatgggtattagtttaaaggtattaaccaaattgatggtagatagtttgtagagtgtaatgcctaagctggttcatgagaatcaatacggcttcattaagggtaaaacaatttaagactgtttagcatggtcttttgagtatatccatcaatgtcaatagtcaaagagagaaataattttgttaaaacttgactttgagaaggcttttgattctatacagcactctgccttgatatccattatgaaaagtatgggttttcatgataagtggctgcagtgggtacaaatggttttttcttcggcacattcttcagttcttctcaatggggtacctggaaattcttttaaatgcatgagaggggttaggcaaggagatccactttcaccctttctctttgttcttggtgctgaattactatagagaatagttaactaagcttgctcccttggtttgttgtccaagccaattaatgaacttgatgaaaggggtttcccagtaatctagtatgcagatgacactttaattcttctcaaaacatcatagagagaggtgttttgtttcaaggcttcgttgaactcttttgcaccttctactggcctcaaagtaaattaccatatgtcttgtctctacccaatcaatctgtctcatgagaatgctgagctttttgctagtctgcttgggtgcaccataggtacaatgccttttacttacctgcgtttgcctatggggacaactagaccaagggtagtggactttgcaccattggtagacagggttgagagaagattgacagctagctcacaatttttgccacagggagggagactcactttgatcaactctgtgctttcctcaatcccaacatattacatctgttctttgcagttgcctgtttcagtggttaaagctattgatactgcaaggaaaaactgcctctggaggggaaacaacccaaactcaacttgaagatctcttgcttcttaggattagatgtgtagaccaaaggaaaaaggtggcctaggagtcattaacttaagaattcaaaacacatcacttctgcttaaatacctggtcaaattttacgaagggcaggatctgccatgggttcaactgatctggaattcttattatgactccaaggtgccccatttagtttggaataaaggctctttttggtggaaagatatagtggctctatctgatatcttcaggggaatttcaaaatgcttcatcaggacaggatcctcagctcttttctaggatgatttttggaatgacaagattaggtgcagtacattgcaactgatttcaaaacaga

SEQ ID NO: 78539 - DNA, 2668 bp, Oryza sativa
  unsure (1)..(2668): unsure at all n locations
tttgannnattggacggccgccgtgtgatggatatgcaaaaagaaagaaaaaaagtgctcatacaagtatggagcatgatgatgagaaaaaaaaagaaagaaaaaaaaagagatagccatgcacttttcaaaatttcaaaagagaaaataaatggaggaggtacacaaaaggagttattattttcattccttttcacccacaaattaaccatccacatacacatgcacatttttgaccagaaagtatgtctcgtatttctgtggatccattatttgactttgtaatatatgtgatgcaagtagtgctctactcttttccacaccctgagctccacataagccttattagatggtaggaaaagaaaggggcatttgcaaatttgccaccggttttttcaatattgtaaggatgccactcaaatgacagttctagtggtatttttgcaattttctagtggcagttttgcaatgatgattcaaagtagtttcagagaaggcgcaatcatatgccattgtgaggaatcatacactttgagtgatcgagagaatcaattgagcaacaaagcagagttataattttgtgttacatgaaaaaccctaagttgttcttcatgaaaagttagggtgacttgagtcaagattgttccatttctcaattgctcaggattgcatggaagacactataaagatccacaactataggtatgactttgaataatttgtttgcatgattattagtaagaaagtcataaccctgttgtagagtccatagccttcactcggacgagtgaaggttaagtgtggaggtgttgttgacggtccttaaatcataatatttgaccgtcaatacttgcatataatgaaataaaatatggtatccaacttagtggtaggttttattactaatcatttccactagtgttggtgaaatatgtgtatgcgggtattttgaggagaaaacacatctgtcatgcgacaaaatgcacctccgcatattcaggacgcgtttacactgattcgagggccccatatgtcaaccaaaaccacttagaattgagccaaatcaaagtacatgatgttggaggcccaataagctacctacccgccaaaggagaggccgggaagacatttttttggtccggccgaaccgttgttgtggctgttaatcaccagccttccacgtgtacgctcctgatttcatcccaatgacggttggagggtagtttggtcgtttcccatacttgtactatcatatggaggctataaaaggaggagcttactctcattccaacacacacaactttgagctgaattacaagaggctctattgtatcttttgtacattagaataaggtcgagagtgaggggaagctctggaggagtgcccggaagtttggtgctcatccgacttctacctcgacgagtgtagcttcctaggaggaattcgggaggagtaccggagctgtcggtatactctgctatgggttcggagaaacttcttctattaagtaagcatccatgttcctttcttatgttatttaattactttgtgtaagtaggatatattttcatctttgtgggttcattgtttagtattcatactaagttctctagtactaggactccggaaagagaaggaagttcctgcgtaagtattagagtagtaattaataacttagacatggtgtctaggttagagattacctttgtttgttgtgtatcccatggatttgtcaaaggtaggtggcaggtggtgacagccctgaatcccgtcctagtaatcctccacgttcgggtacatcatagagctatagccggaaacacgctggcagaccagtaggggttggtgcccgaagcaacagataggaaattatctttgcttagcttagatagttaaaacacatagaaagtcctctctaacctacctaccattaggtagattacacacgttccttgagttcgatatccttttagggtcacccgaaggtgaagtgctacagcggtattccgtgcacttgcggatttatatgtgatcgtaagaaataccaacagcggctgacgcggcgacgggctcggggacggcgtgaaggaggtcggtggaggacggcggtcggctcggggatggtgtggaggtcggtggaggacggcgggggacgtcgatgcggcagtagcaaggacggtggcaaggacggtgggggacggcgtggaggaggtcgacggcggccgacgcgggctcgaggaccggtgccggctcggtgggcgacggtgtcgggctcccgaccgaggtggcggcggcatgagggctcgggaacggcggccgatggcggcggtgggcttccaaaggtggccgtgctagggtcagagagtggcgaacttcaaaaattttcatctagatctgacgagagtgaccctaatcaaatatgggcaagcatatctcaatcgggctaatctagacccctgacggcattaaagtatgcccgtagagtgacatatatctttgagcttaactaaagccgtacgatgaatatttgtgagggcctaaactaatcccctaaaataagtatttttttagctttctttaaggccccccggaagatttgccatttttcacttgaccaattttttttatatggtgctttttagggcctgtgtcaaaaattacttataa

SEQ ID NO: 78540 - DNA, 4107 bp, Oryza sativa
agaataggtggccatgacttgtacacatggataaatcaaactattaatgatggagcgatggaggcatataaatactacgctccaacaacgttgttgattttttatcattcatcttattttaaaaatttacgtaattataatttattttactgtgagttgttttatcacttaaaatactttaaacataatatatatatatatatatatatatatatatatatatatatatatatatatatatatatatatatatatatatattatatttacataaaaaatttaataagacgaatggttaaacatatatttaaaagtcaaccgtgttatttattaaaaatgaaggcagtaataattatctacaattttatctatatatctccagtgatctttaatttctttttccaatgacaatagctagtagtactagctccggtcaatggaagaaaacatgaaaagccaagccaggcgcacgtgtgatggggagaccgacacgactcggcccgatccggttccttgaaccaataatccattctattactacatccaccccgtcacatctctgctcggcctaagggggcatccggtcgttgccgcgcgtgatttgtgcttctactgtcactaccagtaaatgatttttccatacgaggaccaatcttaactaaatctgtattttcatatacggtttcttaaaaagtcagcaagaaaaattaatttttacagataatgctcttgacatacccgtataaaaaataaatatatttttgttatacggatctcttaaagagccgtatacaaaaataaatttttacatgagagatacataaaaagcacgtgggtccccgcctttttttaccgcataaatttttttatcccctctctctctccagcacacctttttaactttctcttctcctctcccaatccttatctcttccccactctcacctctactctcctagtctcctctcccccttcactccaatcacctctctcccgatcacctctactcttctcccctccctctctctaaccttcctcgacaatggcgacggtgggaacgagcggccaacagatggatccgctacacctgctcttgggatcgatgatggtgtgtagatctgctgcccctgcctcgcgaatgtcggcaagagcgagcggttggcgggtagatcaactgccccagcctttggtatagcaacggcgcgtacgtgcggatctgctgcccccgcctctgggagcggtggcggcgggctcaggcggtaggagcgggcagccacggcgaccggcgcacagatctattgcccctactctcgaggatggcgatgatgatagtggtagtggctaaaacgacaatgacagcagtgacggttgcaatgacgacggcggtaacagctacggttttgggtgattttgtttttcggatttttttcaccgaaactattttcatgtgcgattagcataggtgaccgcatgcgaaaatttcatttcgtatgcaattgcgctacccgtatagaaaaatggtgatcttcatagacagctgggtgtgggctggtcagccggatgcaaaattttgttttgtgcttttggccgtctggaaaaaaaattatagtgggtacatgtggcattttgtagatcgtgctcctttaattaacgagaagacatctacccacgtcacagtaatatttataaacaacgggatgaaagcttacgattctaccaccaaatcacgcacctttttaaaagattgggcatgaattatgtcctaagtatatggagtactccctattaaaaattagagcaagtatacagaagtattttttttaagtcagctaacaatatcactgttttgtctggttaattaattagtatgtattatggtgattgttatttgacaatgcccatgcgtatttctaaaggcaaaacagtatcactagtgagcaaatccttattggtaccagttgggaaccggctattggtgtcggttacccagccagaaccaatttgacggctccaatacccaaacacatatgtaccggtacctatagagattatatgtatcggttcttaccccaacaccggtaactctagttttcaacgaatgaaaaaaaaatcttggccaccaacgccgccgccaccaacgccgctgccgctggtaggagaaggcagtggagaggagaggtcattgcggggaggaggcggatgcataggagaagggctgccaccgctgctggtgaccaccgtggtcctctccgctgtcactgccagatctgggtggccctgcggtcctctccgttgtcgccatcggatctgggcggccgctgcggtcctcctccaccgggagagaggggccggaggggaggatggcggaggagtaggcgacgctgcaaccacctccacctccgccgggagagagggggctggagggtagggtggaggaggaggaggaggcgacgccagccaccatgttgcaacaaggaggcggatatagaggaagaggagtggagtatggagaggagagagagagatagaggagaccgcccagatggataaggactaggaggaggaggccgcctggacgaagtgagaatgggtgctcggttcaacttggctctggtgccgggcacctatagcttattataggtaccggtttttatgcaaatctgacacacctataatataagtataggtcctttttttaaaaaaaaaaatcggcacatatacaataggttctagtttttatggttggattttagcatgataacaataaataaaaaaatgtgtaagatagctaaataatataaacttacgtaagtgatatggtgtatgataatttaaatttaaatagtatatagataattcaaatgtaaaagtaagataatggagttttatgagaaaaaaagggagtgagatagtttggaccatagattaatcatctaagtctaaaaataattgatgtgatatgatttaatgggagaagagagaaataacactaactaagtgaggatgaaccaaataggtatatatatatatatatcataaatgatgaagatatatattgaaatattatttaacattcttagattttaaaactctaaaatttaataaattataaaattatagataatataacatgcttgcatgatgtttaaatgcaataattgttagtgggtgatgatgttgtttcttgttaatgcatgataatgtgacatctttgtatgttgagttttaggatttagtaggttataactttacaataagataggataggtgccagtttaaaaaaataaaaaccgacacctatgaaccggtacgtattatatgttttgtagtagtgtatctcatagtactgcatgcagcatagcatcgtcacaaatgggccaagagcctatcataacggttctgtgaaccatcatattttttatgtttgtgataatatgaggtcgtcattgaatgtttttctgccataggaaaatttctattggaaaggagggttgaaatacgtgtacaatgaaactcccaatttagatgaaaacttgtgtaaaacaaaaaaaaatcatctaaattcacaaaaaggaagatctcgcatatagatgaaatgatggtggacaatagtgaaaaaaatcttgtctgaattcgacttcattataaactgattgcgttgggccatttgtggtgtatggtagagacattagaaaaataggcttgggattaggggatgtttggctgctgagcatagtttgccttgttttttgtatgccaaacttttctttaactttatcccatacttcataaatacaataagttgtggtacttgataagaaggctaagagcaagtataataaataagtgatgcaagtgagcttcagaaattgctacattagatttgtgtttaagtgaaaaagagagaagaggggagaaaataaaagcaggctacatatttgtagcaagctgtagcacaggctctagctcttaagatgttgcgtgcgtatgagaagtcgcctaggtattagtagtatagtatacatttatatgtatatgtataggcaggctattagattgactgtaaataatgtatcaattttagactatacaattaaactttcttta

SEQ ID NO: 78541 - DNA, 3354 bp, Oryza sativa
tgtatggaaaaatcgattttcccgtacaggcctcttaagaggacagtatgcaaaaatgagatcattttcgcttgcggctcacttaagcgaccgcatggaaaaatcgatttttccatacggaccacttaaggagccgtatgcaaaaataaaatttgaaaaatttaaaactagtttatctcactcatatgaactttaaattagatgattatttttcctaaaagtttctaaaatcatgctctgtcatgttattatgttcatactgccattattttggccttttttcttgtgactttgttttatcaattaaaattttgaatttcaaaattttgaagcagtaatgatttcagctgaaaaagtcatcaacaacaaagttgtataacttatcaagatctataacttattttttggtcatttcttcatcagacaaagtgatagtaacattttcacaaaatttgcatatctcttatatagtttataaaactttataagagagatatgtgcattttgtgaacaatcttacaaatcattttgtcggatgaaaaaataaccaaaataaaagttatagatcttgataagttatgacactttgttattgataactttttaagttgaaatcatttagtatttgaaaatgttgtttgaaattgtcataatttgaaattcaaattcaaactgtcgaaaaaaagtcatatagaaaaatgaccgaaacaaaagttgtagatcttgatgcattttacaactttgttgttgacaattttttcatttgtatcatttactacccgaaaatttatttgaatttcttatattttaaaattaaaagtaaatttcacagaactacagatactatgaccaaattatcacaaaactacatatttaactcggtgtatcacaaaactacacatttaacaccaaatttatcacaaaactacacatttaagatgaagtgtcacaaaactacatatttagtaactaaattatcacaaaactacaggtttagaatcaatttaataaaaagtaaagatgtttatagctccatcataacaatggtgctagggatttaaactccaaaagttttagttttgtgataaattcaatattaaatatgcatttttacgatatttaatctaaaatctgtagttttgtgataaatttggtgctaaatgtgtagttttgtgatacaactccttaaatctgtagttttgtgataatttggtcaaaatacctgtagtttgtgaaattgactgtgaaattaaaattttctatagttcaataaaactcagatagagaaatgaccaaaagaaaaacaggacacctaaatgagttctacaactttgtttttgacagctttttcatacgagttgatttagtgccataaaaatcgattagaaatttcaaatgaaaattttccctcctcaccacttcaaaatatttcatctttcatcctcctctctctctccccccctgatatttttcccttctcctcactctttctcttcctctctctcactctttctctcctctccctctctttctcttcctctctcggtaccgagcacgagtgggcggcgtgcgcgtgctggtggctagcggctgccgcgtcgtccccgtcgctcgggctgcccccttcgcggcggcgccgactgatgtgcttgagggtgtcccgatatttcgatgagagggataagtagattggatggagtgacgttggcgatccgactacaactatccagggatgttgcgccttagcaatcgttacaccaactccagaggcggtgtaagcaatcgagaaccagcaagaacaagatgaacaagcaactaaatttgcgaatcaaagatgtttgattgaatcaatagaagtaacaagtggggttcagtaacaagcaatccggcaatctaatcgaccacgggatcaactcggcaaagtagcgacgctgtactttgatctaaacaaaacccgattattcttggtggcggagaaagctataagaagaggaaggggacaaccacagggatgctggggtcgttctctaaccctaggacgcatccctaatggacccaacttgatacacggcccattgggcccgaagaggtgacgcaacaccgtggacagaaaagaactcggtagaaaaatgaagattgcggctgctccagaactgatatggacaagaggctagatccatttgaaggtagacttgatagtacttgcacgcccaaatcagagttcgcatgaagtcatggcgaccgtcaaaagttgggactgtgctgcagtccgaatccaccccgcgcgaatcctcacccatttgattctctccattgttcctgaataaaacaagagtgcacgtgtctccggggaataaataagaatcatatgaatttaagaatgaatgcacctgatagttgagttgacgtgcacgagcgcgagtaataggacgttgaagttgtacttgtggaggcgtggatatatcgttggtgttgatgttctcatcaccgaccctgacgacgacgaggaggcgccgaccctgacgacaatgagcctgaccccgacggcaacgacgagtgggcggtgacgacaacgagtgggcaacgacgataacgacgcgtgggcggcgacgcggcattgtgtgtttagatgatttattatgagaatgagtagttaatgcttgtgtgtcactctacccttggattatcttaacccctgcttagaatatgattatcacaagtaatatataaattattagtcaagttctctctacattatcttcccacgggataaaataaatacgatacccttggaatattctcgggtgaaatgctacaatggtatatccatgcgcttgtggatgaactctgtaaccataatataccaggagtatttctgggccattgctgggaattatatttctagtaatgtcgttaagaaataccaacacacgggcggggctgttagtgttatggataccacatacctaatagtagttgactaagcacgacaaggcccaccacataccatatcttatacggaatcatacctcgtatatagaaggagattcggataaggaaggacaaatagagttctatatgaaaatgacaaggactacctggattgtatccatattggtctccctagttcttcttggacaaggggacacctatgggtataaatacaagccccccaggaggagaaaaagcaagccacaagaccaacaagacacaacatatacataagccaacacacaccgccagatctcgacatcagagattagcctagacataccgcatccggtgcctacggaggccggctagagggatctagcgctatctctgatctcgacgagttcatgctcgaggaggaag

SEQ ID NO: 78542 - DNA, 21348 bp, Oryza sativa
tgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcacctcgtccctatctctgtctggtcggaacgtgccctgagaggaggcttccactgcatctgttagtcatcgcgcagcctctcgtatctgatagccgaagaccagtgagccatcagctgggttgagcgttccaccgtgagcatagtaccagaacttcgatcgttccggccaattagctgttgccggttcgataccccatctttagtcccggttgttctcaacaaccgggagtaaatatcttttcctgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatacgtaattaacatatgccatacatcaattgatttatatggataatcaatacatccaaaatagtttacatcgtgtacacaataattacggcacgtactttctcctcactattgttccctccttgtgatcgttgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacacttcggctcatcaggccctctgcccttctttcctttgctagatatgtccttcacgtaaaagacttgcgttacatcattggcaaggacaaaaggttcgtctgagtatccaaccttattaaggtcaaccgttgttatcccactatcatcaaccattacgcctccaccagtcaacctaacccattggcaccggaacagagggaccttgagagaaccatagtcaagttcccatatgtcctcgatggcaccgtaaacgtgccagttgttccatcgtgtcccatggcatcgatacgaacagcgctgttttggttcgtgctctttatgtcttgggctctcgtgtagaatgtgtacccattgatctcatatccctggaatgtcgcgatcgacccaaatggtcccctcgctaggaaggccagttgttggttgatcgtctcgttacccatgagatgttgtcgtagccacgcggggaaagtatcgatgtgatgccgtgtaatccatgcatcggacttaccgatgttcctggcgcgaactagagccaagtgctcctcgatgtaaggagctactaatgaagagtgttgcagaacagtgaaatgggctttacggaataaattgttgtctaccgtcattattgctttccttccgagagttccctttccccgtagtctcccttcatggcgtgattcaagtaccccgattgggcgaaggtcttcgataaattctacgcaaaattcgatgacctcctctgttccataacccttggcgatgcatgcctctggacgagcacggttacgaacatacttcttcagaacgcccatgtacctctcgaaaggaaacatattgtgtaggtacataggcccgagaatactgatctctttcacaaggtgacaaagcatatgcgtcataatattgaaaaatgaaggtggaaatatcaactcaaaactgacaagacattgcaccacatcattctgaagggcttctaatctatccggatcgatgaccttctgcgaaattgcgttcatgaaagcacatagatttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggttggaatcaagtaatagcttcctttctcttttgtttccgggtgaaggtcgccgcgttgttccatatgcttcagatcattacgtgcttccagtgtatctttcgactttccatatacacctaggaagccaagaaggtttacgcaaaggttcttagtgaggtgtatcacgtcgattgcatagcggacgtccaagaattcccaatagggtaactcccaaaatatagagttctttttccacatagccgcgtgaccatcttcgctctctatatgctggcttccaggcccctttccgaacactactttaacatctttaaccatagcaaacattgttttcccgctgcgatatttaggcttcgtacggtggtccgccttatgttcaaagtgcttgcctttcttccgtaccgggtggtttgctgcaagaaatcgacgatgacccatgtatacaaccttcctacagtgcttaagatacgtattttttgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcaactatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgttaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttagccacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatcatagactaaagttaagatctttagtcccggttggtagcaccaaccggggctaaagatcaccgggatctttagtcccagttagtattaccaaccgggactaaagttaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggtctttttttaattcataataaaattaaagaaagtaatgagatgttagtatgaatcactgttaaaagaaaaagaaaggaaatttagtttgtttttttaagctcctgtccttttgaaggccgggcctttttgggcccgtctaaggtctattaattcctcattgtatatatataggatacctaaatactcctagtatatactactgagaatatattgcagtccagataaggcaagagcacaacaaattgccttcaccattcagttttgccgtctacacatgtaatatatatcattatctaaaaaaaacacacatgtaatatatatctccaaaacccagtagtagtaatcttgaacgaatcatcatcatcatcatcatcggtctgcatcactgaggtgtcccaaagtccaactttcatccatctgcgcgtacgtgtgatggaggaattaacacgagtatggtagtaagcccatacgaaaatcttcctcctctttggcaaaagaagtcttgctaaattctctaattttaggctcttgtcaatttaagaatcttaactttttccgcagaggatgaaaaaacgagttaaatgctggcactaatccaaaaactctgcacctagatctccctcagtctcttcaatgtattctgttcagattgcatatattggatcaagatcgacccacaggacccatcaatacttataatagtacatgaaacaaaccaaaccgtgggtaacaattcaagtcctaaacttgacatggttgctcgtacttactgttatttttttattcaatggtataagtaacgtacctgtcgacagcaaggcatccatagtaacttcatcaatctcaagatatatcgaacctatctttgaaaggtcatggtaatttcattcaacttaagatatgcccgttctagctatctttcgaagttgtgtatgtatacgtttataggggtaagtgtgggcacgttgtgagcgacggtgtgtttgtagtgtgtttaaaaaaatcaatgaagtatttaactaattaattactacgtgcttctttcttaaccagtccaaaattaggcagtatatatatcaaacgaaactgatgaatttttctttttccttcttttttctttgcaaaaattaactttgatgtattgtcatgttggacgatgtccatgataggagctctgttatatatagggttggccggatatgtgatagtgaatcaaccagcgtccctatcacacggggggagagccccaatcatgtgattttggtcctatatatggagagtagtacgccaacagcaatttgatgattggaagatgagcttaattaatcgccatctcttccattaattcgatgatcgattggtatagtacgtacgtactcctctgaatccgataggtcactcatcgatcgttaattaaaattaacacgattttattaattatttcttgatgcttatatattagtactagctagctgtgttacgttggtgttttaaggatatagggcctggattctccgataggaacggcacccctaccttgaccatgatatgtactcccaaaggtatagtcgtggcgaggtaagagacgacaaacacacaaacacacacacactgctctctcccaggaccctcaatgattagatgaggctagtctagtgacaaatttgcatccatctgtccctttttctcaacattggggagcttgttctctttcccttgtcatctgatcgtggagcaactttgtttttgttttgccagtacatgcagcactatttggtgagtgggatgtccatttttcatttaattttcactgtgctgcctagctatactagctagagtatttaattgattattcttttgttgtttttttctcttcttctagttagccctagtgctttattcatgtgctcaaattttgttgctaacatcaaggatggatttctttttccctcatttcaagaaagctcactcctaccttttgacaatggaaaagttcacaagtccacaagctgcaaatgcactgctgccttttggagcaaagataaatttataaaacatttttaaagctaattaaatcacacaaccaagatccatttagacaagaagagaaacgcaaagagtaacgcttagtatttctgtgtttgtgcagttcatgcgttccaaaaggaaaagaaaaaaggctgttaatttgatgataaccaaagttcctgttaatctgaccagtgattcgtacacacaaaaggaaaacgtccggtctctctcacgctctcatctcatgacgctacacacatcaatgagcattaagcatggggaaaaggagaggtatcaaaccgggggggtgagggccccaggagtaggaggaggagatggagagaggcagaagaggacaagttagaggccctcgtgcaactctgatttgattgataagccccatgtactaccttgacggcacatcccaaaagccaaaaacaaaaaaccaacacgtacgcacacgacggaatagtaaatggaagaaaaaagaaaagagagggagagaaaaaagtatagcaactggcactgacatggccgcgcacacaggaccggcggaaaagacgcatgaaaagcgcaggatttcctgggaatctctcgtttctgtcctttagccccaaggtttggaccaaaacagctccaacaacaaccgactcatcaatcttaccaaacacttgagactactggcttgtagtaggatttaaccatttaattaggtttgtaaaatttctttggaattcatttctatgctctagttttaaagaattttaaatatgagctccaatctcaagttaatttttcctataagaattccaaagcaatatctctctttctcttactctgtgcaagtaatacatacctcaaaaatcttatatttttcccatgagccatctaaaaacatgtgtttgagcaatcttgtgattctattttccaccagtaggattgatcgtgccacaacattccaatcatgttttttttctattatggtttttttttaaatattacgttccaaaatagccttatagaactcctttaaatccatataaattttagagtatttccttcattaataattaaatcctttcaagactcttttcaaacctaggaattgcatcagaattccatcattttaaagagtggtgtgcggtttttttattcacatcaaaattccatctgtgtgatttcagtgaaaaaaaacatgttctgatatatgtgtggtagtatataaagggttaatttgatacattcaagtagaacattgcaaatttgccaatttgaaaaaaatgtcattaccattcacggtatcgactgggtgctactgaaattttgtaaaattagaactatatcaatattgtcacgttttctatattcttccttattttctttcttcttattaccatcgaggggtcggctacgactacgagaagtctggtcgacaagctcccccaatccatgttaatataaaggaggtggtcggcgagcatccatcgctgccttgaactaccgtgcctggaaggcctcagagcggtcgaggatgcgggtgcaagaagcgttgacaaagaggaggtcggggatgatggggtcgaagccaggatggcgagtaggcgtaggttgaccctgaggaaccggcacgtcggcttcctccttgcagtcgacccctcgactgtgtcacccgcaagtttgtgggctagagctcgtggtagggtcaaatgactatggcatgactagcctcaacgccgccgacaacaatagctggtagccgcgaagactacgacacggcgaggaagagggagctcgcggtgatgggaaaggccccgacctatatctagcgaagccccgtcctcttcggtatcaggagtaggcagggcagttgggaggagctcggggcatgtggcgacaacgcgacgtgcttgagcgagtggtggcagtgcaagagtgggtgggggccatcgggaggagctcgtcatcgacccctccaagccgagtgcaaagctaacgatgcccttatccacagacaccaccaccgcaccgttcgagcgttgccacgtcctcggatccaacgctaggctgacactatggacctcgttggccggcctcctcggagctcactaacgatgagaagaagaaaaggaaagaaaagaaggaagatggaaaacatgatgatgatggcacgatttcaattttgcaaaatttcaatgacattcagtcgatatcgcgaaaatagtaatgatattttttaaaaacaaattggtacacttgtaatggtatggatccaattaatcctattataaatgtacattatacttgtttatgtattccaaacagctcagcttgttaataattatcctcagtgctagtatattagtatatacaaataagacatcgatctccatctccctgatctaaggctgtgaaagatgaggtatagaggataggatggattgatgggcaacggatgcatgtgaggtcgcatgtggcgctaatgagagggcacatggtggagctagcagcagagcaagagagggacattccccactcgtgtgggtggttggttggcggcttaaattactctcactttttgcatgacagagttgggtgagtgagtgaatgacactccactatactactccactccagtaccaccagtcgacgatgcatgtgtgcatggattgatggatatgtagagatagatgctctgtccagtgttgtgcatgcgtgcgtgcgtctgtgtacctactcgttggaagtactcgcggcccccttctttttattttctgcatgtttgtttgtggcttttcatggatcatatggatctccaaaccgggcgggcgccccatatatctctgctgcttctccgaaggttccttgatcgataataaaaacagctgcttaactaattgcaggaccattttgttggtgtcccgttttgcaaaagagaaaaaaaaaaccgctgttgaatttcccttttcccaaatccacttccgagacaaacaaaatgaacaagaggccggggacaagtgagttaagaggaatgaatattgtacacctatccaatcttggaggtcgagaaagcagagacgagaggtaaaccgggaaatggtaacaggcgttgaacactgttccatcggatcgatcgatgggcacatgaatgatagagtatagtagtactagtcgtgtgcgcccatgggaagcagacatacatacggcctaactagcgcacagtacgtacgcactgtatgtgtgtaggcggagcccccccaactcccaaggaaggcggccgatcagatcgatgagcagctagcatagcaaaatgcaggacgatccatgcaattgatgcgtgcctagctgtgagtcgatcgccggccataaatacacgcacgcgtgcacgtacattacattacacccatccatccacgatggatcgatccatggccgtctccatcgatatatactccctccgtcttcttaaatgtttaacgtcgttgatttttttaaatatttttagccgttcattttatttaaaaaaaattaagtaattattaattattttcctatcatttgattaattgttaaatatatatagttttatatatttcataaaattttttaaataaatcgaacagttaaatatatttaaaaaaattaatagcgtcaaatatttaaggtacggacggagtatatatctgtcgtatactcgaatcagtggttggaatgataaatgaagagaggcgaaggtttggggcgggcgcgtatatcatgcatctatgggcaattggcatcggcgcctctagtaggagtacgtacactcctggagtagtacgagtagctagcagcaataaatgcacacggcaaagatgatatacaacgtactgtaggcatcggtgtatgcatggaccgacctcccatccgtgcgtgcggtagccccctcgctcctcccctgcaactgcaagctgccaacgcgggcacacagccaccgcacgcccatctatcgccatcccctctcctctcctatcctgcgacctgcgcgcgcgtgcggacgtacgtacgtacgcgcggccgctcgcgatcgatctctcctctccgcgcgcgcgtcaattcattgctcccaaccaaccaagcgcagggagcaacactgcgctgctgactccaccgcccggcggccgcacgcgtgcctgcagcctagataggctaccgtagtagcgctagcgcgggcgtgggcgcggcgcaaaaaagccgcagagcccgcccgcccgccccgaagacggcagacggcgcaggaggcagtaattgcgatcgtgcgggcgtgcgggggcactacccacacaccgcctactgccgtcctctttctttaccattaacgtccagcccatgcaggctgtgtttagtttacacttagaagtttggttaaaactagtatgatatgataggaaagttatgcgtgtatgaaatgtttgatgtgatagaaagttagaagtttagaaaaaaaactttggaactaaacagggccgcagtcccctgtctcagttcctgttttcttactatcctctccaatgcatttatttattatctagaaaatcagtaatttatccttcgttctaatataagagcaggtgcaatactggacggtataaggtccacgtaggattttttgatgagctagaggagagacagcagcagcagcccaactgcatgctcgtcccgaggcagcggggcccactagcgcgtccgcatcgccaactcgccatccgctccgcccgcgttccccgttgtcgccgtcgcgctacaccgaacgccgcctcgtccaccatcgccggcgtctccgtcgctctcgtctgccgtcgttgagctccaccgggccgccgcctcgtccaccatgaccggcgtctccattgcccttgtctgccgtcgtcgccaccctcatccaccatggccgccgtctccgtcgcctacgtcggccttggcagcggccctcgcccaccgcgaccgcctcggttgcggacctcgtccacggcagccactaccgccgccactgtggttctcgtccagcccgaccgcctgcgtcgtcctcacccgcatacgccgagccgtggccaccatcctcgcctcgtcgcccgtatccctttcgccattgtcgccagcgtccatctcatcgtcctcgcccacatccgccgcgccgcgaccgttgtcctcatcctcgtccatcccgccgtccccgcccacatccgtcgtgccccaccgtcctcgtcctcatccatcccgccgtcctcgcacgcgcctgtcccaccacccttgtccacgtctgcagcggccgccgtccccttccaccacagccgtcgtgtgctggcctcgctggacccgatgaacacggtggccaccgcggctgtgccggcgagcgccccacgccacgcgaggcccttgttgaggctgaggaccatcttgctgaccgtgatgtactggtgttcgtccttggacttgagcacgtgaaggatcccgtgcatctcctcctccagcaagaaagagagtagagggatgatgggcccataaaaattaaaaaaatatttgtgttgcagtaagtatacgatatctctattgtatcaattggctataatgattactccagatgaggtgtccctctattgcagccgatagttggctctgttattgacctcgctctaagcttaaatttttcacgcatcccaagtataccaataaaaaacataatactttattcttctttttatattttgccaatgcatttatctcctactttctcaaattcggatgcaatggttactcaaaaatgaacttaaaaaagagagatgagtcaaaaacgaacttattctgaaacagatgtagaatcgaaacaaaagaggctccttgggcaaaccctaaccaccgctacaaccccatcattcctctatcctcacagtcgtccaagcgagccactggagatctgtacatccattaggaaggtggtggcggggccaaatcactagctagatccaagccagcgagaacaaccttatggtgattttttggttgtggatggcaacatccttatcacaacatgcagtacactggtggagaaagcgtttctagtcccggtttgtaaccccccttagtctcggttttcaaaccgggactaaagatcgagctgaccttttttttttgcatggccctgttgctgcatatatatatatatatatatatatatgaccaaaatatatatttacattaaagaaaatgtgtacatgcatatagaaaaatagacatgtattaattacaatccattatgatgtcctagctagctacgatttcgacgtagtagtagttgttatctcagaagctaaggacctatgaattgtatttccgtcatagtagaattcacccttgtgatcaaggatttgttcgttgatgaatcccatgagttgttcttgaaccgccacgataaattccttgtgtgtgatcaggttatccctcatgcgaataagctatatgaatgtatgaaattaattagtaattaaacaacaaatcgatacgtacgcaatgaaattttgaatttatttgcacgtacatcgagctctcttgtggtgatgatttggtctgcaaggcagtggcaatactcgcacatgtagtagccgcacaagttagttccctgcttttgctttgcgcactataaataaatgacaaacggcgagagatctaattaatatatacttgtatgtatttgaattggagatgaatataaatgtagagcatgtgtactcataggaaatttgaacttccgcctaagtctttctctccatttgccgcggaccaaatgacggaccaaatcttcaccggtcaccaacggctcgatctcttggtttggttgctctctaagctgagggactggtttggactttccaaaagatgctttcttaagtgttcgctcatagtccgatagctttatggcctctttggcaggtgcagacatacccctgaagaagttcctggtactcgggtctataggaatcttcttttctggacttcgaggcttcaattgtctcctgacttctgatgccacaaaagcgtcaagatcctcttgcgtgcaatcgtaccccgggtccttattttttgcagcgtcaactttcgccttctttgttgcccttgtgggggcaggcggtggagcttggggggcccttgacttggaaggtgccagacgaggagcttgcgaaggagtcggtgtaggagcctgaggaggagtcggtgaaggagcctgaggaggagtcggtgcaggagcctgaggtggagacggtgctggagcatgaggaggagacggtgcaggagcctgaggaggagatggcagagccggaggagatggtgcacgagacgccgcttgtcgcccagggaggatgatgtaccgcttgcgccatagtataatggcgtggcttgtgtctcgtagatgcgtctcaccgtctcctctatggtaatccaactcgaggtcctcgtacgtgccttccaccaactcaacttcgaccttggagtatcctgctggaatcggcctgcagtggtaagtacctgaagggtccgttggtatggccatgcccgacgccaccttcacgtggtgagacgttatttattagtaatcaacatatataagcagcaacttgcggaatggacaaatctaaaatctataaactacaaacttacctttattgataaattcttgaaggaaatatgcagcttacatggtgtccgctgagtgatgtcatcaacagggcaggtggtttcgtcctgggtttgcatggcgtccatgctctgtgatcctacctgccccgttgaggcgcagctgctacgattgcctgaagggctcaccattgcaggaggaatggtcagctggggatcatgggaccgatgtgcggctatgcgttcatcaaccttccttgccacctcctcttgcatgctgagctcgagctcgataccctgtactcaagatctgcaatcttcgcatcggtatctctcttgctcctcatccgactcctgtacgtgtggatgtcctccttgaatccaatcttccaaggaatcacccctttccctcgtattcgtcctggatgctctggagtctgcagggcgagtgacagctcgtccttctctctctcaggtcggaacgtgccctgagaagaggcttccactacgtccgttagtcgacgcgcagccttgcatatctgatcgctgaagaccagggagccatcaattgggttgagcattccaccgtgagcatagtaccagaacttcgatcgatccggccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttatatgcaatgaactcgtcccagtgatcccttagctttgggaatgtgtcgaagttcggtgtctgccccttcaggatatatttctggtacagatctcccttgaagctctgaaactgttctgccattttctttagagtccaccttttcactttgtcctctgtacccgcgggaagggtgaatgtctcgagcattgcggtccacaacatctctttcttcgaatctgggacaatgctctcatgatctccgcgtgcccttgttttgccagtacaccgtactgacaggcatgttatcccgcacaacccaaccgatgtgtcgtacgtagttcttggctgcttccgccggggcactaggtcggccgtcttcgtccacttccgttatgatgtgccaaccctctagcttcttcgcggcacctcgttgcccgcgtgccctcttctatccagcggagggttgacttccactagcctcctcctcctggttcccctccacatccctctccacgttcccctcctggttcccctccgcatccctctccacgttcccttcctcgttcaagtattggtttggatcctcgttcccctcttcttcgttccagtactggctgctttcctccgcgattgtatcgtacagtatctattcctcatcacgatcagccatctgttcatacgagaaatagttgctaagtctataggtcatttttgctttaacaatcttatatgctaacaatcatatatgctaagtcaaatatgctaagtctaactgtcgtatattataaccctacacaatcttatatgctaagtcttattacaaatctaataatcttatattaaaactctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcgtatattaggaccctagacaataattatataccaagtctaattacaaatctgataatcttatattaaaactcaaataatcttgtattagaactatgctaactcaaacaatcttatatgctaagtcttattacaaatctaataatcttatactatgctaagtctaagtgtcgtatattaggaccctagataatcatatatgctaagtcgtttaagtgtcgtacattacaaacctagataatcatatatgctaagtctaagtttcgtatattaaatctaatagttttaattgcattaaaaaaaatctaacaatcatatatttacatcacttgcctgtgcgaattccttcgagggctagctaccactccggcttgagggacgacgacgacaacgtcttttctgcaacatacaaaaagatgtattaggataaacgcaaagtaacatatattgtatttcacattcgcgttctcgttaagttcacgtttcgttcacgatcgttcacattcacattctcgttaagttcacgtttcgttcacctacgtgcgttcacgttaacgtatgttaagttcatgtttgcgttcttgttaacttcacttttcgttcacgcacgttcattcatttacgtacgttcatatacaacgttaagttcatgttcgttcacgttcacgttaggttcacattcgttcacgttcacgtacgtttcgttcgttcacgttcgttcgttcgttcgttcacgttcacatacgtttcgttcgttcacgatcgttcttcgttcgttcacgtggcggcagcggagcggcggcgtggcggcgcggcatcggcgtggcgcggcctggcgtcgtggcgcggcttcgtcggcactgccggcgcgacgtcgtcgccggtggcggccgcatcgaggtcggggttggcatcgtcggtgcggcggagtcgtgttcggccgcgacgacgccggcggcagcgtcggcaacgaggcggctgatggcggtttggggagagagagagagagagggaggcggcggcggctctcaccccagagatgcggcggcggcggaggcggcgacgatgacgcgcgcgagacgacggcgagatacaacggcgacggcggcgcggggatgccctaggcagtggcggcgaaggagaagccgagagagatcgatccgggaaaaaacttctaagtgttggtggagaagacgagggcgcgcatcgggaatatatatacccctagatctttagtcccggttgatgagaacaaccgggagtaaagatatctttactcccggttgatgagaacaaccgggagtatctttacaccctgttgttctcatcaaacgggaataaagatattttccagctatttccaaattctttttaaacccggttagtgttaagaaccgggactactgataagcgcactgaatattaatttccattacatatgtgtttctaaaatagaaaataatgcattaaaattatttgaagtcgaaaaatcaatgacaattacttcgaaacattattgttgtctgtagtaaattaagtggataaaacgtaataagcaaatatatgatttaaaattaataaaaattctaataatcatatatacttagcatatgaatgatattaaattgttaaaaattgtaattaacatatgtatatacatacgacatgcatgatttaaaattaataaaaattataataatcatatataattagcatatgaatgatattaaattgttaaaaattgtaattaacatatgtatatgcatacgacatgcatgatttaaaattaataaaaattataataatcatatataattagcatatgaatgatattaagttaattgttaaaaactctaattaacatatgtaaatgccacatgcatgatttaaaacttttaaaaaatttaattatcgcatataactagcatatgcatgatttcaaattgttaaaaactctaagtatcatatgtaaatgccacatgcatgatttaaaacttttaaaaattataattatcgcatataactaacatatgcatgatttaaaattgttaaaaactctaagtaacatatgtaaatgccacatgcatgatttaaaacttttaaaaattctaattatcgcatataactagcaattacatgatttaaaattgttaaaacctctaataatcatacgtaattaacatatgccatacaacaattgatttatatggataaccaatacatccaaaatagtttacatcgtgtacacaataattacggcaatacatcggcggtgacggttgactgcacgtactttctcctcactattgttccctccttgtgatcgctacgtgagtaaggggtgtcttcatttgataggaggatgctagggtcaatcgtcactgtgaaagggggttgcccatccaactgatcgtaatcctcgttagtcttgtcctcaactccgacgatttttcttttgcctgggagaaccacgggacgcttcggctcatcaggtcctctgcccttctttcctttgctagatatgtccttcacgtaaaagacttgcgttacatcattggcaaggacaaaaggttcgtccgagtatccaaccttattaaggtcaaccgttgtcatcccactatcatcaatcattacgcctccaccagtcaacctaacccattggcaccagaacagaggaaccttgagaggaccatagtcaagttcccatatgtcctcgatggcaccgtaatacgtggcagttgttccatcgtatcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttatccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcatgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaaatcaaaactgacgagacattgcaccacttcattctgaagggcttctaatctatccggatcgatgaccttctgcgaaattgcgttcatgaatgcacatagcttttttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccggacggtacctttatgctctccaagcattcaaacatactttccttctatgccttgctaagagtgtagctagctggactcaagtaatggcttcctttctcctttggttccgggtgaaggtcgccgcgttgttccatatgcttcagatcattacgtgcttccaatgtatctttcgactttccgtatacacctaggaagccaagaaggtttacgcaaaggttcttagtgaggtgcatcacgtcgactgggctgcaggaatt

SEQ ID NO: 78543 - DNA, 1274 bp, Oryza sativa
  unsure (1)..(1274): unsure at all n locations
attccagcagttggccccgtttgtgctccgcgcagccatcgccattgtcgcgggaagggagcacggcgcgtctgtggtgctcgtcgtcgtcggtctcggagcccgagacgtggcagtcgtagcagatctctccctcctcgatctggtcatcgtcgtcgacgtttgggcggcggcagcggtgaccaccctccatggcgcccttgctggaattaccaccctccatggcgcaaatattcttggcttcttcttgttgctctagggctccatccaatggatacgatacggctcgcgaaagctagaggaagaatctactcaggctagggtttgttccactaatccgctcggtggctgtgggcggccgcagcgacgcagtgatggttaattatatatatagcggcgtgcgtgttgcatgcgttttttgcggcgtgtctgtgtgcgtagagagagatcgagagagagaggagagaaccactcggatacggtcgggctcccttcctcccaacgagaacttagaaagtttgcctctgttacgaatcgactgctgagagagagagagtagattttatggtgggacatatttttccttaatatttaaaatcttttagagattgtatgtggtagatatgtagtgtttaaaatttctgagactgaaatttggtttaagattgtaccgcaagaaattatttaaggaaataaaatgtctgatagatggttactccacgataaaaaaatggttagatgtttaattaattaaataattctagctttatggatattcctaaataaaaatggtttaatttcaataattaacctattaaacttttttgtctgcaccgtaagttgctttttgggtttttttggttatcatgtggttcattaatctatgtttaaaatttttctaaatacccctcttttcggaaagttttttgccaataatgtgtttgggctatgtctttaaaaaattattttttttctttattacacacactccttcctttgtgtgagaacattacaccctcttgggggagtttttttttcttccctcaagacgcagttcagacgctgggagaagagtatcattatgngccctctaatttggcacccgagtcgaaattattcccttactcacaaaattggtacccgcgttcccacatctttaaaacaccccaaataaggccctatgcgaatatgtgttcacggtgccacacgggccctcccaaggataatggcctcttctgaacaccttaaataatttgaaaacgtccccagaaaag

SEQ ID NO: 78544 - DNA, 1938 bp, Oryza sativa
  unsure (1)..(1938): unsure at all n locations
actgtcatgttgacnctcgtgcgggcctcncgctgtctggccagctgtatgcaccatattaacaggaaaaggattaccatcgaccttcatcggttttttggtatcatcaaacttaatcttgcccccctcaatggccacctggatctgatgtctaaaaaccttgcaatcgttagtagaatgagacccaaaattatgccatttgcaatacctctttttgcctaactcctcggccgatgggattgtatttccagcaggaagttgaatttgcttctctcggagtagcagatcaaagatcttgtcagctttagtaatatcaaaatcgtatttctcttcttttccagaacttttcacccattggcatggtatgacctttttactccttacccattcggccgcagctatttcagaatcatcctcattatcatcctacctatacatgtatggacaaacatgattaactctcttagagttcttcctaacttccgcagacctatgctcatgcagggttactttctgtatcagatgtgacaagctatcaaagtcttcagatgagaacttctccctaatcagagcaatcataccctgaaaggccagatcggctaactgggcatcagttaaactcaagctgaagcatttgttcctcatctccctgaatctctgaatatactcgtgcacaggttcatcatgcgctgcttaatcgccgtcaagtcagatcatttcatctcatgaaccccactatagaaatagctgtggaattgcttctccaaatcggcccaactattgatcgaaccatatggcaaagaggaaaaccaagtaaaagccgatccagacagagataaccagaataacctaactttcagagcgtctatagccgatgcttcaccacactgagccaggaatcggctaatgtgctcataagtcgacacatcatcttgtcttgaaaatttggagaagtccggaactttgaactgattgggaagaggaactgtctcaaaccactcagggtaaggctgccgatacaagcttccagtctcttttggtttaagcccaaactgttccctcatcacatcagcaatcacatcagcccacggtcgttgctgagctgctccttgtggctgttgctgcatgggctcgaactaaccatattgagatgcaaaccgaggttcagccaatccccctggctgatactgggcttgcggggaaggaggctgatattgataactcaagttacccccttggtaattatgaaggttcggctggatattgcgcaccaagtgctcaggaacaacctgaggcattactgtgccgtcccgctgtacgtggtgaaacaaatgttctgggacaacttggtttacaaattgttgtacaggctgaccaccaggcgttgcaaacccggccgatgcacttattgacccctggtgcttaatcggcttgacgatttgctgtcttaacggagtcttgtggatccgctgcagaagcttgctgcttggtggtgttgctgaatccgcttgaaaagctgcttgcttgcacgacctgttgctggattggtggacaaccagctgaantgtgggtgtctgctgaatcgcttgttgctgnatggatcaaacacanngtgggtgtnagaaacatgcaagcacctgatcttggtcaaccgattgcaanctgcccgcatgctattgctgttcctcaataacaaccgagggtactatcttnccttgcgcctatctgatgtacaaatatggaattgttcccgnccccccgctgaatttgggcaacggagggaatcccctaaaaaaggtgaaatctggaccaaaccttgtaattgggagaacattcttgtaatacacgcgccccggcccgtgttcatttttgacactaattttggttctaagtttgagggtttgccaaacccccacttttttaaaacttggtcccccg

SEQ ID NO: 78545 - DNA, 2232 bp, Oryza sativa
  unsure (1)..(2232): unsure at all n locations
gattgcnntttgttgancncccnctngngatggatttctaagtcgaatgctttggtttcttctttttcctctttggatgttgttgacagaaaacacgaggcctaggagatttgcttaactccagtgcaggtccaaagctcgccttcgggtgcgctagcgtgccagttgatttgatcctgtaatcaacaagaaatagaagcaaagaaaccgtggttaaatctataaatgatagccgatcggctaggtgccgatgacatatcatttatctttgagccgatgtcatatgtgaatctatcggcagttgcaaataaacaataaaggactaaatctattcgatcggctgtagatatttccaatatataattcttatgtcgatatatacttaaatcaagtgattgggatagatcgatcgccatgccgagacagtataaatcacttagatcaaaatatatattaataacaggactatatatgtttatagcatagccccatcagatagatctagcatgtatcggctaatactccgatactactctatatcaggatattaaaacaggtaaaatatatcaaacagaagcctaatatacttaaaaaagtaatatcttgacataaagggcagatttaacgtgtcaatgaagcatatagagcaaatataattaaatcagataagatcggctgacactccgatgctaccctaatcgacaaccagaagacaggctagagattgatattctaatcatgacttaatagatcaaactcaactgatgcagcattaaatatgaaaagaagaacaatatctagacaatcaagccgctggaagtttcatagagtggtagatatcttatatattccgagtcaacgtcagaatctaacctaatcggctgccttcctcgatagatgttagccgattgtaggttagatagcgatattgctagagattatgtaagatatatgataacttgacgaatcacataaacaagattagagtatcataaagatggaagcgctaatctcaagaacgcaagccgtcataacaagttttacctcttgttgaagatcgaaaccgatgcagctcaacccgaaagcaagaactcgtcgaaacaaaactaaagtaaaaaagggtggcgatgcaccggaattatattgaacgtgtgtttttaagttacatagggctcggttctatttatacccgagaattacaagatatgtccataatggacacgattaccatctctaacaaactctaagatactataagtctttgcggcagacttttgcccaatcgtatctctaaagaaattacataaagcatcctaattaatagatagaattgcctcctcagagactctatccatgtgcggcaatctccttgaagcacctcaatccaacccgacatcacacgtcaagttgtattatcagaatcagctgtatcggcttttctaatccgactcagacccagccgatcctagtcgtagccgatccggactccagccgattccttgctctgtttccgaactcgatctccgcctccaactttgcttcgatctaatcttctttcctgatgctgatgttaccaaatctggttggtaacacatgccctccaagtccagaatatttggaatgtttcggatttgctgaaatcgactccgagcaaatttcgcactttgcttgtttccgaccgttattgccgtgctttaaatactaaccgtcaccttcgagaaatctcacaccgtgacttccatttncaccgctcaagcgaaaccttgtcctctttcttctccgccattnctncaacgcanaagcgactttcaggcgacttcatcttcggcgagatttccgcccgcagtgatgtcgttctccaccaacccatttgatacgccatcaaccgagtatgctgaggtaagtcctattcgggtagatcccctttcttaacaagagatcgaatttttcctaattttacacccctctcttttttctcggtggttgtgtatttgaagcaatctttcacatctagatggggattccaggctnttattcgaaaaacattaatttttgggcccggtgaacaaccccgtttccactgggtttattattggggaaaccaaaggggccccttcaaatttacaaccccatatttgtggcggggagaaaacccttaaattgggcgccctttagaaaagactcccccaaaaaaggtgcccctcgtggtaaagattttttaaacaaaagagg

SEQ ID NO: 78546 - DNA, 1216 bp, Oryza sativa
  unsure (1)..(1216): unsure at all n locations
caaaaagaggattggttggttcaacaattcgcccctatgaaatgccagaacagaaaaagggtccaaagtttcttgaaggggtcaatgatatctcatcggatgtcctagctgggaaggcaaaaaaaagcaaaatggtgaaagccacaatacaagccccacaccacaagccaaaggttcttaccaaggaggaagattgagaatctaggagagcttttcaacaagtttgcccgctttgaagccattattgatgtagtgtgtaaagtgagatgattattaggaaaagaacttctcggatttttgcttcatggcgcgtggtgaatctgacacagagtatgaagataatgaggtgagtgatcttgaggaagctattaatattttgagtgcaaaaaataagaagtgtgagaagatatatagaaaacaggaatttatcattgaatctcttaaatctgaaattgataaattaaaatctcttattcctaatgataatgattgtgaaaattgtgaggttttaatgaatgagatttcaaaaattagagatgttaatgctgcacatgatttgaaaaatagatcttctcttgcttgtagttttgctttgcacacacgcacattggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtacatggaagatgttgtgaaaaacaatgaactgctttcttgccccaaatgtcgtaaaagcaaaggtgtcatggtagattgtgaaaattgtgctaatttggaaaaagaggtttctcatttgaaaaattctttgctaagattttctgatggtaaaaagaacctcaacatgattttagatcaatcaaaggttagcacacataaccgtggtttaggttttaatcctttctcgttatagaagagtgtttaaagctgattttgaaaatcctgtttcacctgtgataacatgtttggttgctaagtttgataaagatgtgatgttttggcatcgtagacttgcacatgttggttttgatcatctcactaggttaagtggtttggatcttgttcgtggtttgcctgnnctttgcaagnggnagtcaatatcagggcggtg

SEQ ID NO: 78547 - DNA, 14197 bp, Oryza sativa
aatcttctgcttcggatttttgctctttttttatcatgttttttcttttgaagaattcttcgaagtgtctgacttggctactttcataccaatcaaagaaaaagatgttcttcctttgttctctcatttctttatgccaaagttctcttatctttagtctaaatggttcatcgaccctttcaaagtatcttttcatcttgggtcggttcttttgaagcctgagttctcttttaagcaaatatttatcaatttcaaactcatcttcttctatagcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctggtgtttcaatcaaggattcgacttccgactgatccatagacttaggttcaacagcttgagataaaacccatttctcaggcagggtgatctcatcccatttcagggttttggggatagtatgtctgttattaggattggtttgaaggagagtggttaggccttttggtgtataatgtttggcacaaggtgctaaagttgtcatggctttgtagtaaactctgtaggtaacggagatgttttcactccctggttctagatcataaccagatgtttgtaagttgagagtgataactttatggatatttttgtctgagagggatacagaaaaatcgggaaaggtattaaaataaacaggaccattactaaggctggcttccaccatgccaagtaaggaatctttgaaccttttatttctgcaatctcttagacaagccagaacagagacgttcaaaccctttctagtcaaggatctgatagcaacttgtataagaccaaagtgaaggtagtgatattgatgtttagttcttatagaatcgatttctctttctgaaagaagatgcagggtttcatgcaaagaactgattggaatagttttttcaattgttttttgtctgccacaagaggtttatatatatatatatatatatatattgttatattctttttctatagcattttttagaaaacttttttatatgaattattttcatgaaaactttctacaaatatactttttatatacaaactgtctatatagaatttatgtatataaactttcatatgtatagatttatgtatataaactttatatatatagactttatgtgtatgaattttctatatatagactaggctcagtcacgcagcgatgctccgtttttcttttttctgtgatttcctttttttttctttttatacatgatttctattacgcgtcaagtctttctgtttttcccactcctctcctttttcaaatatatattttttgttatattctttttctatagcattttttagaaaacttttttatatgaattattttcatggaaactttctacaaatataatataatatatatatatatatatatatatatatatatatatatatatatatatatatatatatatatatatatatacaaactgtctatatagaatttatgtatataaactttctatatttagactttacgtgtattaattttctatatatagactttatgtatatagactttaaatatataggctttttatttataagctttatagtatgaattatatttgcggttagaaagtatagtgtataaatttagtaaaaaatcatcagattccggatttttctttagaaaatagaatccaatcaaacaacttgataatagaaaaaaataagcatgcaacgatctgatcttgtaactgaaaagacagaatactagtatgtactaggaagtaggagctgaagcacgttattgagacgaactgttcgcgagatgcgaatgttcgtgggctagacccacccatgagtggataaccccttccgtttcttctatggtggacttgctgacccaaactatcaccaggtcgtcgtcatgatcctatgggcttcaccaatagtgaattagctaggccggcccaggataggaattgctagtcatgtactccgtagttctggtgggccatatagagcttccggcccagccaaaaaaatgaccttggattattactaatagatacatgtctgttgattatagtatttattaattagggatgaaaatttcgtgtaattgatagttcaggtggtcgtacggactatatatagagaatgcatgtgtcaactcgctcagagaaaaaataagaagaagaaggaagacaatgtgccaacgagcggtgagcagtgactttgctatagatgtatgatgaacaagtatcacaaattgtgcaagtgtgttgcacttgcacgctggctggagcagtaggggcccaaagcacacatgggactggagtggatagtggcagttggtgggcggttaattggaaccaattgaaactgcctccgggtagggatctcgtggccacttgcacaaatgctcctttcatttaaaaatcttctgcatattttattttctatttttttcaaatgagatattatatttaaagttttcacacattcaaacttaaataaatggatttatcttttcctttttacagtgttggattaaattattgactggaagcagtcatgatgttaatactcgttggttgcatgcatgcttatagtttttgtcttttggaataagttaatttctttttaatcttagtgataaaataaatatacccgaaatttttgcatatagggagtatagtgctatgcctccgagtgttctggaagctagctaatgtactctactatactgtactagagtaataatgttaggggtaaatcttaatgaaaacaccttatgaccatcccatatacaaattaattaagcttctaaaataataaataaattaagagttagtatacattacaaccgatgcaattatcattttttacatgaaaagagactttaaacattgtcatcgatcggtctaagacagacgcatctagaaattaagaaaatcaaaaccacggccatcatatattatatattctgccattctggatcactctagctagctcgaccgatcaatgatccgtataattgcgggcgatcaaataataccggtttgagctggacgagagatgggggatcaataatttaggaagcgatcgatgatcgatgttggttaggtggatgcatgcatgcgcacgagcgcatgatcagatttgttaatctcgatcgcgagtggtactagtactagtagctatagcagcatgcatgttgggggcgcaatgatcagtggccactggccagtggccagcgccaacctgacgaaatccagcggtggggcccacatgtatgtcgcagctactagctagcatcctatgcaaagcatgcatcatcgccgttgcattgcatatgctgcaagaacaaattgctgcttcacagcaaagcagagagagagagagatttggattttggaacgacaaccgcaatgcacgggtgcgggcatgcagcagatcaagctcagacgatgcagatgcatggtcatggatggactaaatatcgatcatgctgtgttgcagtacgcacgggagcgagagggccactgcagggcagaggtgtcgggcagcgatgaagacgatatatgttgtcaacttgtcatactaggatcaaataatggatcggtgtgcatggtgataggccaggggtcaccaacctgatccagtgatagatttgatcggagatgtatgtgttgcagcatgatcttggattgtggatatacattgcatcgtggggattaatcaatgatagggggactggataacaagttagctcggctcgttaaaactcatcttatttaaacttattgtctcaacaatctagctcgattcatatcgttaagcttaacgagctaaaagcctaattcggttcagtagcgagatagcttggtaaacttgttaggcttgatgatgtatttaaactatctttgtgatttcaaatttatcattttatattatgtgaatacaataataaacactaactgataaatagctcactaaatataaataatttagatgtaattaaaaaataaaacactaagttaagaagcagtaaattcatctcttgtactaacgagctaaagctcgtgtattggctggttaagatacgagttaaaagactaatttggttcaactgattaaaactatgagttcaaccgatccgaatcaagctcgctacgagccgattcgacccacgaggcgatcccacaatataattaatgtatgtcctgccaccactattgtgtacttgaaacttctaaaaaaacaagtaatgagttcagcctttgataattaaaaaacaagaattatctgctccctttgttctaaaatataatagcttttaggatctatttggagagcttaagattctgacaagcagctgatgagaatctggagaagctgagaaacctagcttttggtttctaattcattttccagattctacaattacagattctcagaatctgggtaaaaagctagactgtttagggtagcttcttacaactggagattctaagagaagctgcaactgctagaagctccccaaaatagggccttcaaaatttgtcctaaaatataacttcaccatctactttcttaaccaattacaaccttccttcatttaattccacatatttccttaatacttgtatccaactcttaaactttttatattttgagatgaatgtagtagctctagctactttagctaatatttactccctccgtcttaaaataaattcatttttcactcaccttacacatacaaatgcaatagcaaaaagactaaaataccactactttattaaataccaatacaattattttcattttatctgctcccaatacaaactccgatgcaacgattccttagaaataatcttattttgagaccaataaatattgtccaatgtcaatcgaaaaagatctacacatatcccggcaaattatcgatgggcataacttttcaaccaactactagggaaccgaagacccaaaaaccagttatgaaatacggcccggtatagttcacaaatttttttttccaaaaacattacattgaatctttagacacatgtatggagcatcaaatatagataaaaacataatctaattgcacagtttggatggaaatcgcgagacaaatcttttgagcctaattagttcatgattagccataagtgctacagtaacccacatgtgcgaatgatggattaattagtctcaaagattcgtttcgcggtttccaggcgagttatgaaattagtttttttcattcgtatctgaaaacctctttcgatattcgatcaaacgtccgatattaaaaaaaaaattccttttcgggtactccatgctacaagccacctcatcgaatactttggaccgggggaggcaggttgtgggccgcctccgcctgcagcatctgcacgtacgcacacacggccgtggtggccggcgctgcctgcacgcggctgacacttgacacaggcaccgcaggcagaggcgcacgtactcatgacgcacgcgcgcacggatgggcactgcgccctcgctgccccggcgcgcgcaccgagacaaagcagagcagcagagcaagcgtgcggacagccgcacgtgtgggcacgagcgcagagcggttggacggaccgcggatcgatctcggcggggccgcatatcgatcgtcgtcaccgcgtcgctgacgatccctgctctgccaccgccgatggccggccttttaggccatgcacagtgcaccactccggcgagtatcccactcgatccacgtgggataattgatgatgtggaggagagaagaggatggaccccgtcttctccgcaatatcaatgtgtcttgcagaagagtttgtttcctcccgccagaaaaggaaatagcgagagcggtctcctctgcttgtgtgtatgattcttcccaactccgcacaaagaccacaagagtgatctctctctaatcccttccaacctccgccgggctccgcttcgtgccaccaagtccgtcgtcaggagaagaggggataggcagccggcgcagacactggcccgtcacccgacgccacgttggatctagcgatagctacgtcattgttgtcctcctgccgtcgaagaagacggtcatcctggtaataaagctacctctccctgctctttcttcccattcttcccctctcttgcttatccccctaaggagatggctaaattttctagaaatctgagtcaccttaaaactagcaatgcctatggattagtgatggatgaatgtagtgtggtagtgttaagcaaaactgtctttcacaacgtcaccccttaagcgagctcccagcttgcagagaggcatgaacagtacaagcccctctttgaaggagcctcaggtgtcggacttactaaagccacaccttatctctcccaatacaaagtggctccagtggtggttttaacttttcgtctcaacccctggtattttctattttagtcctcctagtttttaatttacatacaaatccaatatttagactgagtacccttgaaaccgaaaaataataaaaataccccttcctctctactttcccctcactctctctagcacgccgctccatcgacctgtcgcaggtgtgccgttggcgtggtgccccttgaccggcgcgtgatgagcttgggtcgaggtaagaaagaagctgacatggcagtgaagctagggatccttgtggctatggcaacactggatggcggtttcctcaggtagtgtcgaggacgtcgagtctctccaccatcaccgtcggggcctttccctctcaagaagaacaaagggcgccgatatacggaaggggagcggatgccaataggggcggagctagagaaaagatgagggggttcctacctttctttgtgtaataccgacatctacagatctagggcgacattatactaaatagttgcataactaataaatataagcattatttctttaattgaagggaatataccacaataaatacatagagaagagtaaaaaatgcataccgtaatgaagaaatcaactagtaatatttgtgaagttgataatggttcaaccatagacaaagacttccatcaacaaaacatatgaatatatcatgcgaaatgtgacgtcaccatcttcattcctccataggacaacgaccttgaaaagagatagatataatttaattttcaacaaagaataagtcatgaaatgatttgatacaaattaaaacattttttttttcatattggtactatccagtgcttttcttttgagatatttctacatagcaatatattcagaccaaataaaaattcaagcttttatattggtgtaacaagtgttgagggaaaacactcacttgctctgagtgttggctaactgttgtttgatagaatcacaattcacaaactccggtactgccctccgtggctccgttgactacaagcaacaaaaaataacataatcatgggtagactagcatatattaaaagagaggaacagcagggacgcaactgcgcaagatttagtgacttaccgattggatttggaggcgattccggccggcgttggggccactgggcagcacgggcagtcagccgcacggcctacactggcgggcggccagccggctagggctggcgacctagcgtcagttaggctcagggcagggtggcaggcagggcgcacgggcacgacagtgggcactgggcaggtaggaggcagccaggcagaccactgagaggcaagagcgacagagacgcagacgggagagtgatagacagaggaagcgacatgcgtttgatttttggaagaggaagcgccaaaacggtgccgcccgcgcgctaattccaggtcgccgcccttcccccttctgtcgcgcacgctcgactcgaaatcagaagcgacttctcgtatcctcctatctgttgggctacctgttgggctgtagttttgggccaaagacttggagggggttcctcagtttgggctgagggggtgcctatgtggtggagatatgggggtaagaaggtatttagaattttgggcaggtttcctaggcaccctgcctggcccattgagctccacccatggatgccgaggaggctgaagaacggcaagggatcgagattgacgggccccactgccagatcaggctagcccattcctctcggtgatggtggccctcgatcgtgtgacgatgaccacaagctccttctcttctccggtgatagcgacacccaaactctgatgtaggatcggggttgcgtcaggatggaagcggggactagtgggactagggatttcccccggcttagagccttaactgcctaagaggactgccatctgttgtcactatggtgtgcttgtcttcatccgtatcgttgagcttggcaaatagctggaactgattctctagggctggaaaggagggatggagtagcaactcgacaacccgcgagcaaaggaggaggcaccctagtaacgtgcaatgatgatggtggtagcaacaatgccaaatcccttctttctccactcttgatggagccgcttgggcccctagctatgcccagatctagagttggcgcatgaatgcatggttgattggagtggcggggttgtatggtggagcggttggcaagtgttgatgtgttgttgacgataggggcatggcatggagcccttaggctggtaacggaggataggaggagtatatctatagcgtacctccgatgccaccatttggcccctcacattgtttgcatggtcttcactattgatattttttatgttgacagataaatccgcaagcgtacggataccgttgtagcatttcatatatgagtatcctaacggtatcgtatttataattccttagggaagacggcgacataaacatatgatttgtatatctttaatcagcatataattaattcaccatagtctaaaaggggttaagataataatggataaggtagtggacaaccagaagatttacctctgtaataatgtctagtagaaaatagtattagtgaactacagtacacatgtatttctgtactaatcatgtttaatatacacttaacatatacatatttacaacatagaaattagttccaggcacccaagtactctcgagagaccactctctgttggtctgctagtgtggttatggcatttacgcttttacgtcatacccaaatgtggaggaatacaaaggacggatatagctgtcaccacctaccgcttacctcactttccgttggaacacccgcatgcaacgacatttatctaacttaagcactatgcttgtgctagtaaataatatcactaactcccgcagaactctcaccctcggatgaacaagttggagctagagcacctataaaggtcattagacaattatcgtagcatggatcgacttgcttaggatgaaacagatatacgaagtatatactactcatagaacatatactcaataaagaaatatataaactatgagcataaataaataaagaagataattatattaatcaaactatagccttacaagaagagtaaaatactaaagacatacccaaaacttcgagaagactacaggacagaagctcataagccttattcctactagaactatagatagtactatatggaagagattgaggtgtaagttgtgaagtgagaagctcctctccttttatagcctcccaatgacggttttatgcggttactagtccgggaaaccagcataccgccatcaggactgcaggatgaggcaccacgtggaggccgccgccgtcgcccgccgcctcccctcccgccggatccggtggaggggagggccgccctcaccgtcgcccgccgcctcccttcccgtcggatccgacggaggggagggcaccgccgtcaccgcctatcacccgctgcctcccctcgtgccgccgcccgctccctcccttcccgccggatccggcggaggggagggcgcaacggccacccatcggcgagctgcgccgccactgatgcctcttccgggccgccgcctggccgccgccgcgcgcaagagagagagagagagagagagaacgagaaagatcgagagaggatcgataaggccgactccacgcttatgtatagggaggccgatgctatcggctcggtggctcggcggctcgtcttggtttggataggtgttgggtgtcggtttttaattaactgacacctataatatgttaaaggtgctggtttttgttttagaatcggcagctatagtataggtgtcggtttttgtttagaaccggcacctatagcgccgatctctatgagttttttttttaagtagtgcactcaactgaaaatcttagaatgtataagaagaatcatgctcttatccgatcataccactacataaatcatcgtcgctaacgtacaggtgataaccctcgtctgtattaatggatcgatatatggttgccattacagataaatcgtcagttaaaaggctatatgtatcgtcggttgaacaccccttagcaatcaactcatctgtaatagcaaccataagctgcagatgttaatagcccctaacatttgacatgttgtgaaccattacagatatggaattcagactaaaaaagaaaaaaaaattaatgcagctccggtcccaccatcaagatgtcctcattgccaatgtcgatgtagccgataagagcacccgcaatggtaaagtaaggtgctactataaaacatgtatatctcgataatagactagattaatagtaaaccacttcaatggtatgtctacatggatatctatagctctctaatccattgtctcgtttttctctatagactatctacaggttagtagatagctttgctctctctcttcatttaatctctttcaagtagaaaaatatgctaacatggattttttataaagagcctataaataaccattgtgggtgccctaagccgctcaaatgctcaatgccatagggtcaccatgtccattaattgttgccaaagacgtgcgtagtttgctcatccatgcatgttgtcgaatccacttgacagtagatatatatatagaaagcacacggtaggaaaacaaataatgggacgatgaacaactagtaagcaaagaacagaaaaaagtgtactccatccgtccaaaaaaaaaagacaaaccctggtttccgtgtccaacatttgaccgtccgtcttatttaaaaaattatgaaaaaaattaaaaagacaagtcacgcataaaatattaatcatgttttatcatctaacaacaatgaaaatacgaattataaaaaaatttcatataagacggacatttaaagttagatacggaaatccatggtttatctttttttttagacggagggtgtagtagataagtaccacacaatttgtagaacgggaagagagaagtggcgtacgtcagggtggtgattagtgacctagagatcgactgttccaagctactggtggcctcagctacaactatagtttcaccttgtcgttggctgttattgtgtatgcatgctcatccgcatgcccatcgtacgtcatgctcatcgatatgctagctccatcacctcgttgaggacaaggcagagctcagggaggggaggcactagctcgaatttgacctctctagcttgccaccgatgtttcggagcttccttgtgatgctaggtacaccttttgatgctagagagccactatatctggatgctcacatactattttctccagattaaaaatacttatcgttttgaataaggacacggtcttaaaaataattttggccactatatatatataagtaaaatcaacaaatatatttctattgtagcatttttaagattaatttacatattatcttaatatttctaagataaatattttaaaaattatttataatcaaagattttaatgtttgacaacagacttatacaaaataagtacttcctctgtcctataatataagggattttgactttttgcttatattgtttaatcagtcgtcttattcaaaaaatatgtgcaaatattaaaaacgaaaagttatgcttaaaatactttggataataaagtaagtcacaaataaaataaataataataccaaattttttttaataagacgaatagtcaaacagtgcaagcaaaaagtaaaaaaaaatttatattatgagacggggagtattatcaacatgcacagacatagtttgcttaactcgacacgtggtaatacgttttgctacctttaattttttttttacctcggtaaagaatgaatcgcaatgtcgttgtcaccctgcgcccacatgcctttcacattggcaacccacagccgcgtcggcaggccggattaaagaatggcagcaggatcgtgttaatccagtggagtgaaaaggtaaaataaaaggacaaacaaatggtcagactcacatcgatcacttcccctttttctccgcagctccaacaggggaaaagataaaatcacttgtccgtttctcgtctaaccggatcatatcatcatgtcattcaaaagctgagatctactagagcttgctccatcgatagaatcgtgtcacgcgacaattaacaatcactttgccgatttgattagtcaagtccctagctacatatccatcgaggcgacctaatctaatggctgtcggttttgaagagatcctcccatagtttaaattacttagcacctattccctccgtcaaaaaaaaaactcaactacttcaatgagacatatccaaattcattgtagtagattatgtcttgtcgaattattagattattttagacgaagggcgtatagctagctagttagtgggaaacaaggaaattactggtaaagactccgaaacttctgccctaaatccaatctctctttctttcccaccttttttctttctttcaaaagatccaagcttttgaagaaagtcatcatacacacgacgaaattaaaaagaagttgttttgcatgcatgtactctggactacctagtgcatctaacacaaaagacagattagtcatgtaattggattcttcttttgagctgaaatcaggggggcctttcaaatgtcgggttcatgcacacctgtagtccactttgagataaataatcagtactgccacgcaaaattaaattcagacaacacacctgacaaagtcaaaattttggcgagtagaaattaaatattggatatatatatatatatatatatatatatatatatatatatatatatatatatatatatatatatatatatatatatatatatgcaccgcatatagcttgtgatcatgagatttacacgatgaaaatcgaccggctagagttacgtttatgcttgtatcacctatggtttcatggacagttacgtccacataacaattctataattcaaatctgtcccttttacttctttaaaaagtgcatgcgtataggcgaattaatcattctcgcgcatcactctctcacgagtgcgagccgaattaatagtgtatattgctcacgcattaaaggccttgacctaaattttcatgcttggaaaggcaatgctgaccaaacctgagcttggtacctgtatggtactaaaatagagcaatcttagattgttccatccataatgtccctattaccacttgtttttctctcgttcatgaatcggtgcccccaagttcaaacgccatgaatgtgccacgtaggcacctcgtaagttccttaaaatatgggcaaatactttttttttctcgatgaaattctagctagttcttggtaccacacggatgaagtatctttcccacacatgaatttttaaagtaagtagacatataacaaataaacctatgtttctatttggcaaggctatcttctctgggagctgaagctacacacacacacacacacacacacatatatatatatatatatatatatatatatatatatatatatatatatatatatatatatatatatatatagtatatatatatatatata

SEQ ID NO: 78548 - DNA, 4424 bp, Oryza sativa
atatatcaggcacgtgcaggatatatatatagcactagtacagtgttcaaaagcgacataccaaacgcgtacatgctcacgcacgtacggaccagaccaggagtgaaaactcaacctggaccggacgaccgaccggaccacgtaccgtgggagcggctcgatcgatcggtctcggacgaattgaaatcaaataaacccaacggagacgacgacgaaccggccgttgcatatatacgattggattaattaatataatgtgttgtgttagttctctctcgtgcgtaatagtactactagtcttggtctttcggttgatcaaattaaagtccagacgccactagctactgcgtttcagctgtatatacaagcatatggtttcgtcgtcgttcgtgcaagttttgaaaatggaaacattaattctttcgttcgcgtgttgaatccttgacgtgagcaaatcttgaattccaagctttggaaaaagttgcagtttattaattaatttgagtgcaacatggatcgaattgaagatagaaacaataatttattaggaccagttttgaaattaatggaacggaagaaaatatatatgcaggaaattcacgtaccaccagcgtcgacctaactaacctacctagaggattcatgttgcaaaatttctacgaaggtacatcgatcttcctcctttacgtacattattttctcagaactaccttaaataaacaacatttagcttaactataacttctactaccttatacggctacgtcgtacgcatgtacgtatttcatcatttcttccaaatgtaggatggcattcatgcatcttaatttcgacgcagtttctatcctatttctagggctcattccctagctagctaaatatatattttacaaatacaggatagtagtacatacttcttttttttagatggtatcgttggtttttagcatagggtttcaacacttatcttattaaaataaatttatataggtcttatttattttgttggcactaattactttattattatagaaactttaagcatgatttataaaaaaagtttttatatttgcactaaacttttaaataatatgaatagtcaaatattaatctaaaaattaacgaagccatctatttagaaaacaaaggtgttgcagtttaattcatcactggaactataaatgtcaattgcatgcattgctgatgaaacggtacaactagcctacaaaatatagtttttctataactcacgttttatttccatttcagaaattaaacaaaaagctcaagatttatcgtacaattagatgaattaaaacggtttttcagatctctagcataacacctgttgctaggataagatagataggaaatattttgacattcataagttggagtacttacttgttttttttttggataatgggaatggcttctacaccaacgggggtgtatatatatacaaccattggagtacttagttgttgggctctcatatgtttagccattatcggctaaccgatttactaattatcttggtatccacatcacttgcaacgagtttcacgaaatatttgcttgaatttgacttagcaacggtggtaggctccaatgatatggctcctgttcaaagtttctcctcttagttgtatccacaatatattgttgacgtacaaagttaaaggtaactatttacacgtacgcaacattaattaatcatggaaaaaaaagaggaaatatgcattgtattggaattaagtagatgttctgagtgtctaaatacacatataatgcccataattatatttttttatctattgaaccttttaaatttttattttttaaaataaactatataccaaaacttccaaaactaatcttttggccacaacagctaggctagaataacaaaacaacatgcctaattttgtttcatcatgccgacttgactgacgtgacaagggttttgtgacttttgtcataattaaggcgtggcaaaacaccgggggcgtaccatattgttgtttcaccgcttgacaatcaaaagcaaaagcaaatagcttgattctgaaagcagattcgtagaaacgaggcatggtttctaataaaaaccaaaagttagcaatgaagctgcttttgtggggtgatgatgttgatctaaaactatcactagaagtattatataaattgcacatttcgcatgtttcaaaatctgaattcacaatcagattttaagaatccaactcctgaaaaatcacaatccagagacaagattgtgacaataaaaaacaaaaataaacggaataatgtaagtaatgggtttgcaagatgatgtgttcggttatgtgcgtaaattaattatggaacggtcgttcagtgcatgcatctcccacagccaaaaattaaattttaaaacatggtattagagttcattttaaagttttttcatcttagttcattttcagtattgacttttaaattactaagaaacacatatgtaaaaggtgtactcataaattatttttagttacttttcttttacggtttatctccatacagtaaacgatgagaagcttagctgcttgccttttcagaggccaaaacgactaattaaactgcctaaaaatttaccatctgatagctacatatgcagattattggtggtcaaaatcatgaccgattgacgccacaacatgaacgggcaacttgaaaaaaaaaagaaaagaaaaacatggtgtatatatacattcatgaaacctgcctagaatagatgatatatatatatatatatatatatatatatatataacttccttaacatctgactatggtgcaacaacccgaaagggagagaactataaaatatttacagaaggaaaaaaaaacatataactaccaagtaccgactaattgaagctagcattattgtggtcaactcttagttaagtgctactctagtagtttgtatacatagtatcgactgtttgaccattttgacttggttggtttgtattttaggtatcatatatgcatcttagaagctattgacttgacccgtggaaaagttcaaaatgccatgaattgttttcttggctgttggttgccatttgcatttgattaaaaaccaatcatactcccagatcattcataaatattgaacaaactaataaatttatccttgaatttaaccaatgtaagaaatataaaacagaacagtatatggctgatccatgaaattcacacgtacagaagcgatcgaaacaggcggatacgatttcagacaataaatgaattttattgaatttcatcatcagacaaaaaagaatgattacaaattaagaggtttggaaaaaccacctttgatcatgcacacatcgatcgtacagatcgtacatacggacctaacttacatggtcccgttcttggatatgatttgattcctctcccggtcgcggccgagaccagatcgtagttcgagtcctcaccaaatcaattccccagttcacatgacacatgaacacgacctaagctagtcctccattattattaactaacaattaattaatcagcccttaataatcaattaacttaattacttttataaacaaataacgaatcttattatatcattttatacgactgaattaacggtatcttgattcggtgtacgggaaggatggacggccaggattggctactcttccttgtagtcctggttgttgtagggggcgaagagctcggcgaggaagttggacttgcggtggacgcgggagccgaggtcggcgcacatggcgtcgctgtcgtggatgctgtaggtggagatgcagtggcggcggtagaaccgcgtcgtccgccgcatcgcctccgtctcgccgtcgacgtgcctcaccatctcctccaccgccggcagcgcgaacctcccccccagcagccccgccagccacctgcacctcagctccgacgtgtgcaggttcgacacgctctccacgtaccccacgaacgccatgttcggtatcagcggatgtatcgtccccctacacacacaaaaaaaaaacactcatccattagctaattgtgcgtgtgcgtctgcggtgtaattggttggttaacatgtgggtaccggtagaggggcatcatggaggatttgttgacgacgaggccgcggaagggctcggggaggacggagcggagcttgtccttgccctcgaagccggtggcgaggaagacgaggtcggcgtcgacgtgggtgccgtcgtcgaggacgacgccgttctcggagaagcaccagccgccggcggagcgccggaaacggatcaggtcgcggtcggccatgtcgaagaagccgtccggcaggatggccatctggcagctcgcgtagtcctccacgaacgggtgatccggcctcaacccgtacctgctcagtg

SEQ ID NO: 78549 - DNA, 1132 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccc

SEQ ID NO: 78550 - DNA, 3327 bp, Oryza sativa
gttcgtttgtaaaattagtttttgcaaaggatcaaattgtcaaaatttgtgttagatcaatatcaaacttccatagcaattgttaaatcactttcctcctatcctatgtctccgtatgcatgcatatgttagaaacatctagccataaaaactgccatcaaagcaatttttaaactagaaaccaccactaacaatagttagacaattgcctatggttaatctcatttattctctcatacgtctcttgcaattcctcctataattaggacagtcctcacaccccatcggcatcctctatcttaagagcgagtgtatcgtccttcttgatccatgttaatcacaggtccagcatcggttaatttcctctactgttttagttttattgattatctatgtaatataggataacttgcctgtttttgttatagtgttcttcccagattgaaaataaatcttaagtgcttcattgcttctactcccttatttctacacacattgcaaattttaagcacatcctttttttatcaagttttcaagcacttcattggtccagtttcaacaaatttgcttattccccaatacacatacaagaacaagttttactaatagacaactcaatcatcatacaaaacaagacacacaaccactttataggatagcaaatatattttttttactatatttgtctttctagatttccaatatatgctacgttagttaaattagtttcaggttacgaagtggtacctactgtctactaacagtattgcaatataagggcccctttgaatcgcaggattgagaaaacgtagaaataggaaaaatataggattttgataggaatgtaagtataaaacagaggattgcaaaacgcagaaaaaatataagaataaccgtttgattgaaccgtaggaaaaatataggaattggatgagagagatagactcaaaagaaagtttaccaagaggttgaacctcttgctaaatttcctgcaaaatctctatagaattgtccattccataggaatttcaaaggattggataggattcaatcaataaagggcttcataggaaattttcctataggtttgaaatcctccgaaattcctatgtttttcctccaaatcaaaggggccataagtttgctttctagaacaagacttgatagcaactacttccagcaaattctgcattttcaaagcttcctccaaatagttgtcttgaagatgattcataaatacaacgcatattgcaacatatatcatgaccagtaccataaccactcaattcacctggttcatatcaatagtttggagggcttcacattacacatgtccattatacctaatttacataagtatatcatatggcttttcagttaaaggaaagcttatgtgaaggcatgttcaagttttgactatttgaagtaattctatactcatgtgacttttaagttccttataatgaagttgagagtttctacacattggatttttttatttacccccacacaaatgtttatacctatatataggtaaaaggaaaaccctcagtgacataatagtacaaagagcctagcctctcatgttttaagtaaaactagacctacacgatcatatgcattattttccttcaattttcaaactaggcattgtcaaagagaactataatcatggtaaaaaataaaataaacaattatcactgttcaatttttttctattttgcaccttcaaaaataattctcctttttttatataaaagtacccaccacaatgcgcggggcattacctagttagctacacttcgatgcctccatcattatctgaatcatttacagaggatgtgtacacaaggcactttgtaatttgcatgttgatccgctctaaattgtactctcggtaaaaaaaaaaacctttttcatagaaaagtccctccgtcctaaaataaaataaagctattttattactccacctttatttaaaatgaagttatttcttcacatgctctctcatctcaaacaatcacaactattttttattttatattttctacctactttttctttctaaccaatcaaaatatttcaccaatcatttttcacatttttaatacttgtgtccacctttagaaatacttacattttatgacgcagggagcaagtcctagccgtagaccttcgtactcaactctattgtagaatgttggggtgtacggcatagtgatcaaaaccaacatttttatggcaaaaaacagcttcaatagaaaaaaagttttaaatctcacatgttggaaggtaaaaggatattgttacatgtgctccaccaagaacaacattgttgggtccttcccaaaattttcattattttagatgtattagattatatcatgcagaccaaagcccttttggcatgtaggatagatctaactttgagccctcggtgttagatgatgcacaaacggtatgttgtttgttgtccaagatagtccaaacgaaaatttttcacctgtacaaactttttccatttgtagaaaccttgaagtcaagatacgaacgttcaattaaaccttcaaacagtaaaacaaattgaaagcatcttttacataatctttcaactcaagtcgctcattttctttagtttgtctgaacttgcaacttcaaaatcatgaacttacaacataaatcactaaaatttatattccaattctaaaactttcaacacaaacgtaattgcccttcagcttgaaaacatgaacattgaacacgaaattaacaaaaaaaaattcctatctggaacaactttcaacttttacaatgttacagccatacatgagcatcggcaccagcatcgacacccgcaaccatgcacatgaagggatggttgatagctagctttcccatccaaacacccaaatacaatgcaacactagctgcattgtgcaggttatcctgtgggagcaaaaagcttgttggtaaggatagactttacgagcaatataagacccctaagggcatggccaacgcagggtaccctaagtgctacctaggatgggccaacactcccaaaaagctaatttcccacagtgcaagggtctattcggctactttgtaccgctgctgcactgccacaaccggagaaacaatatacagtgcttgttggctgaaccacagtgaaaataatggcagccgaacagagcccaagttgcttcaggtggtagtctcatttttttttatttcagcccctggtgtttttcattttagccctcacaattttacaatttatatagaagttcaaattttacactaaacaccccaaaagccagaaatggg

SEQ ID NO: 78551 - DNA, 11730 bp, Oryza sativa
  unsure (1)..(11730): unsure at all n locations
tcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactgaaaacggccgagcgagcgaggcgagccatcgacgtctcgctgcatggtccctcgacgcgtaccggtgtaccacccacacacgccgcagcaaccaaatcggcctgggagttgagcagcgtacgtgtcctcccgcggatgtctacaccggccggccacgtacatcgccgtcgtcgctgcgcgaccgctcgctgggccgcgcgtccatatcatcccaccgcgacgggctccgatccacttccactccatctcccggctcgacatcctcctccgatccgacccgggcctcgcctcgcgcgcgaccccgcgattccgccgcttcgcgcgggccgttcgctaagttttcttcacacggcctgtacgtctcggggacgcgcaaaaggaaaaagtacaccgaaggtccctcaacttgtcctcgagatacaaaaccagatatcccacgtcccttaactaatcaaaaccggtcacaaaagtcactcggcggttttgaccccggttttatcctacgtggctgctgagtcagcgtgggacccacgtggaccccacatgtcagcttgggccacgtcagcctcctctatctttcccctattctctcccttccgcatctgtctcactcttcccttctcttcttaggtaagcagcgttgctggcactgccggggaggagaccgccggggcgaggcgggatcagccggaatgctgagctcgtccgcatccttgccaccgtcgccgccgggatcctcctcagcgccgcctcgatgctcgcgttctgaccgccggcaacgacgtcggtgtgggggatggacaccgaatagctccggtagtccgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgaggagctccatgatccgccccggcgagtttccgaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaactctacaaaaacacgcacgtatgccttcacgcaaaacccatccaaccgcagcctgcggcgtgtatgggcctccatctgcctccatctccatcgtctcttcgcaaaccagtagctatagctagcaccacattgatttggttcttcgtgacaacaggctgtgccatctatgaagtaaagcaatgccttccctgcccaacgaggcaacgatacaccgccatgcatgcaaagcccacgtgtagtacctgttaactcagcacacaaattcccaataaagcaattaattaagtaaatcactaaccaatcagcaatttggcaaaccaaataacccaactatcctaattacagtgtcaacagaccggtgcccagccggcgggtgtacatgtacgagctccctccgcggttcaacgccgagatcgtccgcgactgccggctgtactcgaggtcgatggacgtgtgcaagctcgtcatgaacgacgggttcggccccgcggcgctccccagcggtggcgcgctgccggagcgggacgtgtacgacaccgaccagtacatgctggcgctgatctaccacgcgcggatgcggcggtatgagtgcctcaccggcgagagcatggcgaggaagaagacccgcgacgcccggagcaagctcgctccaccgccgccggacttgtcggacacgacgctcgccgccatcggagcggacgtgcgccctcgccttctcccgcatcgcagccgccgctgccgcttcctcccccacctcgccccgggggcctcctccccagcagcgccgcccggcttgcctgagaagagaagggaagagtgagagagaaatgagaaagggagagaatacgggagaaagagaggaggctaacgtggcccaagctgacatgtgggacccacgtgggtcccacgctgactcagcagccacgtaggataaaaccggggtcaaaaccgtcgagggaccttttgtgaccggttttaattagttaagggacgcgagatatctggttttatggtttgaggacgattttgtatctcgatgacaagttgagggaccttgggtgtacttttccccgcgcaaaaaccaactgggataagttcacttcagatctcttattttaacagagttcgaatttcatccctaaaccataatatcagatatgaagagtcctttgacttataaaaatcggtgcaccaaagattccaagacattatactctcatgttttagctaacgtgacgagctgacttcggtcaacccgactgatttagtatgggacacacatgtcataaaaaaaatcactacccttcttttcccctgtgtctctccggatccacccaccattgacgccgcgagttcccccacgaacatcattcgcttcccccgcatcgtccccatgaacaaccgcgcatcaaagctgctcgattcaatttgtgagcaaatcaatctaaagaaaatgcaaagatgttgatttagaaggaaggaatgcaaatgtgccttgcttggtgaggaaggtatagaaatcaatgttggggtagaggtagtcatcgatggagtactcaacgagggtgtggacgtccttgccatacctgaagagggcagggagaaagaaggcgacaacgagggtggtgactggggaagtggggagcgacatgctacggcaaggaaggagcagctagaggaggaagggagtgttggtcgtggattggtagggtggttgtggcgtcgtggagtaaggcggcgaccaaccagggggagggggtaggagcgacagttgacgggaaggcgcgcggcaaggagaaagacggtcaccgacttgaagagaggcggtgggtgcagcagattgtaagggcaggcagctgaacgagctcccatgcttgcgtctgcacctcacgtctccccggtgcccacagcttgccacccatctccccctgcccgccactcgctgagcatgcccgcccacatcacagaggggaagggggcaatgctgctagctcatgccatcggcgtgatgcccaagccacaacaatcgcccccttccaccaccttgcctccaccaccactgccctccacttcagcccttgtcgccgcctcctcaaccaagccaacccgctttgtagggctcatgtgggtcctatttaccacattaaccaaacccggggagcatactatcttgagatttttggtatactggttttattggttgaggaattcttcatatctgatattgtggttcaacgatgaaattcgaactcgacgactttaagaagagggacctaaagtgaacttgttccaaaccaacgtctcatcgcggttgcggcccttgtcgcgcgcgtgtcgcgggcttgcaccttgcggtttcgcgcttgggcttttgcctgccggaccggcccagcggccagcggattccagtggataaacattgtagcgttcaccgttatcgcttcctgcaaagtggatggataggataaccatggcgtttttctcactttggtaaaggaaaaacccatcttgcagccgatgacgacctgacaggttgcagccgcagagcatggctacttacaacgctgattgagaagcaaaaaattttgttatccatcgagatcgatcgaagctttcattcatccatatcaagtcacgatcggttggttttatgttcttcctccgatccagcggcctgccaccatcaaattcatcacgatgtgttcgctcctgataaaaccacgaatggattggcacgggtcacacgagtggagctagaaacactaaaatttatactccctccatttcacaatgtaaatcattcctattcattaacatcaatataaatgagaaaaatgttaaaatggcttacattgtgaaaggaggaagtatttactaataatactatttttaatttattttttataaaagctacagtgtgtaattttacagaaattgagagagggccctaaatgataacatgaggaggagtatcatttatcacctattgactgcaaacctcatgttagttaacttaataatttcatcaatatggtaagcctgatctcacaagctgactttttgtacccatacctgcatgcttctgttgcaggctggtaggtagctaacgctaactgtttataataatccaggagcatcttaatgaaagcaaaattatgcgtataatctatcacacaagtgggcacgaactcatcaagttggatatataccacggtcagagctgggctcttctctttctctcttctggcgccaattcagaatgaatacagctaatccatccatgccaagtcagcaataataatccccaattctgttccaaggaaaacggattatattacctcaactagatgcatgacggggtgtttgaatcagaaacaagcttgcttagcttgatcagttaacgtaattaatccggtcggaactagtctaatcacatgctggttaaacatgctaatcactcaacgggtgatgctaattaaacgaatggcacgtacgtcaccggcgatcccgtccaagagaaggccaaatcggaaactgaaatcaagttgctgctgatctgatctgaataaatttaatcagaaaagcatgcgttaagcaagcgatggaaacagcatcacgtattaacgacatccatcgataggtatatatcggtgtcgtgccagccttactgatcatctctggacacggatgatgtgcacgtaattaatctaatctgattgacgagattaattgcgtgtgattaccggttacgttacttgcgttgttttgcatgcgttgccctgctggggtgaatgcaaacacacagcatgaacagattaaaaaacaaagaatctgttagttagttctacgtgtgtacggagtggatgtttgcttcctaaccatagttattaatttcattagctttaggattagagcacatggtgaaataacgatggtccggattgttgctgtgcagtaacagggctttgctgttgggtgccataacaccggtcagaagtccatatattttaactaagggtgtgtttaattcacaccaaaattaaaagtttggttgaaattgtaacaatgtaatggaaaaattagaaatttgtgtgtgtaggaaagttttgatatgataaaaaagttagaagtttaaagaaaaagtttagaactaaactcagtctaagagaagttatagttgccttcactctaatcagggtggaagaaacacactatggtcggtcatgtttgtaacaacagctctacattatttaggcttaggtattttgaatcctaaatccaaaaaaatcatgaatttgaagctgcgagtacatcgatactacttggatgaatcattttatttttattttagatgaaaataaatacttttaagatagtacagtagcaatgggtgtatggttttaactccataatcccgtattcgtcacaaattataatcgactattatgcttgcttaaaatgtacctagaaacagttctctagcattgatacagggtttattttgtttcctatacataatactactactaagaaaaccgatcgtaagttgttgcaaggagacactagcctgcctggtccacatggatgtatcgactcaaaaacacctcattaattagtagaattcaggttagccaacctgtattgacttgagcaagaggtcgatccgagagggacgcaagcatatgcaggcgtggaatttcagcacaagtgacactgacagatgggtacctctccataaaaatacagaggctgctgacaggtggattgcatgtgtcatgttctggttgttgggctgcaaatagttcacttggcatttgagatgattttttcttggttaaattacgagacttgactcggatcaatcgaccaatcataccagtttaagtggcgctcaagttaactatgaaatgaacgtcaatgtattgttttattatcgactgatgtggggtgtaaactccttttaaactggtcaagttgtatgtgtactagttcagaactattatatctagagcatgcggataatttcagtttgattagtaatttactagtcagtatgtttggtgagtaacacatgatttgcattttgcaataatcaagcttaggcctatcttaactagcgctatactctgcattgtcctgtcacttactccattgcattttcaccttaatctatagtgctaatctgaacataagaaacattaacctgctagccaactaaaacatcagcgtcttcctcgtcagaagcatgacatctccacacctcgtggatctcatgtgtgtgtgatcaaatcaaaccactaagcttaggactttttgatgtgccaccaaatcaacactccatgaggaaataattggtccagctaatgagctaaatgccaataaaaccatgactccgtgattaattggccaacactattcacaagtacgagctcgcttttgacttctctgttgaactgttctgtgagacaatgtgtagcaggacaggcaactgctttacacattaattaccactagtagagtgatctgatgaatgttgcaataatatgagaattaagctgatgaatgtgtcagatgacctcaggtgtactactctataaaaaaaagcaactcctagctaggatttgtttttttttttattggaggggtgctctcatatgcacgtacttcctcagtactaaaaagatttcactttaatgagatagtaatatcactttaatgagatagtaatattttatatgtaagtactccctccatcctaaaatataagtatttttgaacttcgacatatttttaaaatgctattttaaccaataatattttaaaaataagatgttttaaataaaaggagttatatattatgatagtttgtttaatgataaatctagtaacatcattctttagatgattgatcttttttacgaagaactatacgtgctggcttttctgctgactgctgcagagcagccgtagttgcaagcagtcgagcatgccttatcttatctatgacagctgagtatacatccctcatccaatttttcacttttatacacatgaatttggacaagtgaaaaagtaagtttctttttggaggagacaatactactatcctatctatgaccgtaggagtatatgtcaaagctatctgggccgctaaaactatgtaggatagagccaaggcagtgtcccaactgctaaacctacctaggtttgactaatactctaaaaaaaatcctatgtcaagctgaggctcaagatgaacaatgcagaaatcataggaagtagcagaaagatcatatcagcttttcaagaacattattttttttctgaaattctttttttttgtaaaactactataataattgtggacttgttcctaccagagctacctacccaaaagggacataaaggatgatggctttgtgtttggcaaggtgatcactgttgctacttaccagtgacccaatcttgctacatggccatgcccatggccacttgttctccttcaccttgaaatccatgtggaaaagggatagtcacacacctaaccccacaaagtcacactctccagtgcctacaaagttgcaacaacaacatgcacaaaaagaggtcaaaagattggaagaagaggaagaggaggaggtgtcaaaaaggccttgacaaacgcatgtacgagattaaccatctcgtgcctcatatgtgtccgagatgatctggatgcaacacttgtctagaatccagcaggcagctgggttaaaaggtaatgtaaaaaaaaaaagctgggttaggatcatgcacggtgatgttgatgccagtgatgtgataatgttgagataagtactgtggttaactgggggttgataatatctaatggtaatagacttgctgcttgtcatgagtgagtcctcgattgtatggataagatctttgtccaaatcaaaaactaaaaaaagaaatgaaagaaaaagaaaatgcacgtacactggctcattaatttggtagactattctggacgatgttcgttttcttgaacacatctgctgcaatttgagagttgggtgatgaaagggtgagtggtcctggagaatagaccggtgatgctgttcactccacacatgtaaagggaacaaaaacttcgtttttaatttaagtagttatacctgaatcctgatagaccgtaaattgtgccaatgatagatttggtaagaacagttcctcctagtggaatattcatatgcttcatggggtacatgctattctgcaacaattgcatattgaaaaggggattatcttaatctaattattattggatggatatgcagcttttcacaaggaaaataagttgaagtacttcctttgtgtgcttcaaactttttcaagagatggcatcttgcatgaacccacagtcattcttgtcagtatttgaataaaagaatgccatatggatgctcgcactattacctgaaagtactccactctgatgctctgttagttgaagtccagcctaagcatattctggtcattctattcagtagcttgcgttatgcctttcagttctttttttttttttggttagtatttcctcattcataaatggaaataaaaaagtaagttcagattcagatctgtaagtagaggtttctgaatactacatcattgctttagtcaattataccttttatatacaatatctacttaggttagatgtgttgagctattcctaacttccatttatcgtcgacagttaattatactacttgtaggatgtgtatttttttaaggatgcattgagcgacagtggtatacttcatgggcttctaaaccgtgcgagcttcagaaaagaactttttatatatataatttttttaaaatattttaaatctacttttaacattataatagttaattcatttatttttactctcgtaatagtgattattcaatcaactattcagtcattcagttattcggcgaaaaaactgacccacatatcctagtagtaatttatattccattcaataaaagatcacattctcctctgtaaagaaaccggagggagtacatcatttttacatactattaacttattatccatttattacaaacaacacattattctctgtaatggaaaacaaaatctgcatcctgaatttctcataatgttcactgttacctcgtcgtatgcaacaaaaagatggcatttaccagtttcctcttggacagcacaaaacaaaacaaagcaaagttgctcactagtagcaaaaaaaaaaagaaagaaagaaagaaaaagaagaaagtatatataaatccagctcaaggagatgcggttgcggcaatgattgattgatttgtattagcccccttccactctcgcgttttctccccttctctgcgtgtttttgtggacgacggcgtcgtcgcaagcttcttgtggccatcgtcttccccccctctcctccttcctcgcatcctctcctccctatctctcacaaaaatccattcttgcacagggaattttgcctactcctatttacgatccttctcttcccccctctgggcggccaaagctctcgtttttacgcgtgatttcgtcgtcttgttgctgctgacgagcccgctgattttggctcgatttaatcccattttacgggtgttttgcatctattggagatccaaaggtgcgccctttctgggggtatcttggggggaattggatcgatttcgatctgtctgagtggttctctgggcgttgttggtgcgttcttgatccgagaggtgagagatttggttggattttctccctggagcatttggtgtgctcgagcaggatgctctatttgaagcagccgacgaggagctgaactacgccgagttgtttttcccctctgattttcttggtttgaatttcgcggcggtcgtgtggttcgcttagctgatctgatctgatggaggctatgacgccagacaaattccttcagaagttccggctctacgagaccagatcggtagggatcctcttacaaaattttgtattctcatcgttttgatttggtatgaattgggttgtaggttccatatatatgaagagatctatgtgtcagcaattgtagctcacgcgctttactttggtaatcacactgtaacttatatgtaattacattgtaacgtgcatgtaactacagtgtaacttgtatataagtttcacgtaattttgaatcgttaaatctattacaagatttgctttggtaaggaagaaaaaaaaatcacagcacaaacatatgtgtaaggatttgttcccacaacctccattttaccgaaataacatattacaaagagatttttgaaagttacatataagttacactatagttacagtgtgattacatgcaagttacagtgtaattacactacgattgtactgtaattacatctgtcaaatttttaggagaaaatttgtcgacaaatatatagcaaaatcgtatcacatttagccccgtggaccaagtttctgggccggcccaaaactcggataaaaaaaaatctaactacttttccggcccagctattcttttcgtgccctttcctttctcccgaaaatacgggcgcacacgtactccgcatcgcacgaagcacgaaacatctcggatgaatgtgcgggccccacctgtcagggacacacgtcccactgacctgaattcaccgttttacccctccccgttccaacggtcgattccctctgcctgccctctgctttacttgacccacgaggaccacgacgttgaaaaggacccaaaaccccattcctctctgcctcttctctctctctccctcgcttaaacccttcttctccagcctcgcaaagccgcagcaaatcgagtagggagaggaggaggaggaggaggaggaggaagggggggagatggggatggggatggngaagcgtcnnnntnnnnncngctgccgtacggactccaagacacaatatatgtatgacaggtgggatcatatattaataggctagtaaccaactattgtataaattgactattacatcggctataaacgaattagacttagtagtgggctatactattaaaattgctcttagactatatggatatgaaccctataaaatccattcaaaattctgaccgtactattagtacattttacgggttcatgtgattttactgtagtatcaaactggagtatcatcacacgaattcgaaacccaacaaggcattcaacacagtgaagaagagctttctccggttttgagctcgccgatccttcctacccaaaccttcctccgcaacaccatggactcccctcacccaaacgtgtgcgacc

SEQ ID NO: 78552 - DNA, 974 bp, Oryza sativa
gtaccctcatcgtttcagttaagttaactaataaaaggaaacaaattatgacctagtcaagggagatagacttactacacaatcgaatcaaatagatcacctctatcaacaataatcaggtaaccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccaggaggaggcggcggcggcggcgggggacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccgcagccgccgccgccgccgccggtgaacggaggccgcgcggaccaaaccctaggggagagacgccgccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaat

SEQ ID NO: 78553 - DNA, 2155 bp, Oryza sativa
ggtttcccccactctttggggcgccaccccctctataaaaccccctgtggttttaaaagagcccccttcttacaagagaaaagaggggggattttcctaataacgggtgtttttaaaaagggcccggaaatttcttggggaaacccgtgtgattttaatattcccggggggtcccgcctttaatatagacgctctttttttactccctccggggggggacacaatttggaaaccgccaaaaacggccctttttgggttccctccccttgggaagcctttcggcacagttctcttatcggcctggcacactaggtggtgggaaaacagaattctcgcctttaaatgagttattcccgcccccttccccgtacctctcgagaacggggaatatattccctgagacagtggaaaggccccaaatcctcacaccactgtccacggtcggttgccgatatcattaagcacagtggccggcaatggtttcctgctctaagagcgcacagtgaacgcacgcgcactgaatttaagttaggtctctcgatcagcagcccaagcgtagtcttgtaagcatccgcgtcgtatgttgtgcgcaattgtacacggacaactctttctctcatgaaactccttttgaccgtacctcccttagcctctatgcgtgccgaaatagcaattagagctttcgccccatccttgtcttttaaccggagtccgcagctgttcgactccactccggtgtcattgtgacccgtgcttgaagtaggagcatacccaggggtgtatacgcggttttcgaccgcctcatcccgtgcctttgggacgtcaacctcatcttcttcctccccttcctctttgacgtagtcctcgtcgtcggcgtcgaaatcggacgaaacaggaaccattagtttcctgggcgcaagcttcactagtatgcgcgttaggtttcacccaggtcctgcatggtcgtgggctttgtaggggttcgcccgagtaggcagttcgccgtagtaaacccggttggcacggccatccgcttgttctgttagcagctgtctatactcgacgaccgacacgtcgccgatcatcatacaggcttcggcgtcagcctggtcaagggttaacactataaaaataaagggagtagccacattaagcgtcgaacaaagcaaaataacaaagcacagaagtgcattgcgaaagggcagtcttaccgttcgtcccttcagggagaaccaactttggcaacccatcaacctctttgccttgctcaactgcgatttgctacgactgggagaggggaaagatgcgaagcatgcagaattcctccaccaagtcgcggcagataaggcgggagcagaccttacgcagtaaagtgaaccgcgcctccatagcgcccgtcacggcgaatctttggctttttgggttaggggaaatcgccctacggcccactttcaaagggctttatgcgggtcagaactaatcctcgacggtgatgtctgttataaactcttccacaatcgctcagctttcccccctcctacataaagtgttctaccgacttctctatctaccatccgtcccaatccctctcaagcacaccttacatatccactcgtctatacccttaccctctttctctcttaaccctctcaagtaatcctcggcccttccctcctactcttctacactatgttctaccttactctatcattctccaacccttctctattcccatttctcttctcctctagccttccctatcgctctcccctccacctattttatcgtcttcacactgtatccctcacgttaccctctccttccattaccctctcctccaactcgacttcgcaagctcattctctcctaccctcctccatccttctatctctgctatatttcacttctactgtcgttctcatctccctcttacgtctgactctcttcttatcttccgacatccctcgtgctctctcttctcctgcccatcatactgtatgtcaccatactatcgctctactctattatcgcctatactcgacatcgctcaaattctctactcgtaatcacctacactcttcttctctcgattactcaacattacttatatcatcataaacctaacgttactcctcttaactcgtttatctactct

SEQ ID NO: 78554 - DNA, 2586 bp, Oryza sativa
attcctgcagccctgttcccgggagggcctgacaggccctgacagcatttgaaccgggactaaagatcatctttagctctagtttttattgtaactgtgactattgtgaaattcggccgaccgacgaaagatggttcttcaacagtgatagtcgggcgacgatagttgtttgtataaattgttagccgagacaatgtagcggtttggcagcgacagtcgacatctacctctcatgattggctgccggtagaagggagtctagcagagtggtgggccagatccatcaccgtgtcacctccctgcctttatcaccactcgatcaaaacgtcggattgtgtgtggctgcaggatcagcattagtaggactcatgcgtgcgaggaggcacaggtgatccggatccatttgtgagatgatgcaagtagcaatggtttctcagttgcttgccatgtctctctctctccctcctctatggaggtcctattttttcctctaacgatgtctttattactagttaagagtttttatactaatctgtgaaccggtgctattttgatttcgaaccgtaggattgtctacatcaacaacccatcccatatggaacctatggacttttggcgtatgcagttgacttgtgttgattgaaagaggccatgaacgcaaattattttcactattaacaaaattcaaaaggacatagggattgtaaatcagttatacaacttaaaaaccatagcaaaacttatccagctagcaagcaagagtactccctcggtaaaaaaattttttaagatgaatccaaataaatactttatctgaatttatctttaaaaattaatatatttttttagatagagggtgtaaatgtacctccctctccactcggattatccccctcctttctctatctaagcttcggatgtcgccatccctgaaccgtgtatccgcacaccaatgcatggtacccgtacatactagtgtaccacgtacggtacacaggattagcgagcatagttgatactccatctctgctcatcacgacaagaatttgtgtcgctatccgcgatccatggtatcccaagccaaaacgattggctttgtttttctgatggatggatggctgactgacacgataagcatgcatatctagttatcttctactactgctattccctctataaaaaaaacaaaccgggtttatctttttttaacaaaccggatttatctttttttttcagataggggaagtacaatacaagtatgaaggaggatcggaaggcataaaagattttggtcaaattgatccaacacagcactgtgctaagattgggcaccgccatgtcgtacgaatctatcaaaatagtgcaaacagtatagggaacaaaatccacacagttttctctgcaaataaattgttctgtccggaaaatatatactccctccatcctaaaatgtttgacgccgttgacttttttaaaaatatttaaccgtttgtcttattcaaaaaatttaattaattattaattattttcctatcatttgatttattgttaaaaatatttttatgtatacatatagttttacacattttacataagtttttgaataagacgaacggttaaagatgtttaaaaaagtcaacggcgtcaaatatttagggaaggaaggagcatatagaagcaaaactagcaatgcttcatttaaaggagtgtttttttaaagaaaaagacgcacagttttccgctgacttttccatgcatatggttctttcaaaaacagaatcaaaggactcgctaaactacattcgcataatttttaggggcaaaatcttccgaaattgcatgctaccttatgcttggatgtgcttcttctccatctctacaggtgatctcgcctaatggatttagggtaccgatgagagtgggggggtggaggttctccggtttagaggaagactgaggcaacagcggcctcacggtgggtggtggcagcgtgccaccaaagtcactgggttggcaatgggcggttggagggtctcatgggtagtggcaaacaatgatgctagattaggatgcggcgggtggtggcagtgtatctggtgatgagagtaaagagaagttgaagacaggaaagacagcggcgtgagatcacaggaaacaaaggagtgtggtgtactggtgtgtaaaaaatgccactagagaagggtaggaaaatgatggggtagagcttctcactgaagggcatggtcattgtgaaggcgatgccaacaaggccgaacagtcatgttgtgtggtgtgaagttagggagtaattgtggcggttgcctagggccaattgaatgggttctctatatagggcctgtttagtaaagctccaactcccaaatttagcaccaggagttgagtctgaagtggagttgtggagcttcctaaacccagctccacctctctagttcatttcggagagagctccacccagctccgctcctattttaggtggagctgaaactgtttggctgaactccagctccaggagaggtggagctggagctggatctgtgccaaacaggcccataataaggtggggtt

SEQ ID NO: 78555 - DNA, 2129 bp, Oryza sativa
  unsure (1)..(2129): unsure at all n locations
acacgagcgcatggaaggggttggagctcgtttggacctgtttggacctatatgacaccccaaaacaagttcaaggatccgaaaatgcattttgagagtttaggtacctagatgacacacccgcacaagtttagggaccgctcgtgcacttcactcataaattaaattatagtacctcctctatacatatgttcctcagcataggtacctctcttgaaaaagggagggtaattgctttataaataaaatgccacatgcaaacggggaaaaacgtgattcttcttgtacgatatatttgtcaatgcctcgtagtcaactcaatttcatgttttttaagcttttcatagaaggacttgtcaatgcgttgaatgcacgtatcagagcaggaatacccatgacccgaaattaataaacaaagcgcgacatgcaaatatcaaaaccccatttttctacacgtatctacacaacctagtcgattggcaaatttcttccctccaattaacaaaactaggaaggaagcctggatagatacgtaggcaatttatttatctatctatctattattattatatattaaaagtccattaaacttcctacaaacgttctcatgccgccacattggactcctacaaacgctcctaattaagccgccacgtggtaatctaataaaccggtggacccactatttcagatttttagttattagatttacacttatttggtggacccaataatacatggaattagttctattttttggtaaaaaaaaatccacatcccgcttggtccgtgcgtacgggagatcagagatacacgccctccctcccctctatccctttaattctcacctatttccatgctatatgatctctcttatttccatgctatattagtttctattttcatgctatatgatctctcactaaatcactaaatcaccgtcctatacacatacgtacaaacgtacatacgtactccctagctcccttctgttccacacccggtgttccgcctttctatattgattatgtaaaaaacggaaaacctaaaaaaaattataacatataaatcaagctgctaatttaaattagagataatccaataaataccattgacaagtgtccaaatctaagaaatactatcgataagcgtgaattccaagaaataccatcgtacaaatgattttgtctaaaaataacatcgccgttagggttctgtccatcccgcgccgttaaatacactgttcataacccaacgagacaataaactctaaaaactataagatccctttttaaaggttcgggcttctaaaaagtaaaaaaaaaccaataataattatgtttgaatttaaaatctcaatgacaataaagaagagcggcagcaggcgagccgtggaggagtatagtgacaaagtcccgggcgttttggcggaacttctagaaagtaaaaatggagaagatgcagtggacggccgtagaggagtataatggtagtgtttgacgaggcttctagaaattataaaaatgaaatccaacaggacaataaactttaaaaactataagatccaacttttaaaggttgcaaggagaatgaatagaaacagtggtagatcgagcaagcaaacaaagaaggatatgacagaagtaaggggtagcaactagtgtgacttttaaaaacaataaaatttaaaacatgaggatgataaggttgggtttacaatgtcttgagancacaagataccatttaataaatnttagtaaaacatataaaatatttatattttatatggatgctaaccgcgccaatgccgaggcccaccaactagttatttgttaaaagttattaaaagaagcacgtttcttctattcaccatagnaggatatgtnttaatatgcaggaagaaaatttnatttataacgtgaatagacatagaccttaaatcctgaaagtaatgcttatacatgccaccaaaattactttgtacttttatttgtaactggtttcacacatttttgggaacaataaaaaaaggtngggttttttttctttttttccacctaatcccctttgcccctgtaccgtccaaggaaaaattttattggcatttatttccgctaccttataacctt

SEQ ID NO: 78556 - DNA, 8356 bp, Oryza sativa
gtcaaacatgccctaagtaagctttctttggtacagctccaaatccaagttttttttgaagctggatattcctaactccataaatctatgaatttagatccacaattacattgataacgtttaaataaatcattttatttccgttttggatgaaatttaaaattttgaaccattataattcaacgtacaaacttcaaatatactatagatctaaaatctacagagcctaactataggagagttgtcgtttctattagtaattaaggaaaaacaagacttatatatatagtgaacaaagaaaaagggattgtcagtccagaattcacgtgactaaaactataatcagtctctttttatgtcttttggacgaagatctaacacatctatctagtttatgagacccctctttcatgtttaaacatgatttcttcttattaataggctgaattaattttactctaacctggaggtgaaataaagctacatttaagacaaaaaaaatacaaaactaaatgtaaaaaatattcaacttaaaatataaagtagaattatatagtaacaatactgcaactcaatatgagctaacatttgcatattatatatcattggaattttcagcttatcatgcaattttgagtaactataaatttctatgtgactaatatagtaaaatccaaaaaaagagacatccataaatgtgtggacctaagaataagcaatacactgggaattactcaaattgtgaattgatctaattgaccatttcaagctcgcatttggtctttatgttataaaggacaatagttggaaatatttctatcaatacaaagagtccctggtggttgcgttagtgtttatataaagttttctacctctaaactaggaagccatacgagtaaccgagcatagattgttaccactaccactcaatgctctgaatagcaaaagaaaagttagaacaatccgatctgatgatattcgcatcggtgtagaggaagcaaccaatcgtttccggcctccttgtgcgattatattttcacttcgctgcatcacgattatgggcttgttcactttactaccatttttaaccttaccaagttttggcattgccaaattttagtaaggttgtcaaaattttggtaaagttgccaaattttagcaagattccatatgtacttacttaaatttggcaacaaactaaacgcaaccacttttttttaactttgttaaaacttgcaggtaaggttgaaaatggtaacaaagtgaacaagccctatattctcgcttcaccgcaccatgattatgttctcgcttcaccgcaccatgattatgttctcgcttcgtggcaccaattagtactctagtatcaatatggcagtgcctctagtatcaacactttgaggggtggaacaccaagtgtagttctgctagcatctgcattggtagggtttcccttgagggcagagttgcatcgatgtttcacccgaggtgagttgacgactatatctcgtgtttaatctctcggccatttgtcctcagaatttagagagctatcgaattgggtcttgcttataagtcatattttgtttttgagtaaaattttctgtatacccctgaaaactcactcaatcccttctatacccttaaaatttacacgattccttctatacccctgaaattttaacttgatccctttcatgcccctgccgtcacattttccttcatttcaccattaagttggtggcaaatatctttaatgcccttgatgatttaggtttgaatataagcttgaaaaatgattgaaaattttgcttgagtgcaaatatgtgcattttatgtagaaaatgatactaaataattagtgcggaaaatttttacataaattttaaaataaaaaattttatctgaaatttaatagaacaatagatttttttatcgggagcatttataaaaaaaatatggtgagcattcacagtcctatctttatatgaatgctcctcatttttataactttttaaaaaataaaatacatatatattttttatttcattatctaaaaatattttgtatcacacatcgaactcataactataatagtctcatgcgacaaacttttacatttccaataatgtaattcgtaaatttgtatgttcatccaaagggtaagtcatttttatagaaattatacggtcaactaacggtcaactgacggaagggttatggaagggataaaaatcaaatttaggggggtatacaaggaagtaagcaaaattcacgggtatagaagggattagctaaacttttaggggtatacaagggattttctctttatttttataggataagacgttgaccaacaattgctttactaatatatgggtatcattatatgaagaaaaaataatgataagaaagtactttcgaaaacaaagccatattcagatcacatctaaataagtcgttctagcctactaagtatgatttttaaatacgcaagagaaccgtgtattattttatttcgatcctataagaagaaggggaggttaaacatttacaaaccacccactaacatggtgacggaaaagcaaaggagaaaaacacaaaattcttccaaaactaagaggatgcgaccacaaacaccaaaactaccctagccacccctactacacaaataattttcccgaacaagcaccttagtaggttgtagacggattataagtgtccgcgtttggaaaaattgaccctcattttcgcatctggctccttaagagaccctcgtgcggccctcttgagaagctgtatgcaaaaatagagccttttttttccagacggatctcttaagtgaccacacgaagaaacatattttcacagacgggcctcttaaagtttcgtactgaaatttaagttatctcctcttttccctcttagcgcatcaatttttttttcaagttatcctctctctacccttatctcctccttatctcctctcctcctctcctcctctctctctcaaactcctctctcccggaaactctctcctctctttctcccaggcgcatggcggcagaggccggtgagcgtcctgtgcgttgaaggcggcggctcccccgtagtggcaggaggagcacgacagtagaggcgggcgcgtgatgtgtggccgggccctgcctggatccgtatggatccggcaacagtagcgggaggagcctggtggtggtaggcgttttgcgattttttatttttgcgtgtggacgacataaacacccgcacgcgaaaatcggattttcatgtgcaggtgcgccacccgcatgaaaaaatagcgtttttttgtagacccttccgggctgactggccggaggtccgcacgcgataatcacttttgacttgtctggaaaaatctattaacttattaaaggaatagaaaaaggagcctccacgttcgctctcacggcctagaaattctcatattaattggagaaaaagaaaaacatagtccatatagaaatacaatttagaaatagttaaaattcgaaattaaaaaaataaggaatattgaaagaggagactagagtccatatagaaatacaatttataaataactgaaattcggaattaaaaaattaagaatattagaagaagagtatagagtccatatagaaatacaattaagaaataatagaaaatcggaattaaaaataaggaatattagaagtagagtatagagtccatatagaaatacaattaagaaattatagaaattcgaaattaaaaataaggaatattaaaggtagagtatagagtccatataggaatttaaaactaactaaaattcagaataaacataatagaattaaaattagagtttagagttcatataaaaatataatttacaaataactaaaatttaaaatttaacaaacatgggaagaagaatatgaagtcaatatatgaatataatttagaagtaactaaaattcaaaattaaaaattaaagaatattgaaagatgagtttagagtccaagtccgtataggaatataatgtacaaattactaaaatttgatattaaaaataattaataactaacacgtatataaaatacaatatgaatattacatattagtagttttgtaaagttagtacaaaatttaaaattatgttgtcattttaatatattagaataatacattgagaaaacatatatgttattatatgggagaaaatataatgatgctagccgcgcaatctgcgcaggccaccatgcttgctgttttcatactagtgctccacctaggccaagccactagctcttgataaacatcacaaaaaccatttctccaaaatcttcttaagaaccaattacacactcagagactatgttaaacatgcaaccataatccgaatacataattttggtacacgaatcaatagtggttcttaacatggtatatttcactctcaagtatacatcatatcgattggctgaatttgaagtgtatccagctgagccgcatgcttttttggcaaagaccgaagatacaccttttgctacaataagatttcagttttttttaatagattaatattccgatctttactcaatgaagttacaaccaatttttacataagattttttttggttaaaatgaaatttcattggctgatagctagagacccagattccacaatattccgtactaccgatcaggtaattcgagagaagggaggtgaaagcagaggatgggccggaacggtgccatgaataaggttcggatctgccgaccatttgcatggcatcaagatttactttttgtagatcattacgtttgtgctgctactccatttgcatggagtatgaaacatcggattggaatcgatctcagctggtcaataattagagagagagagagagagaggcagaggcagagaagaggcatgagtaaaaaaaagtgaaggcaggagcagagagggagcagaggaggggcagagggtgcacgagtgggcagcagagaggagagggagggagatctaggcggtgtttgggagagaggggatttatatttttatgagagagactaaagtttaatacctctcttaaaactataagtctttagggaagggatttatacttttgtgagagggcctaaagtttagtcccttcccaaacaccccctggtgaaatcagcagcgtagggccaagtttttatttatgtgctgccacccacgctcacatgcaccttcagtagggctcacacacacatacacatacacacgctctctctctctctctctctctgcaaatgacatctctcattgcccaatccatccaatgaaaacatctcatcttaatctaatcaagcgccgggcatagtgtatagtagtagtactttcgttagttaaatcacagatccaactaaccctgcagctgcgtacatatttccatgtgagggggtgaagggccatctatccctgattgcagaactcatcagcttgctatgcccccatcttgatcttgtaattgctcaatattgttgctttgagtgctgccattctaggtctattcatctaaggtttttttgtggctaagttaaaatgcgtcgtaaaatctaagtaacataaaagcttatattgaccgtcaacaatatattattttaaaattattttgtcaatattgtatggcaatatatttttatcagtagtgatagtgttgcttggcacgagtttcaccatgttgcggaggtatgctgaataaggtctgttcgaaaccatgcaaaaatcaattgtattcattttatggcataaaatgcccaacccataccattgctaatcaataactaaccaagctaggtttaatgtttaacggtttattcaaatttcactcttaagtatacataacagtttaatcgtagatggcgccccggatgatgtatacactcctgtatgtgcagatgcaagcacgccccatcctggtcctccaatgggaaccaccccatgtgccacctcaatggcaatgcaaccttctctttccatgttttgtttacttatcctttgataaatttacctcatccattatttttttctaatataatgtgctgtttgatttggcatagttttgtttgatttaaaaagatgcatatgtaaatataatattttgatctttcaaaatgtctgtggtgccttttctacaatataatcttacatacattttataaatctgtaaaaaatgtcttgagccttatagttaaatgggggaaagtaataactagtggtaccatgtagacattgataggtttactccacttataatgaaatcaacccatccacctataaaatctcattgagcactgtgcatgatcaatcagtagctagacactaccatgtatcgcgcacatggcgccggtcatcgacaccaatgcactcatgcaattcctcttttcagtttctttattttacatcccggacctcatgattgattggatcgacccactcacaaacaaatcaacattcaagatcaaggacacaacaacatctttcgttgaggaaaagaaaaacgagctagagaaagccaagagcaaattaaatgtgatctcttccaataaaatttgtgatgttccaatggtggagtacgcaaattaactagaaccaaaagccttaacttttttttagactactaagcggcttgatttgtacttgttgctagatttttcctaccaaactttgtgcaaatgtggtacgtcaaagtttagaaacgcaacatccatcaatgattggaggaaaaaattggcaagaagatgaacctaataggccctagccaatggcaaattaagagaatcttgtcacatatagtagccatccaatacttgctaaatcttctagtgattgcctctgctagaagttcaaaatatagttagtgatcgatcagagagacagctcctggataggtcgatcactataaaatattattagttgagtccaccgtagaatatattataataactataaatattagcagaaattaatacgacagatcattctctaaaattcaagttctatagtgctggttgaaactgaagatatgccttatattagtatatattttaataaaccacgaacacacattaatatgtgcaaattaatgtcgtgccttttgttataaacgaaggccattataaattgcagggtgcacgtgcaagtctgcaaggttggccatccccagacgaccccagtcctcccagccggcgtccatgatttgctcccactggtctgaagccgtgtgcagtgttgtgctcgtgtgtgtgctcctcgatccgtcgtcccatccccatgcaccaccacaccaccgtgccgtgcgtcgcagcgcaggagtagtacagtacagtagagtacagaagaaatttcagcagaaggaggctgcacgcctgcacgcccatacgcacgcacgcggcggctgggtgggtgggtgtgtgtggtgtgcgtggacggggatgcgtccaagcgagcgtgcgcgcggcgcagggcggcacacatggccatccagacgcgccacctgtaggcagctattctacgcacgcacggtggtggtggtggtggcatctctgtctctcttgcgcgcgttttattccttttgaccggtgcgcgcggtgccatcccaccaccacgcagtcgcggtcgcagtcgcagcggcgcggctcccgaggccaagcatgcgccgcgccgcgccgcgccgcgccgactactactccagtggataggccagtgctacccctgctgcctatgtaggtggtgtacgaaataccaacgattctctaccataagagcaagtttaatagtatagcctactattagctccaatttatttatagccaattcatttaatagttgcttactatactattaatatatggtcctacatgtcaaacagacatcgcttcttggagtcaacactgtagctagttgcagatctatagcccgttgttcttctctctcatcttttatctcattaaaatatgtttacagctggctaatagcctgctattgtacctgctattgtaacttctctaatgtcataaccattattggctctaaatcatctatagtcaacttaatagtcaactcatacaatagttacctataaacatatactacataattaatatctggtcccacctatcatacattcatgcaccctagagtccatgctgcagctggctataaatctatagcccgctgtccttctctcttctcttttatcttctcgaaatgtgtttatagttggtttatagcctgctattgtacctgctcttagagcaagtttaatacttccttcgtcccacaatataagagattttggagggatg

SEQ ID NO: 78557 - DNA, 1405 bp, Oryza sativa
  unsure (1)..(1405): unsure at all n locations
aaaaaggtattccaagtgagggtaacaaaaggtgacttttaaccaataaattaaacatgggttgataggttgggtttacaattcctgacccaacaaaaacttttaaaattttaaggaacccattaaaaaaataaattttatagaagctaccggacattgggaggggcacccattgtttttgtgtaaaagtaattaaaaaacccgtttctttcaaaaccacataaaaagaatatgttatattaagcaaaaggaaatatttatttaaacggtgaaatagacaaaagcctttaatanactgaatgttaatgtctatcacatgcaaacaaaaatcactttgtcactattatatgtaaactcgtctacaaccatcattcgcaaacataatataggttttgtttttttctttcttttattatacatctaattcacttatgccatggtaacgtacgaaggaataatttatattgtcatattatttacgctaactattaatactatttacatgagagcggcataatgcagtttcttgtgccatttaatttcgatcttggactgaactgttagtgctgacatacttgataaactgataactcactttgctgacaaggaattggtgcatcttttgcactgactttcgtgaatcctcatatgcttactttgctttgaactactcttgacccggaaacaagtatttgaagaagttgcttgatcggcatttcacctggattacgatttctccctgttcttctgtaggctgaactgttgacacggcagcccgggtgtacacgttagatttaaatctgttaacttggcaataggcttctttgagctataactgttctttccctgcttatctgaacatccaattgaaacggttacggggcatgacaaaaatcatcttcgagacttacccttaaaacaagtggttgagcatttgcctgaccgtgatcaattaaactgctatccttgaaaataaccaaacttcggttattttcctggaaccctgacttggagaactcatcgcttcatcaatcagttcaaataaggtgatgccggtgcactttcattccaagagggcttggaacataacactgatcagttgttgacaggaagttccacaaaagtgactctcattcagtttccgaacatacagactcttgattgacctttccatctgcatgactgttctgttctgccctgacttcggtgtcaactggttgaacgggctgcttagttgatatcttgaaataagcactgatcacttaatagatcaagctcaaaagattatttcctcgatataacatttcacttctttgcttatcctttattgactcctctgggttgatagactataagctctaaagttgctttccnncgatnnctgcgagaggtgatcataagggcg

SEQ ID NO: 78558 - DNA, 9250 bp, Oryza sativa
ggatgtgacatattcgtagtactagaatatgtcacatcccttcaaaatcccttatattataggatggagagagtaatataagggattttgacattttgcttgcattgtttgaccattcgtcttatttaacaaaattttggaattattttttttgacttactttattatccaaagtactttaagcacaatttttcgttttttatatgcacaaattttctgaataagacgagtggtcaaacagtgcaagcaaaatataaaaatcccttatattatgggatagagggagtagcccactagtagctccaattcatctatagccgatttaatagccaattcatacaatagttgcttactatactattaatatatggtcccacctgtcatacacacattacgtcttggagtccgtgctgcagctggctataaatctgtagcctgctgctcttctatctcatcttttatctcattaaaatatgtttatagctggctaatagtctgctattgtacctgctcttatgatcatctgtatgtgggttttattcttttattgccctataagtcagtgttcataatgatagcgctattatgacagaggatgtgaatctcgtggctaggtttaccaacctgttaatcttctcagtttttaaaagccacataaaccatgtggataaccatcatgataaccctatgcgaaaagatttgatgaaccctgtccgtagtaatgcttctctctacatttgtactcactccatctacttttgatagtcatattttcaaatctgaaaaatttatttttgataagtatatttcaatccaacaacctatcatcttaataactttctcggatttaatgcgtgactctccattcttccacacatgactggctacatgggcattaaaaatataaatattaatgaatcgcttgtttacgaggaatgactagtagcatgtttaaatggatgataagtagaattacttattcttggtctatgtgtcaagatgaaatatgactatcaaaagtagatgtagggagtatttatgaagcttatgatagctacagtttatcccaaatcagaagtttcatataaacatttgagcttttcaatcaaattttgttaaaccgtagtgtagagctcaaagataaattagaagtcaaaaaccgaatcttctagccttttttaattcttattagatgcttgtttagagcaagtttaatagtatagctaactactagctccaaatcatctatagtcaatctaatagctaatttatacaatggttaacttcaaatatatgctacattattaataattggtcttacatgtcatatacacacaatattttagagtccgtgctgcaactggctacaaatctatagcccacttctcttctctcctctcttatctcctacacatatgcttatagttaacttatagtctgttattgtacatgctttgagtatccaaaacttctccaagcaaacctatgggcctgttttggggagcttaagattctgaaaagcagctggttggtagccatcttataagaatctagaaaagctgggtttcccagcttctggcttctagttcattttctggattctacaactacaacttctcagaatctagaccaaaagctaaactgtttggggggagtttttgattctgggagaagctgctgcagctagaagctccccaaacagggcctgggcgggggtgggggcgggtgtgattttcgacccgcaggggtgtcagggatagggccccgcatttgggcgagcaggggacgggggagacattttaccgacggtgaccctcgggggcatggggatgtatataaaccctcaaaatatagcgcatagaaggcccaaaaagcccaacccaccataaaaagctactaaaccctagcctctgccttatctctctctcagtttcttcccatatcccctcccctcccgtgagacacacaggcgcctcccctcctgtgagacacacaggcgacgacgcaacagggcgcactggatctcgctgtcgctggccaccatctcccctcccctcctctccagtctccccttcggcatccggcctcacgaatcccgtcccctccacagctctacctctccctccggagtcagcaaggggtggcggcggcgcacagggcacggcggggaggcgagacaggcaagggcacggcgagggaacaggcgcggacagcgaggttgcggcagccggcgagacaaacaagggtatggcgagggaacaggcgcggccgcgtgaggttgcagcgcacaggcacgggcgcggcggcggccggcgattcacgacgagcttcacctatgcacaggtggcgattcacagatagtgagaggtattgctacatctccaagattccaactgtgccttgtgaatgaaactgtgcccgcaattttctcgtgtatatttaatagatttggtagtacatagcacataacataacaatagaatctaatacggggctctggtcaggttgtggggccccggaggggtcagggacgagcgttgtttttgacccgcatccatgatcagggcaggagtgaagttgggggtcggggtctggagcgttccagcccaacccggtccgccccgccccgttgccatccatacctatgcctatctaacaccctagaattcaattccccttttctttattgtttgaaaaaactaattttcctcggtgcagctgcaaggcatctgaccattgtctcgacacatacccatagtcaaggccttgccttggaatgtggacccttaatcagaacatgaaaatacatattttttctatataaatgctactctcgtatagtaaatttatttttcacccatctcattcgttattactctatcaaatctcttgcctactttaattacttctaatacatttattactttcataaatattgatgtaatgattctttaaaagaaacttattttataataaatgaaagaagttaaaaataaacttgcttttaacaaaggaagtagccctgtctcaaaataaatttatttttaatctttataattcgtcataaacaaattttattttttaatacttcttaccaagtataagatgcattttgatcataatcacaggagcacaggttcaaggcagcgttcctggcccgggaacgtccaccacgtccggagaacgaaagaacattttcatccagactttttaaaaacttcacgcaaaaaagcatacaacgtttctcaaccccgttccttgatgagaaacctcgttccttgatctcatcagaaaccatagtttttcaatcatcttaatttgggcttcaatagctaaagataaattatttcaggaaagatactacacaatattatttgtcttatcaatcatctttcatttaattcttttcatcttaatccaaacgactctctcacattaaccatctcacatttaatatgaggtatcaaggtctttttttttgctctattaaagaatctaaaagtgtttatgttttgtaacgaagagagtagtaaataggtttattaatagcaatacatagtatattctcctttagataggttaaagtacaacatataaaaaaagagagtagaagcagtaatttttcaaaaaaaggccgttcgtgtgccaaaatctttttaagtatacggatacacatttgaagtattaaacgtagactaataacaaaataaattacagattccgcctgtaaactgcaatacgaatttattaagtctaattaatctgtcattagcaaatatttaatgtagcgtctcattgtcaaatcatgatgtaattaagcttaaaagattcgtctcgtaatttacatgcaaactgtacaattgattttttttttcatatttaatactccatgaatatgtctaaatatttgatgtgatggaatttttggaagtttgaaggtaacttaaacactgccaaagttaggagaggggagaagtaaattaaaaaaaagaagaagaaaaaggcacaggcaataattcttgtgctgggggtggtggtggctggctggctcgcctatataaagggggagggaggggcttctcctcttccagcacaagcaagcagcttgaagcaacccaccacagcttccttcttcctctgcttcagcagagcaggggagcagaggagggagaggtcactcattcacaacctcatacagaaggaagaagaagaagaagagaagaagattcacacatacatctatagataaaatatatttatacatatagagaatactcagagagtagccaagagaggaggaagaagaagatggtgttggtggcgattggggtggttgtggcggcggcggtggtggtgagcagcctgctgctgcggtggaacgaggtgcggtacagccggaagcgcggcctgccgccggggacaatggggtggccgctcttcggcgagaccaccgagttcctcaagcagggacccagtttcatgaaggcccggaggctcaggtatatgctatattactccactatgaaacaagcaccaaaccaaagcaacacaacaactaactgcttcttttgacatgctacctgacgcgccatacattccttcccctgcaatctctgcatcatgcgtgtgtatatctatctatccatcatatgctctgctctctgctctgcaatagcaagcttgaagctttggccatggggggagaggcagaggaagaaggagctgctgcagtgctgctgctttgatgatggtgatgatgatgaagatgtggggagagagagagagagagagagagagagagagagagagagaggaggtgatctggaggaagggagggacctcggagctgtgtcccccaaaagctcacactcatcactgttccagctgggagatcctctctcccttccagtccaccaaaaagtgcccaccctcataacacacacacacactaacactcttacacaaaagatatgattttttttcatcccaaggaaaaaaaaggagcgattttttttaattacatccatccccacttggccccctcctaaacttttctcccttcaatgatcaactaaaagagaacatccacagcacaaaccaagcatttgtttttcttctccttgttgcagaatctgtactactagcagcagcattcatccatcacaatcattcattcctccatttccttttattatcaacgagaaaactaatcaaacactaataccactagcagtagcagcaatagtagcagtagtactaaaagcgaaagattttgcaggtacgggagcgtgttcaggacgcacatcctggggtgcccgacggtggtgtgtatggaggcggagctgaaccggcgggcgctggccagcgaagggcgcgggttcgtcccgggctacccgcagtcgatgctggacatcctggggcggaacaacatcgccgccgtgcagggccccctccaccgcgccatgcgcggcgccatgctctccctcgtccgccccgccatgatccgctcctccctcctccccaagatcgacgccttcatgcgctcccacctcgccgcctggtcctcctcctcctcctccgccgtcgtcgacatccaggccaagaccaaggaggtactctctctgcttctacttctacttctccttctccttgcatggatatcatcgtcttcttttcttttcttgctttctgaaacaacaacaacagtagcagtatcaggcattacgatctgtctggttattagtagcagtaatgagtagtaaattattggggagggtggtaatttgtgtggggcccaccgtaagaaaatcttggtctctactacgagtactaccctgcattaagaaaatctcaactgttgacattagttagcactagtactgtactgtggttccactgatgctgcaagttggcaacaaagaatgggtggcaccactagcagccagcagcagtaggaagcacacagtaattacctttttgacctttctttaccgcactctactgctgatagtacaatggcagcagacagaatgatggtgcctcttgcaaaatggggaatggagcaaaggaagaggaaaggaggggagaaggaagatccccctttcctctctggacccccaaaaaaggggaatctctagcttttctagaacacttgtactgctggataacaaaagaaagagattgatctatcatgagctctttcctcagccagaaataaaagacactctaccagacacagcatctctctcactctcttagtactaagtagtacatattcattccaaagtgaaatctatccataattatggccatcacatgtctcaaatgcctaaggaacttgttttttttttttttaaagtagcagtagcattgtatgagtacctggtttgcttttggttggcatgctgaatttcatacttgcatggcagctcacaccaatgtttcactttcagatggccttgctatctgcactcaggcagattgccggcgtctccgctggcccactctctgacgctctcaaggcagagctctacacccttgtgcttggcaccatctccctgcccatcaaccttcctggaaccaactactaccaaggcttcaaggttagctgactgcagaattgtactgatatggtaattcagttaaaactcatgcactgaagaactactctaacaaggcactcttttttttttcaggcaaggaagaagcttgttgcaatgctagagcagatgatcgcggaacggcgatcctccggtcaggtacacgacgacatgctggatgcgctcttgaccggtgtcgagggcaccagggagaagctcacagatgagcagatcattgacctgatcatcacccttatatactctggatatgaaaccatgtcgacgacctcgatgatggctgtcaagtacctgtcagaccatcccaaagctcttgagcaactcagggtatagataatctgaaaacaaaccacttgaatcccatgatgaaaaccatttcacacttcgagtttactgatgatctgttcacttctgcagaaagaacattttgatatcaggaaaggtaaagcgcccgaagatgccatcgactggaatgatttcaagtccatgaccttcactcgagctgtaagtttgatgatgataaactcagaaagcagccacagtaacagtgtagtctgatcatgatgaactcatgggcacttttactatgcaggttatcttcgagacattaagattagctacagttgtgaatgggctgctgaggaaaactacccaagatgttgaaatgaatggtgagatatgcatgatatatacgctgctgcaattagcatctttttgataaatctttggatagccctaatgcagtgcttatttgtttcttccagggtatgttatcccaaaaggttggagaatatatgtttacacaagggaaataaattatgatccattcctgtaccctgatcccatgacattcaatccatggaggtggctggtaagtaaaacagcaatcaagtaatttccactagcacaccaataacaccactattgattgaattgtaagtttctaaccacgtaatacttactgataacaggagaagaacatggaatcacatccacacttcatgctgtttggaggaggtagtcgaatgtgcccggggaaggaagtaggcaccgtagaaattgcaacattccttcactatttcgtgactcaatacaggtttgttcatcttgtcaaatcctctgttgcttagaatatgtctggttctttactgacaaagaagacatggtgttaatcttttctttgcagatgggaggaagaaggtaacaacacaatattgaagttcccccgagttgaagctcccaacgggttacatatccgcgttcaagattactgatcctggaacattttgcgaagttagataggaattcaaatcagatagaaaataagagtgcaattctgatgctgctgccctgatgacaggattagaacagccgtttggctcttgtaacatatgtccatgaaaataggaatattatagagataatataggcattataggaccattaggaagctaatgtagattgccatcagatgctcctgtattcttttggtccatcaattgttgaactaaaacagaagtgtcatttggcttctatgcttctgaacatgatagagagttaatagacaccagctgtccataagaacagaacacatggatgaagacttgacaagatacacgagttctcatagaaacagggatgaagacttcaaatttctcttctcatgtccactaactgaaagaaatatgaaatatgtaaaagaggaaatactgatagaggaacagtaaaggtgtacctcaatgaacaggctaaagcaagtaaactgcttcaatggtggctctcagttttccctatagataccaaggaactcatgttaatgaacaggggatgcttcaattggttggacaatatattgatgtcgggaaaagaacttgcctcacctcaacatactgaaaagcagtattgattgctagtacaggagatgttaacagttgttgaaatccagaagtgtcactgttggctgttgctgctattcataggacacgaaactacattgtgtaaacacagaggtgccagcccacaccatttataaattatataattcatcataccaaagattatacaaagggacaagtggacaacatttccagattgctacaggcaaattttctcaaggactgaaattcccctctaaatgaaggactaccaaaaccctaggtaaggcatgcaaggtattcaagtaaagaatgaaatgatacaaaaaacacaatgcagttctgttaacttgtagtaccaattccaaactagtagttctgctaagtcacatttttcataaacattactaccaaaacatcttttttgtggtgctgttatagcttttcttcttcgttttaaaaaaaaacaccctttattctggaagatacccccaattcagatcaatggcgttctttatcaccatgaaatgtctaaaataagactacacagctcaggtgagttgtatattggaataaaagtagcctgtcaagttattttgtggcaagattaataagcccttgaagttcattatgctcaattgtcacaatgaaaaaataaacctgaaaatggaaataaacttccatgggacatgagctatcaactatatctatttgaaacagttttgcactttaattactactacaataagttaatgtaat

SEQ ID NO: 78559 - DNA, 4080 bp, Oryza sativa
  unsure (1)..(4080): unsure at all n locations
gagaacacaagcaagtgagtagaagatgcaatctgaaaatattgcaaatataagatgaatctgacaagttggggttccacagatcgaactagcagcgttattacacttttctgaaagtatttttttaggcggcgtgtgctcttaggaaaatatttaacggagacatcttagcagccgggcggcccgcttgcgaaaaaagccaaaacgtatcttcacaggcagacccccgcctgcgaagatccgcaccctatataagggcagccacccccgtgccaaattttctaagtccaggcaggaaccctagaaaatttggcaccgttaggctgccgaaattttccaccgccgaccacctgcaatagctcggcggccgtcctccgccacatcctcctctcctggccgggccactccttcgccgactggccacgacgctgcttttctcgcgtactacgaccgctcctactcttcttcgggccagcaccgtctcctaccagccggacgctgccacctcctcttaccggcccggcgctgactagctcctaccgtccgaccgccgccactaccttcttcgtggctggcgccgcctactccaggccgaccgttgccacctactccttcctggatgacgccgccttctcccgggcgatcgccgccaccttctactcccgcgccagccctggttcttcttgggctggcgccgctacctcctcctcctggcagaccgccggcaccctcatcctcccgggccggcaaagcctcctctcgggccggcgccacctcctcctggccgaccgccgccacattctccctggccgctgctgaagactctattcgactgacattcggccgatcgtcgtccccgactttacgtccacgaccgaacgtcgcctcggccgcagctcgtcctcgtcatcgtcaaccgaatgaactcatgcatgtgtgtgaggggtttgaatggtatatatatgtgtgatggctttggatgacatgtggggccggtttgggttttttttgggatgatatgtggctatgtgctatgtggtgatatatgtgttttatgtgttatatgaaatgttgaatgtgggtgatatgtgttgaaatttttttgatagggcatgtgggtgttatatgttcaacttcttttcagatgacatgtgggtgagatatgttcaatttttttatatgacatttgggagatatgttcattttttttacgtgacatgtgggtgatataagttcaatttttttaatatgatatgtggaatttttttacatgacatgtgggtgatatcagttcaaattttttcatatgatatgtgggtgatacaagttcaatttttttatatgatatgtgggtgatataagttcaaatttttggtagatgatatgtgggtgatataagttcaatttttttgtagatgatatgtaggtgatataagttcaaattttttgtagatgacatttgggtgatatatgttcaattttttaatgacatttgggagatatgttcaattcttttttaatatgacaggtgggtaatatatgttagatattaattatcgttctcattcttatgtttatagtactaaacgatggctaatagtcctaaaggagatgaagataaggatgtaggggccatcgtggagtactcacagctgatagtcgagccttcacaacctaccgtggagccgtcatagcctatcgtggagccgtcacaagcaattgtggttgcttcgcaacctaccgtgccgccagccgatgggtccgacagtgatgaagctgacgagggagattcatatttgtccaagcccgaaatggcggacgaaagatgatggtgaagaagacgacgaagactacgtccttcgcaagaaagtggtaggtttctataatgtcatttgagttgcaactgtacgagtgataaatagtagttcgtactaactcaaccattttttaattaatatcgtaggaaatggggccacaaagatctagatggcatccgaaaaaagccgcccaactcgatgaagtcccaactacgacctccaactccaagaagaaagcaaagtccaaagagcttaccaaaaagagaaagggcaagaggagcgtgaatagaatagacgatgggttgtacgttgtcacccacataagtccaaatggtgagccgctcgcgccctccactgcacgcgcaaagttcagctttcagtgtagcgcaatagtaagcgataagatcgcagtcatgatcaaggactgggatatatagtgtgtcagcaggggacaagaaaactctttgggatgagatgaagaaaaggttctagttccctgagggatcagaagcaatgacaaggaattgcgcattgcaaacaatggacaaggcgtggcgcggatagaaaaacactctgaacacacaattcgtgcacaaggggaaggcaccatttaagaaatatgggaaaataacgctgaaccaatgggacaaatttgtaaagttcaagacctcgccggaagaaatggccaagagtaaaaggttgtctgacttggccaagcgaaaaaaatgcaccatcgactgggctccggtgggtacgcacgtaagattgcactgtggaataaagaggatgaggaaatgaagaaggcgggggttccggtgccaatggaagaatggaacatacaatccaatcattgggtaaaagaaaggaccccgaagatcacatcggaagggaaagtgttatttgaagaccccgagctgcagggagttgccgacaagatagaagatttatctagcaaggaaaagaaaggagaatttatcccacagagggagaaagatgtgcttagccaggcgttgggaaatcgggagcacgggggtcgggttcgaggagtgtcctctaagctgagttggaaagaagggttcaaacaggacgcctcctcgtataagagacgtgacgcctataaggaaagcttgagggacgaagggggtaagaaatttgaaaaacaaatgatggggttttgcataagacattttctactgcctaagacagaagaagagacccaacaaccggaaccaaattatccctttgatgacttggaggagactacaccctgtaggttgcatgtaccgagtggacgagctggtaggagacttgaggctacgaccgaaattgctatccctggtagaacgtaccatgacagatttattgattctggatatgcgaaagtgcaatcgcaaggggtgaataaagggtttaagtcgtacgacctagatatcccaactcctgatggtataaccgtacttggggatgcggtcggccttatcatattctatggcacaaaaaggatataatctttggcactggcaccgatgctccaccgaaaccaacaagacctcctatgaagaaaccgtttaatgataaggtggaagaacattagccacctaaggccactgaaggcccagaaaaataaaaggaggtgcaaattgcaccgaaaaatgaaccagtggtgcaagaaccggatgtgccacaagaagatgtgcaatttctgtcatcagttggagtagacatcgaagtcgtatcgggtttggaatgggacgatgcagaaccagacgtctatgaggacccaaatcttgcaaaagatgtcatggaccaaaccccggttgataacaaggaaaccgaccgagaagtctgaagtgcctagagtgctcaaaagcctcaactccaagtctaaggatgatcaaaaggagaagtggagggtaaccgacttcagtgggagtaaaaaacgtgccaaggaaagaaaaggccggattatgcaattgatgagggtccattggagatgacatgntacataaatgtncattgacaacagcattgtaaggctaacctattaaacaatcggatcaacactgatgctgtcggccagcaaaagttcttcttgcttaatttcgtggattgcatgccatcatcggncggaaaagatggatgtaactttttcgtgatgtggcctattaattgatgcccattttcattcaaaaaatgtnntaatcttaacactggttaattattacaagctggtttataggataccaaatatgatgtgtgaagg

SEQ ID NO: 78560 - DNA, 537 bp, Oryza sativa
  unsure (1)..(537): unsure at all n locations
tatcgcnggtggacgnctcctttgtgacggatactatgatctgctcgtcaaagaccacgaagaaaaaatgatctacagatgtctgtaacacactaattcttgttgatatattagcaacaataaccttttggtatgcacttgtgttacaaattttataacatactcgatatccctgacgttgttgctttggtgaggtgccgccagccgatgggtccgacagtgatgaagctgacgagggagattcatatttgtccaagcccgaaatggcggacgaaagatgatggtgaagaagacgacgaagactacgtccttcgcaagaaagtggtaggtttctataatgtcatttgagttgcaactgtacgagtgataaatagtagttcgtactaactcaaccattttttaattaatatcgtaggaaatgacacgtcgccgatcatcctacaggcttcggcgtcagcctggtcaagggtcaacactataaaaataaagggagtagccacattaagcgtcgaacaaagcaaaataacaaagcacaga

SEQ ID NO: 78561 - DNA, 8817 bp, Oryza sativa
tgtgtatgtgaatgaatgtatatgaatgggggatgttggggtgtgatatatcacggcctagggcttaataggattaatagaatactcataccaacaaactacaactattcttccggaagccgatcttcaaataactttgatattaagcgtgtttagcctggagcaatttcctgatgggtgaccgattgggaagtgaactttgtgcaaagtattggcctgagaagggcgggacggcatggaaaggctccgattgggaagtgaactttgtgcaaagtattggcctgagaagggcgggacggcatggaaaggctagccaaaaataaaaatttattttttttaggattatactcatcagtgacgggcattaacttaggcccaattgagatgactcatctgtgacgggcattaacttaggcccgattgagatgactcatctgtgacgggctatagttaatgcccgtcacagataagggtcatctgtgacgggctatagtttaggcccgattgagataggtcatccgtgacgggctatagtttgacatgtcgtctgggttaaagctatcagtgacgggctttaattagggcccgattaagataggttcatccgtgacggccgtttgcccgattgagataatttttcacatcagtgacttctagcctgttacggacgccgtacccgattgagatgggggttaccgcccgattgagatgatgttatccgttctagtgattcaaaatattccattgtgtggcaaaaggaaaacttatggggcaaataatacattaattttgcctagttaattacatgcgtgccattcacatagatgtaataatatatatacaaaatgtattcccctggacgctgcatctattacctacatatgcaggtttatcctctgatggccgcgatgatgttggcatcgggcatggttgtgttccagcttgggcgcaacgtgtgcaccaaccctgaagtcaagtatgtcaatgcaaaacctcttccaacctaactagcctagattacagaatgtcaatatactgcctctaggttaagaatatttatcatttgagataagagctaatatcaaacttttaaaatctttgaatataaattatttctaaaatatttttagaccatatatatagattagcaaaaaagttctttaattaaattaaattatatatctattaatatttctattatatatattataatataaaatagtggttatagttaatcttttagcgttctagtcaaaaccaccagtattatcaatctgcactaattaagttatggaaatttaacttctaacatgtatttttttcggctatgctctaaataggatcagcaagcgcaaccgccgcaacgcagtgccagacagcgcggcggaagcggagaggtacagcatgcatggtttccgccgcttcttcggccggcgtcgcccagaggtgatgccctccatcaaccgcttcttctccaactccgatcgacccaatcatgatgagaacaatgatgattgatgagtaattcgcattatgtggtgtatttgttcgctataaggaccagcgttatgtgacgtaatatggttagatgtgaactggtttattattttaagaactcggcctgtgtgcatgcaaaaaagaaaaagcaagattggtaaatgtaatgtacttttactttatttgttggttcagcacttgatttttttcttttatcaacaaacttacctatgtgagtgttgacagagcctaagatataaatcatttctattataaaaataaacagaattgctaactgtctactgacagaaatttgatggttaaatctttcactttctaaaccgttagatgtgtttgagatttgtgctagtcgttcgatatgcatcaagatccgtgctttctaataaaaatacgaaaagaatcatgtcacctgatgggatgcaggcgcatgacacatctaccaagctattatggtttttatgacttgatgtcaacttacatcctatttatcatataattgcatgctagttacatatgtaattatagtacaaatataatgtaattattaaaattacattgttctttattgtactccgtagttacatttgatagattttaatgataattttcagtcgaatgtcatatagattgtttcaaaagtaaaataaatttcaggtattttggttctgtaaagggaaacgataagggaaaatcaatggtttttctctcaaattaactgttggtggcctttcgattgtcaagtcgcttctaacttttctcattgttgaggatatgcgtaatggctacgtacacggcatacatatccgactacaaatagaagatggattgaacccatgtattatgtaataaagtaggattcggtcgttatgttgccttatatgttaaagtatggtatagagccccgaacggatactaacatgtaatagaataggaaattgatgtcgtttccggctaggttttcctcattggaacccttcaccccaccctatataagatgcgcagagagctccttaagggcaaccacacaatcatatcatcaaatcaatacaacatgagagaggggggaggctcggcacatgagatgggccgcgcgacacgttggcctgtggaggaagtgaaggagaggggaggacgaggctagcgggctaggaagagtaaggggaggagggtgcccggttgaacaagaacatttataaatattccaggagtttggaagggggaaattgatgagttgaaatttgaaatcaaacttgatatttgaactcagggaattttggggaatttttgtaagcgatggtttagaaagaatttgagatgcacaccttggcacatacttgaaaaatacaaaatatccaattttttggctccaagccggtcttcatttccaatgcctcgggaaataggtcgagatagatgacaacacatttttatcctcttccttacggggaggcgcacttctcttcttctcctggccttcacctcctgcccggcctggaaatagaacccctttctgatccattcattaagtttttattcaaatagattttctcaggcacaaaaacacagtcattacaaagatcgatgccaccacaccgtgcagtcgcgccagcgctcctcttgtgcacgcccatgccatctgagagaaatggatggaggaagaagagagaaaacgcctcttgtgcacgcccattacaaagagttgttttagttaaattctctctccaactctaataaaaataatatttcaatcgtctttatgtcctgcagcaaattatcacaattttgaagtgtcctcgggcattcatgttttttttgtctacaagcaaataccacactttttcagtgtcgtgtagcaatttttaccaatagatttttctttgggatcagaataagttttataaatattatgtttttcttttaataagcccgccagccaccataggctagagaaaatacataatctttataggcaggctttcaaccgctaacaaaaattgattttcgttagtgcctatcttaagccaccagtcaacgaaaatcgattttcacaggtagagctaggttaagacgaccactagcaaaaaatcattttcgtcaaagaaaaatgaagaatacccacatgcagctcccctctgatcggctgcaaagattatttttggcaaacaaggaatgaaaatgcccacatgcagctgcattctatttccagatatcaaaccacaaatcaagcaaatataggaagaacaatcatcacaatactctataatcaataagaaacatagagaatccattcacaatttcatctcagatgtacaagaaagattagagagaagagaaggcagcctagcttgtcttggagccgttgccaagccacggtcatcgacaccaatgagccatagggacactagcgctgaagtgtcctgagcttggtggatttgagataggaaggtcggcgccgctatatctagagccagaggccttgccctccccctcatccactggcattgctcccttccttttttttgccgtggagaagctcgtctagatctaggactgtgagggaggtagggcacgtgggggcggaatgcactcgtcagacacttccgagccgataggaggctgtgctcgccggtcagtgatacctctatgaccaactcccaattctacgtctccgcaactctcgaacactgtcagcccttcccattacggcaaccaaggcttacgcggcggatccccttctcctgattttgttgcaactcgctgtcgccatcgccgccgcggtcatagtcgccatcaccgtcgctgagagcaccgcgcggtgtggaggtaggaaggatacagggagtatggagggagagggagggaggagaggtaagggagaggagggagaagagggacttagctagtgtgctggccggggagactctgccttttaataccgtagtttttttccctaaaggcggcaattagcgaaaactaattttttgttagcagtgacttaacaggtcccttgtaaaaacatcctcgatcttgtttggcacaagtttaaggagagacaaatgaaaatattccttggactccaagattatttctttgatctcttagaagggagagaaagaaatcccttgtaaaaacatcctcgatcttgtttgacacaagtttaaggagagacaaatgaaaatattccttggactccaagattatttctttgatctcttagaagggagagaaagaaacccagccatacgagtaatcatatatatgctccctctcttaaggctagatgatcaggcaatctctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcaatctgatttaggaaacgctgtgaaagatgtctgcaggagacttggacatggaagatacaggattatcttctcctcaataccaccaaaattcacaccacctgttcgtccagcaattcattatatatatatcatgaatggacaatttaattttcaagaagacggtcctagcaaactatcggacgaagaggaagaaatatatacaacaattgctaatcatgaaaattggagattattttctgaagctgcagaaattgaagaagctatcaccacagattatgaatatcagctggttttccaaaacaaaatcacaaggatttttatcagcaaattctacaaccaaagttctgaatactttaagggagcaggacgcataattaaaccggattttggaaatgaatgctccaagaaaagttactacagaagcctggctcagtggtttcagaaaacagagccatcagagatcgacacggtgcaatcagcacccatgataatcaacgaagataatgaataaagatcttgtcatccccgacaaagatcactattcaagataaggaatctacactattccagataagataagtctatggtcaaaaggcgatattatgacatctttattgaaggtcaaaagcgtcatcatcaaagattctctccatgaagtctaaagggatatcatgaactctttgaagtcaagaagagatatcatgaagattctctaccgagcgctatataaggggctcactatcacatttcagaggcatcgcattccacacacaacacatctcgctcaaccgttcctctcaccgctccaccagccatcacactccactccactccatctaagtgttagtactatagtataacctaaataaaagactcatgagagtctaagtgtgagagtctatgtaagagtctttgtgagagtcatgtacctgtataattacgaacgtgttgtaccaagtccttggtgtaatcttcagaaggaactaccttcaacctatcaaggtatatgaatgaacacctggaccgttctatataaacctattatgttctaaatatctaattttatatcttgtacataatttgtatttacatctttatttcctgtactgcatttatgtttgcataataatataaaaaaaaatttaacaacctggattgccatccaattgtcacatactaatctcacatccaagattgcatatagataagcattcctatcctcatatctggtgactagacccctagtcactgccctgggcaagagctggtatcagagccaagtgctcgtaaccttcccaagccatcttctccgaaagtgggggagaggggtcgggtggcgtgctgaagtcgcggtgatcccgaacggtgtggttgtgttctgaagttgtgattaaatcgttctccatggcctctgggcagttggggcagtctccatgaactcatattcgtgagccattcagacttctgtgaagccatttccctgcatatatattcaaaatctctagtagcttttaataaatatttatcttcccatgacgtcttacctggcaagtccatagattttggaagatatgatgggaaagaatcgtcatgtaaatatattgtattcacaacttgttctctcttggtctgaacaagctggtcaagaatctcatctgtgttagacgaaaatcttaggctcacctgtttgcccattatcttaaattgaatatcttcgtttgtgactaggaaaggacgaataagtgataaaaatggtgttcctaaaataacatcttgcttaagatttttaacgagtaggaaagatgttttaatgcaaacttccgagatgcaaatatagatttcagggatttgatattctactgttaaaagtcctccatctgccccacgaattctgtgggcggctttatagaaatatttatgagggataataccttctcgaatgcaattgacatcagcaccagaatcaattaaagtaatatgctggaagtaggatccgtctataaaacgatacataacttctgtgtaccatttttgcttcatatatttttgaatggttccaacaacatgatcatcttcttgaattggttcgtccttttcttccatatggaatccttcttttgattctaacatgtatagacgctttcttatttcttctaaatcttgtttcataattttttggtcttcgaataggctgatcaaatctggttgctcattcttctttttctattcatctaaccttttaaacacttcatcaatagagaggaatttgctcttttgaaatccttttttagtttatccttatcagttttgactcttgaaaggaatttttcgaggactcttcttttttcttctggatcttgaatggtttcaaaagtatcgagaacaaattcttctaaactggttaaaacgagtatattttcatcagactcttcttctgaattatctggctcacaacaagagcaaccactgtcttggcaacagttaatttctgtatttttttcttcatctgaacttgagtcattgtctatattatttagtattgcttcaagtttttctttaacgtcttctgattctgaatctaacaaggcttggatctattttttaactttggatttgaaacatctgttagctatgtgtcctttcaagccacatttgtaacaaatggtttctttgctttcagtgtcttgtgttcttatattcttattgtaaattctttttggtttccttttggtagcttgaaagctcatcttgcttttatcatttggttttgtcatgggtttggaatgggtttttctttttctatagacataaggatcttgaaaaccaaactgatagcaaaaatctcccatttctcttttaccaagaatcctttgttttttgagttgatctttgatttttaggtcattgcaaagctcagcccctactaattgtatcttttgtgtgatttttccaatatctagatagtgataatttatactccctcccccttcttttcttagggaatttctaaccttttcagcaaataaaggaggtaaactagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccggcaaagtgataaattatgttatagattagagtggctaaggcatcagaaatgttaccggttggattcccattaccatctctatcaggtaatggccttccttgatcatccctcttaactgcgcaaagaatctcctgtctttgagtttcatttaaataattattccaccatccttttaattgaccagaaaacccaatgacaatcatattggcagcttctctttctttgtttccattagctatgcaggcattagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgaccatatcatatttctcattatcagaaatctcattgatgtttttatttacttttaaattatttagttttaaggctagcttattgactagttcttcagagattgcgggtccaaaagccttttgttttccaagtttgatgttaggatcaattgttgggacaaacataggactaacagactgagaactagaagactgag

SEQ ID NO: 78562 - DNA, 1185 bp, Oryza sativa
  unsure (1)..(1185): unsure at all n locations
cagtccttgtgaccctgtanancnccnnnnnnnnnnngnggnncgatgctttcttaataaactctacatatacaaaataaagatatatcatgtatcataatatattctactgaattggatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaagatctcatcgaaattaagggtaacttttatttccgctaaaagttttcggtttttgggtataccaaccattcacccccctctggttggcttagttcttgtaattcgatcctacaagtggtatcagagccttgttttcttctttggatttttatcgatctagagtttttgccatggctactcccgctaggttttcaactaagccttatgttttcgatggaacggatttttctcattgatgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagtggtatttctcgttcggaatatgatcgtgttgctcatcttcaaactgctcatgagatttgggttgctttgagtaattttcttcaaggaacaaataactttaaagagcttcgttgagatctttttaaaagggagatattaaatttgtatgaaccctgcagaagctttgatgacatctttctaggttaataaaaatttagtgaattagactgtggatcttctattgaactaatttccacatctgagattctcgtactttttgatggctcgacaggttttttggagatgaaggtcattttttaggagcggtaacaggtaacttccttgaatactcttacaaacggaaaccatggaggaaggtttttctcaaaggactcaagcgagcttgggctttcttttcctctgagggggcagaaaaccgagccagagaatgttacctccg

SEQ ID NO: 78563 - DNA, 25534 bp, Oryza sativa
tggcttggaaggggcctaaccattgggagtgatagcacggtttaattgttgggcctcattagcgccaaagatgtcactagagaggtaggaggtggcatgggatacagcaaagtaggatgaaggagaagaccggaagggagatatcttaactgtttgatctatatatcttatacctagaaaatatgatcgttgacctagctaaaacattcgagtattttgtacacagtcccatatatacttcaacacattcaaaaaaaaaagagctatgatgttctatcatgctgtgaaaagtattacttcctctgtcccaaaatataagcatttttagaatagtgtcaagtcaaacatttttaattttgagtattaatagaaaaaaaagatcaataatgtaaattagatgttactagatttatcattaaacaaactatcataatatgcaactccttttatttaaaacatcttacttttatagatattattggtcaaagtagcaccttgaagactgtgttgaagtctaaaaatgcttatattttgggacggaggaagtattatatactcttactctacttagtataagaggccttggttacaacttacaatagctcctatctggctatcttagttcttacggtgattatcttatttggccaacaacttcattcttatagcaaaccaacagagcacataggaaagtcaatgatcctcaccatatagctagtgccaccgataaattgaatgatcaaaaattaggagacaaatttttaaatcttttgttaaaaaccttgcaaacacatccgttgttcataaagatgtacatagagtactttaacctctaaacaattctaataccaccataaacatcacggggagtacaaccggccaaaaccatatatctaaatagatctaagggcaaggctaatatttgttacgcaacatatagcattaaaataggtcctattgtcagttgatcgtagttgttaccttagcacgaaattaagttctcgataaataatatatgtaactcattcataaataaataaaaactatccaaataagccttttattaggtggagagagaatggagcagagggagaagagagattctctgatctttttattcgctagcgaccaatcgcaaacttatgattatttttttttgttatgacttagcttcaatgtcacaatagctatattgttcaccttagagactttaatgttacttttttttacaacattgcgatgtcctaaacatctaaaaaatttattccaacgaaactacgaaaactagctacagatcaatatgagatagacaggaactgacacggagcgcaagtggtgcaacaatctcgacgcaagttgtgaaactgagagaaaaactttttaactcacattataattgattagcctttctccaaaagaaaattaactcgatctatttcaaaaatagaagataatttgtcgttttatacggtgttgttctgtactaattttttttagacaagtcacgcgggggccggggggattccccacctgaattttattgatgttacaaaggcagttctacacaacatttagaggttggagggaagaggagaaaatgttcttccaaatcgcaattacaaagcgatcgttgcgcttaattcgttctagccatatcccacactcttcaacacacttaagcaaaaccaactgaagttagggggctgcatttcgaaagacaacatcatgtctatggttccagagcgtccaaaaatataacatgaagaaaacttgaaaatggagtgccggtaatcccccagagggcttaatgttcgccaggtttttgacgtcctgacccatcatattcacgctgattattgtcctgacccgagggcagtgcaggttgaagtgcctggtattctccgaggcattggcacagatatcacatgtatcaactgaaacaattccctttttgatgagattatgctttgtagggagtcgctcttttgccagaagctaggcgaagaattgcacctttagtggcgctctgttgttccagacgaagctccagtttggacagatttagtgcagcattatcctggagtcatagttttgtttggccaggatgatttcaagatggggagttcctttacttttccttttgttagggcagccttgaagaatgacctgctacaattccactttaagtagagctaaatcatactgggctactaaggacaagcgaggaacaagacaggtggctagtcctctgcaaagaacagtcctgatagtggctagctgatccactgcatgagagaaaagggcagcgaggcgaagcttgagaggttgattgcagagccatgagtcacactagaaggacgtgcggaatccatcccccacctggacgcttgaaaggtcttgaaccgtcgggatgagagattggagggagcgccagaggggtccaaggttcaagtcatccgccaacgatttgtcctcagcttcctactagagccacatagaccacgacgaatttgagctatgcggatggaacaacatcttgattagcagtgtgtcgttttgcaacctgggagcttagaggaaaacatagcaaagactgggatattgttcaggactaagttgataaggactatgtgctcggcatatgagagcaggcttgcctcccatccagctaggtacttgtacactttagcaattgttggattgaggtcctgagctcgcagcttatggggagagacagaggtagtcctagctaggtacgacaaagggaagctttccttcttgcagttgagaatttcattgatctggcacctgtgacccaagcattgcatatgattaaagtgtcgtctgcgtattgtattgtcacacaggggctgtctgggcacatcgggtgtgagattctcattgtgaaggaggagtctttggagaacatcagctacaagaatgaacaggtgtggcgatagaggatctccttggcgaagaccatgcttgcagttaatccagcgtcccgagactccgttgagaaggattactaacttagaggttgaaagaatattctgaatccatgtattccaagtggtgttgaagcccctggcggtgaggatctggaggcggctatcccagctgatggaatcgaatgccttggcaaaatccagcttgaggattagggttgggcattttctgacgaagcaggtttgcatcagttcagtcgcaaatatgaaattcttagtgatacttcttcctttgagaaaacctctctgatcaaaatggattagctcttgcagaatacgatgaagtctgtttgccaacacttttgtaatgattttcatcgagcagttttgtagagagatcggcctgaaaccatctggtgtattctcttttccaggtttcagaatcagaacaatgtatggccgatttatcctttcaagatagacatgttgtagcgagaatctttcaaggagattcatcacttctgtgctgaggagatgccacgttgcttggtaaaaacttggcccgaagccataaggtccaggggcgttgtttctgtccatctgcctgattgcaaagagtgtttcttccttggagaagccgcccatcagactgctcaaggctgaaggctgaactgtgtcgtagagcattccaagctgaaaagacactactacagaaaagcccttaagtgccggttgtgaaacttccaaaggtgccggatttcccaatcgacaccccggaggcggcactgatatggtgaatcaaaggtgccggtttaggaaccggcacctttgaggttccacgattgaaaaaaaaaaggtcggctcgactgcagttgagccgataactgattccatcaagaacacacattccatcaagaacacatatgaacataaaaacacaacatgaacatatgcctcttctgccgtcgccactgcacgtcccctcccgccggatctggcggaggggggggggggaggcgccgaccctcccacccccgccgggccgcagccgtctccacgacgtccttccctccgctagatccggcggcaggggacggatggcgtggaggcggcagaggttgccgggcgacggcggccgggacggtggaagaagcatatgttcaagttgtgttcttatgttcatatgtgttcttgatgtttgttcatgtgtgttcttgatggaatgtttgttcatgtgtgttcttgatggaatgtgtgttcatgtgtgccttttttaaaaaaacgggcacatgtaatatgttatagataccgattttttaataaaccggcacctataatatattataggtgccggattttttttaaaaaaactggcacctatattattattattgatgttggtttttctctaaaatcgatacctatcttcgtttaaaggtatagtgccgacttatacgtttttttttttaagtagtgagaccattgcagggattcagcagatcctaggatgagcgagtaatagttgaacatgacttgtgccttgctgttgtggtcagaaacttcggtgcctgccgccttgatcgatttgatggaggttcgtccgaagttgttgtaggcatgcgctttgaagaaagcagtgctatctaacccgagcttgagctttttaactttcccgcgctgtttctagtaggccagtttgtcgttgatagaagtggctagtttgtgctgtactaaggctatgttcgttgctgtgtgttggaaacatatttctggcgcgagccgaggctgggatttttcgatgaagtcgaacagatcaataacaaacttgtagtcattaattttcccctgactcttttgagcttcagttgtttcatccaagtattattcgttttggatacgtccgccattttgtaacatcagctaggcgaggcgaatcaatttattttgttgaagttgcagcacgaattggagcctgcctgcatgcatgcacttggaggatccaaagtctcgtatggcagtgggcagtggcacatgcacatgtatgatcatatatgcactggcaatacgtgtattcgtatacacggatctcgtacatgcatagccgcatgggataagtagtactcaaatatgtcatcagcgatgactaaacgaaatttataagatgcgtgtaaactgatccgtacgaggcattccagaagagtctacacactgcacttttttactctgccgtgacatgtcattatcttgggctaaaaataaaaaaaataaaatagcgtcaaatagaaggcacacactgctgtgcaagagtgcgtgcacgtggcaaccacgcgctcggggtcaactgtgcaagtattaggaccggactggcattccatatgcatgcacttcgagctggcctccatgttcgtaacagatgagtccaaaaggtaaaccataaagacaacaaagtcaggacagcgaaagaaagtgcaagttgatacatataggctgcaaaatacagcaatattgctgcttctttgtaaagcttaatttgaaaatggagccaatggagtcgatcctagctttgtcgtacactggtacgaaaatactcactctctcttccaaaatataataatataatatcacatgagacattttagcacaaataaaaagcttgttcatattcgtaatattatgatatgtcttatccgatcataggttcttatatttttggattgagatagtatgggctgtttggttcaatgcttcagacatcttagcacaaatagaaagcttgttcatattcgtaatattatgatatgtcttatccgatcataggttcttatatttttggatagagatagtatgggctgtttggttcaatgctttaacttgccacatcacactttaggatgccacacctccttagccttatgtttgattcattgccatagttatggcaagccacactttcttatcatcttaccccacatgtcatagactcaatcatttgtctaactttgctacaagtgtggcttacaatttgtaggccacaaaaaaatgtggcaaagccacacttgtctaacattgcctaaagtgagttatggcaatgttagttaagaaccaaacgacccaaatattttgcatgtggtccgtaattcattacatgggtgtttttcaatcggcctataactaatggcatgtaaaaatcacatgatttttatggacgcattccacaaccacccgtgaaaattgattttcactggcaactctcttaaggaatcacatgtaaaaatgaatatcatgcttttgattttttttaactgtaaaaaagaaccccccaaaaaaaatattttagatttttgtaggcatctatagacgcaaaattttactggctttcccttatgtgaaccgaccataaaaaatattttaagggcgactctttaaaatgtctgcctgtaaaaatcattttagggtgtttcgttaagaagtctgctgacaaaacccttttttctttattctttgataatgactaaactttacttttttagaaaattcattttatgtccgattaaggtgaacagaagttctcaaccttacaacattctgggtcgatgtttccttaaaatacttcttttgatatgattgttcacttatgtcctgtagtctctatatgttgatatattgcataatgaatgggcatactaaaagaaatattaagtagctcatatcaaagaaaataataaataaagataacaatctataaaacttttggtttacctcgattgggccaaatatgaattttctagaaattttcaaactttgaactttctgaacaattccccgtaataatagatatatcaaagcctgtaatgaatattagccacctgaacgatctcatttataatagcttttaataacaaagttgtagatctggccgagctcgataatttcaatatagaacatttctccatccagcgttgtttggaaaactaaaaagtagttacgagaatagtaacaaaaaatttgccacactaaacaacctaaaatgaaacaactttaaactgcaaagttataggtttcatcaagacctacaattttcatattaagtttgtcatcatccgacttcacatgaaaaagttataatttttttcgtattttagtggggcttctagttttaacgtcttgtacagaatgcatggtccacgaaaatagattttataggtggatttctttgggatctgcccaaaaagtatacatatttttaaaggggaatttcagaccaacccgtaaaaatagtttttttaacaggcggttatgaccctaagacaacctcaaccatttccacaagtattttttcttttggatcgtctatgtgaagataaaagcctaatgtccgaaaaaagactttttaagtagcatcactaattaaggtgtagggttaattcttaaaattatttgattttgtcttcatgatcgactaataattctattttgcatataaaagtctaactaattgatataatgcggtatttggttgtttgttcacagctagaaatccccgaatatatggaccgaatcccgtacggggatcagagaagataaccatcaaatgctatgaagccaaattgctttgaaatgtttttgttggcttcttgctaaagaaggtccaacactgtatagtttttgcattgttattatgcatgtgcatgttactatttctgttataggatgttgtaacatcccggcctagggcttaataggattaatagaatactcatatcaacaagttgcaacttcttttccggaagccagtctggcctggagcaatttgggatgggtgaccgaccgggaaattcttcccgggtgcacacgagtgatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcttggcctagggttgatcgacgggggcgtcgatctctcttaagggggtcacatggacgtggccaagagaggacgttcctggcctagggttgatcgacgggggcgtcgatctctcttaagggggtgagggtgtaacatcccggcctagggcttaataggattaatagaatactcatatcaacaagttgcaacttctttttcggaagccagtctccaaagaactccagggttaagcgtgcttggcctggagcaatttgggatgttggtctgtgagggcagtctatgacctatgaaagctatcagatgtaagtgggcccagacatgtgttggtctgtgagggcagtctatgacctatgaaaactatcagatgtaagtgggcccggcctgggggaggcgggacgttacagatgtaaactacatctttgtaaagctttgaaaatggagccaatggtgcactacttccatcacactagggtttcatgtggccataggatgtgttggtaaattttgaaagtttgattgtcattgaatgtgacaacaaggaataaatatatttcacatctaaaaataataataggcacttgagttatagaatagaatcagttgttaaccatcacatacttacagcaccagatcacgctacctataacgtggtttttgatgcatatggcttgctaaagcatgtccaacaatttgaggattatttttttttattattaggcacatgcacatgcatgtcattgatttttcctgtgctatctgcataagacatggtggatgaagaaaagaagagagagaatgtatagacatgataataattttgattcagctggcatctttgagttaaagtaggtagatttaggaagggtaaattctatttttgccctgaactttgttcgaactaaaaagtctatcatttacttttaactacaaaactagttattttttcaatctcaattttcaaaacaagacaaaaataacaccataaaccatatttcaaggtggctttgataagaaatattggtgtgtgtacatgtgttttttttttttgcaaacatgaaattcaaataggtaaattttatggttgtcgacctaattgatatctacacgggtaaaatatgtataataagaatataaactaagaaatccaccttcatttcatccaaagccacaaaaaatgatataaggtgttacaaacggttccattgtttagggtaaaaattaaacctcgaggagttcaggaacaaaaaatggactttacccatttagcaaaaatctgatatacaagatatttatatagtcagacagtcagcctccgtttatcctttatccttgtaatctaagacgactatttagacgatatgcaataacaagaaagcattcccttgagagattaaaatccatttcccggtcgatcgaagtgcttgcactatgggatatataataattcagtaggttttggaacggggcgctgtcaaatgtgattctcaatttgccaatttgcttaagttgtttggtgaaatttccgaacaatggaaacaagaacaattaaggattactgatgggactgctcatttataccatatttttctccttaattgcatgaatcgtacatgattgtaatacacgaccctatccatgactccatgtgcctgtggttgccttgctggaatcaggtagctaaaaacttggtgaaggaggcaaaaaaaaaaagaaactctacagtgaaagtcaaagcctcgtccaattgcatccagcttcgagcaggcacttggacaaaacttataaatagctctgccaagcatgacagagcatattcatcgagagatcgaattcggttctcgtctcgatcatcagtttggcctgtcgatctctgtccatctctgacgacgccgacggccatgcagcagctgctcgcgatgaagctgatcctgacgacgctcgtcgtcgccgtgctggcgctgtccgccggcacggccacggccacctgcgacacgctcacggtcgggcactaccggcagtcgtgccgcgccgccgagaccatcgtgcgcgacaccgtcaagctctacttctcaaaggaccagaccgtcaccgcgccgctgctccgcctccacttccacgactgcttcgtcagggtaaaaattactagcatatactctctccgtaaaaaaaaaactcaacttatttgaattttatctcacaaaaactaacttctaccatcttatttatcctccgtatgtaaaacgagaagttttatttcttcaataccctttacccacccatcactcttactatttttatcaatgattaagagtattttagtcattctctatctctactacttctattattagatttattttgtaacggagggagtatatcaattatcaagaacaagttaagctatcagcttgtaattgacagctgcaaatgtggatggagaacttacccaagtttaaaattattattggcagggatgtgacggatcggtgttgctgaacgcgacggcggcgagcgggccggcggagaaggacgcgatgccgaaccagagcctggacgggttctacgtcatcgacgccgccaaggcggcgctggagaaggagtgccccggcgtcgtctcctgcgccgacatcctggcgctggcggccagagacgctgtctccatggtttgagactcgctccactgatgaattctcctgttactgtagagacgatgagcaatgcaaaagctgatgctgatctgatcatccgattcttgctgtgctctgtcttttcaggctgccgggaacatcaatggcgcgagcctttggcaagtcccgacggggcggctcgacggccgcgtgtcgtcggcggcggaggccgtggccaacctaccgtcttctttcgcggatttcgctaagctcaaggagcagttcggttccaagggcctaaatgtgcaagacctcgcgatcctatcaggtatagtagtgctaaccatggacgattctaaagctacgtgcgatttgctgtactgttcttgctgtatgccgtgtcagagtcaggcacaatcttggtcttcaggtcgggtcaaaatgacagaatgaactgaacctcaataatgacatttctgactttttttctgtatggagttgctttcttgctttcttattaaacatttgcgtgttcagaaatcatagaaatgttgaacatcttttaaccttttttttcaaagcgtcaagtcacattccgattaagatatcattatccctggcaatttctcgaaccgtaagatgacactgacaacaagggagacagtaattaacacagtaaattatattaattcctttacatcactgtttcaggtgctcacgccataggcaattcacactgcgtctccttcgccaagcggctctacaacttcaccggcaagggcgacgccgacccgacgctcgaccgggcgtacgccgcggcggtcctccgcgccgcctgcccgccgcggttcgacaacgcgaccaccgtcgagatggtgccggggagctcgacgacgttcgacaccgactactacaggctggtggcgagccggaggggcctcttccactccgaccaggcgttgctccaggacagggaggcggcggcgacggtgcgcgtcatggcgaggtcgagcaggcaggcgttcttccggcgattcggggtgtccatggtgaggatgggcaatgtcggggtcctgacgggagccgcaggagagatcaggaagaactgtgctctgattaattgatgggcagagatttgatctttgatataagttattactaagtcatgtactaatgatgttctattgtttggtgtctaattaagttattactactactacaaggtaaatttcatgagggaataacttgctcggcattgtttgatttgttttatgttaatcatcgacttgttaatgtactcttgcactgatcttctccatgtatgaaatggcagagccgctgccacccttctccagaaaaaaagatgttggccatgttgacatttcttctttatttttttgtcaacattatgagcttgagaggatgagctatatacttggatgattctatacctttgctgtctgcctgtcagcattcaagcccatgttggatacatgttcagttttcagcccacccaagggacgattttgggcccaatattcacaaggctttgacacatgcagacacaaaagtccacagcatagaaaggggaaaactgcttccgaaaacactttacccgactgacttttactgaccactttaactccccaactaccaaaatatcactttacacttcactccacagactttgggtagtacaatattttatattacctcagtcgtaaaatatagctatttttagtacaatactttatctaaactgaaactatttcttcacttatcttcttctcttaaccaattacaaccattcttttttatctactttctcttctcaaccaatcacatacttcctctaatcatttttatatttttttaacccatattaacctaaaaaaatacttacatttgaagtatatgctagtctcctcggagacgtcttataatcttatctttttactttagggcagtgttcttgtttattttactttatccagcgtcgctagaagaacaaccattgtataggaagtaggaaccagtgcagtttaaggttcccatggtttctaacgaatcatggttttgcagcatccgcctttgcgtttacccacgggcgaagtttcgccaattgttctcatccggatatcagcaagaaccttaagcaaggaacccaagaataaaatacagaaatatactcctagagagctagctagcctcgctcatcactcatcagagtaccaatcccctttatacctgaacctttacaacatacacgttcaccgagccatccatcagccagaagagaatttgatccctatttgagtttccgtttcactttccagcacaagtccaacggccagggctcgatcaactagccaggaatcacgcagtgctctgctctggatatcgaatgttggcatctcgatcgcttttgggcagcaaggcaagaatattacttgccttccacacccttaatcacatgcacggcccccatacagacgcagctataaaacatcacgaacgccatgagaagatgtccattgtccaaagccaagagcagcagcagagggtagctagctcgaacagcacactactgaagctgatcagaaggaagcagcaaggcaagcaggtttagtttaagcagcagctcgccgccggcaataatgccgccgtaccggctgccgatgtaccgggagaggccggcggtgaggtgcatcaacttcctctgcgccgtgctgctcaccatggtgctcgtcgccggcatcatcatgttcgtgctgtggctcagcctccggccgcaccggcccaggttcttcctcgacgacttcaccatccccaacctcaaccggcagtccggcgccgtgaacctgccggtgaggttcaccgtcgacgagcgcaaccccaaccagaagatcggcatccactacggcaccatcttcgggtcggtgtactacaacgacctgctcgtcgcgtcggggccggtggtccagccattctaccagcagcccaagggcgacacgccgctggccggcgagctcacggcgtccgggccgacgcccggcgacccggcgtggcagcggttcgccggcgacgcggcggccggcagcgtcgcgctccggctgctgctcaactcgacggtgaggttccaggtgcagatgtgggacaccagggagcaccacatgaaggtggactgcgagttcggcctgcgtggcgacggcacgctccagcagggggacaagaacaagcagtgtacgctctacttctagggtggatggaccgtatcttaatttttcctcgatttttctttgtgagtggttttatatttttcatcgtttggattttcgagtgatattgattattactttttaccccttgttgacaaatgtaatttgtttgtaactgtacattaattttattaaactgtctgaattattaatgttgtagcgcgagtgtatgtgccaggttctttgtctaattatatggtactataaacgatagactacttgatattgagagaatattttgagggtacaaacggattaatgaactattataaagtaaaaaaaaagctgttttgaagtactactcttaagaaacttgtgtatataaaacttttataaaaatcataccgtttataagtttggaagagcgtgatgatgacaatgaataatatgtaaagaggaaaataagggggaacagagaaacgattgatcgaaaatagctgattgtttttcaaggtttcactgggatcggagaagggtttaatgtccagtgtaacggttgaaggtatgacaactagacaatctaccatttttgctcatagttttctgcaagcagtcaattgtacaaaatagtgatgttttaccccccaactttatggggagatgtacttctttgttctaccgatggctcagtatagttaaggaatcattattaacatggactcaggaaagattattcacaatgtatacccatgagatgatgagaatgatcagggcatcaggcagagggtaagtattaatacatcatttgggaaggtataatatttatgtgttaaccctaaccaatcataaaatcttggctaatacaggctattaaatgttgattctgtcaagctgcaaacaatttacaacaaaactgcagtggtaatttccacatactccagagacccagatacacactaggacattagtaacctggactcaccaatgagcaccagagttgattgatatctgtttagctttcctccagtctccgcaacacagagtcagcaaagatgcgctgcctgaaaattgaaaaccttattagaaattcaactgcttttagtgagagagagagagagagagagagagagagagagagagagagaaagagagaaggaagaatcacgcacttctcttcagtgtgtttgggactagggcggttgtgtttcagatacccgtcccacggaaccttcttaagaccagctctagcagctatcatgtctcttactctgtggaaagcattccattaagtatgaaaaaggcagtatgtttctcataaaaaaaactagaatccaattttatgctacctttcagcaaattcaattgctgtttctccatccctcagatactgaggctccaagtaccatacatcacacacaactgcccatgatgtcataagcctaaccaagtgcattgtaaacgattgcctgacaaaaattacgagaagatattaagtgaaatacagaagaagataaatgtgaacaaagtaaatttgtgcagttgattgtattcctcacttcttactattccagaaggcatcaacaaatattttattgtatttgatagctattgggcatacagcacagccaagctcaaaagcaccctggaaaaacataatgagaatgaagacaaatcatcattagtctgatcgtggtcaattccagcaaatgttaaaacataacaagaatgaagacaactcatcatttgatagctatttagaagatgacaactttctagcatttgctatcttttaaacatgtcaggcatatgattggcaatgagtatgttcgtaccactactagaaatactcaactactcttatctatctgccaaaatatttgtgctatctgcagtacctctttctttttgcattctctgtccatatgtacagctgtgagttaattttaagtgaactcatgcatttttaaatataaggacaattaattctaccctttttaagtttgaaacttgcagtatatttatttacgaccagccacaattcacaagacacacttactttgttagtatattttttacaatctaaaaagatgtcatatttatgctgtacgtactgtaagggctggttttctgcttgaagcttgttaaaaatgaaccaaaatttgaagcctctcttgaaagttagttacacaaggatgcatatttggtcatttattcagtcacttcaaaagaacatatcaagtttacaactttaccttcttgaacatgacagtgtactggttgttaacacaagttccttcagggaaaatcaggagaggattgctgtctggatgttgaacatgatctcgtaacctgttgacagagttctcttaataaactgaactatatatagtaagtaatgcattggaaatgaaaaattatacttttttgcaaccacttcacgatccttgagatcattgcgattaaaccagatgcaaccaacactttccaagatagtcttctgaataaatcctgtacaagggaggaaagcaaattttatcaacaatctagcaatgcaaaaggtagagatcaacaatccatcctgaagaatgagaactgaccaacccatccaggatgcttttgcataatgacagcaaatgctgtcatctgctccagaataatgaaatctatcatcgatgtatggtttgcaacaaatacctgtggtaattagaatttagaagagagttgcaaaggatatccgtcattcattaatggatgaacatgaaattaattaagtaaaacataatgaaggaatgacaatgtgtacctaaagaatggtttctgcaaatgtttgcatttaaattggaattatagaccttgtgaaacatgaggagattttgtgatagaaaggataacttttcctgaattatccaggtgagatttccggggaacaaggctaagttaataactatgatgtttggcaacagtgttgcgcaccacatgttcctataagtgcataaactacttaacatgggttctaagagaaagaaagtttgtaacctgatgaggccgtgtgcttgggcgaggcccatgatacttgatcactccagtccaagaagcaacaaaaacactgcacatcatttcaaccagctttctctgcaaaaaagattacagtgtttttgaataaacaaagaacctaagttgcaaaatattatgacatattatggctgcatatgaacatacacacatctacaaccagaaattgacatagatgggagataagataagtcacctctattttacttctcatcttttgacctttcaataagaaatgtacaggaaaaaaggcagcaaagaatgctaaccatccaactagaagagttaggcccctgaaacataacatggttacagttatcagatgagagtgactcaatattcgacaaaagaaaagaatataagctagatccagagacagaaaataacttttagtagtaatacatacacaaagataccgaaaaaaaaattctctccaacatttcacacaaaattcaaatgagtttcctgaacaaagttggtcttgaaatattctgatttctgacgttatgtggaaagtgattgtaactgaccaaaaaaactcatagcacatggttaaaaacatctacttcattgccagtttggacaaaggttttacagatcaaatgggctaggatacccttgtactacaaaatatcaagtcaacaaagaaggatacattgcaaacacttacaaaacaagtaaactaattagcaaaactgccgccctaaatatagtgttcagattataaggatccagtacctcagcgggaatagtattccgtatcttatcactactcccaagcaccacaatgggaataaataaatgttccaattccatggctctggagaatttgacttaaagcaacgtgtgaatgaatcctgtatcagtgtaaacacaagcaatgagaaagctagacaacatcgatcacaacaagaagaattgccataagaacgactgctatttatcccacaccgcatcacaactgaagttacgtatgcacagtagtaaaatgatatgaaacaaagatgcatgagatgtcaagtcattatcttggcatactctcactaacaggctatggaagtacccatatacttgtctaatacgaacaacattataaagaaaatgttatcatgttcctgttttaaaccttaactaagggagatttactgctcctttaacttgaagttttgaaaatagtgtcaaagacagacatccttttcttgttccaccgatatatacccagggcttagatgacaactttgtaaagaacatcgaacttagggttaattaacattacaacattaattatattttgattcttatacaaaattgattactgaccacaagcaaaatactcttttcctcagtaataaacgagagtgttcaaagcgcgaaacaatccagaaattgtcctcaagggaggccataaaataggaaatttaaggtaaatctaactatatgcaatattgacgaaattgtacatattttcggagattttgacgcaagaacagagtatgagagtaatcatatgaaaaccgtacaaattcaaaaatttgagcgaagcaagcctagccttgtttccacaaaaggattgctctactcctttcgctaaacctcacagatcaaagcctataaacgtcctatctgctcttgccatctcatagaacatcaccatctaataacctgagaacgcacgaaacggggggggggggggggggcgattttaagacccgggtaagccactcacatcgacgatggcgcccgccgcttcagtgagcaccggcgagatgtccagcagatcgcgcctgcacgatggcagaagagagtaaagaatcgcctaaaaaatatctcgccaaaatcccccacataatcccaagctagggttaacgagcgaagaaaacaaagacggggaacagagagggggctagggcgcgattacagatggagattcctggggaactcctgcggcagcgagtcggatgggaggtagtcctccaggttcggccggtccagctcgatgtcccccgccaccgacgaggtcgccatccccccctccgtcgatcccctccgccgccgccgaggaaatcttcgcgatgaggagcgagagcgagagagatgggcgcaatgtggcgtacgtccagcgaatcgatgcgtgggtggatcggtggaccaacagacagcgaaggggaagagagaggctcgtcaccgggtgggccccgcacaccgacaggtgggcccactgcagcgcctacatgggccggctcgggtgaattagttggccaaaactgtcggcccatgtaaggtccataaaaccgaggtttacccttgcgcgtcgccgccactcgcaagcaagcagccgccgccatggcgccgccgggcaactccgacgagctcgcgagctccaagaaggtgaagaaatctaactccaaggaggagaggaagcacaagaagggcaagcatgagcgccccgccgcctccgacgaagcgccgactccccgcagcgacgcgaaggggagcaagggcaagaagcggaagcacaaggacggggagggggagaaggagcacgggaagaggtccaaggagaggaagggggagggcgaggcggcggaggcgaggcgcggggacgacaaggtgaggcgggcgatggaggacgagaggttcgcggcggcgcggaccgacccgaggttccgggcgatgcggcggaaggaggcgaaggtggagctcgactcgaggttcaccagcatgctgacggacccgaggttctcgtcgtcgtcggcgccggtggacaagcacggcaggaggcgccgcaagaagggtggcagggagaacccgatgctgcagtactatctcaaccaggaggaagaggaggaaaaggagaaggccaagttggttgaagaagaggaagaagagggggacgcagaagagcagcaaggggaagaagagagctccagtagcgacgacgacgacgacgatgaggacgaagaagaggacgatgacgacgaggtggtactttgcttacaattttttgatggtttggtttatatttcgttcaattctctcgcttgtagcatggaagtactttatttactttatacgtctcgtccattctacatattatatggtagatgatagtgattagctcctccaagaactcaattgcatatatcttgtttggagcatgatttgtaggggactacttttgagtctgagtttagttttaagagcattaagtacttcttgtttttctatcaatatatggtcttggtcatttgtaaccacggtatgttcaatctgatgttacaagtgttatgaactgttaaacttttttttttgggccgaatgtgtaggttatagagctatgtggttgtaccaagatatgcgtctttgtagctacgcatttttaatagtcgactaaccaaaaaaaacaaagggcatgtgtttgtgttgtggtatttgacacaatcccttcgaattgcttgggactcaagtgcactttgtttgtccaaatgtccaattgaagggattggacataaacccacatgtcaaagaccctactttactcatgtactcagctgacaatgacatgccactgttagtatttttatccaccatcctgccgcttaaatctattttttgagttagccttgtaatttttgtattttgtaagcattgattaatgattgcaatatttatgtagttttcgcccttcaagaaaaaaaaacaatgttttgcaacattattcttgcattatatctaatacatggtccttttttttcacagtactctgtcggcagtgacattgcgcattatttgatgggcaggcatgatgatacacctatgattgacaaggaaacccataggcttgctgttgttaatatggactgggatcatattaaggtgtgtgatgattgaaaataattatttttttgtcaagcaaacctattagcataaacaatttacagaaatattaaaaaaggctttgttactggatgcttaagaattaccttgaaaccaataattttactgaaaaaacttgtttattatgtgattacatttttttaatgcttttgcttttatgagcgcattggtagcttctatcgaacacttttgtgccattggggtgatgtttggaaaaaaattgtctgctaggtggcagcagcatttacagagtatgttttatggctgaaagatgtttatgtttatttcttatgttctgtttaaatcaggtgaaatttctatgtgtactactctcttttcttttagttgaggacctaatagtccaccatataaattcacttattttatcaaacatagttattgaggatgctagttcttgtaaacaaatgtagttgcatctaagttcttgtaaaaaaatgttgttgacagagcagtgcacactgaggcacttggcgaacacatatccaaactctaaaaatgcttggactttggaaagtttagagggcaaatccaacttagcaaaatcctggttgttaaaatgaagatctgagttgttacattgttattttgtctccttgcaactttcaattgattagttttgttcatccttcattgtacaataatactatattttgtttgcgtccttccaataggcagttgacctgtatatggtgatgacatcttgcctcccaaaaggtgggcgagtcttatcagtgtcagtctatccatcagaatttggacttgagcgcatgaaaattgagtcaactaagggcccagctgcccttgttgatgtcaatggtagtgatggtgaatatagtggtggtgatgatgatgacgacgatgaagaagaagaagatagtagtgacactgaacatgattctgaggctgaaaacaacaagctacgtacttatgagctaaacagactgaggttagtaacaaaatggagaaggatttttttttatctgtttttctgggacttgtagacagtctttaacatgttcaaatcctatgtgtaaatatatgtttttctgcttgatgtatttatcactgtctgtgtatgaggagacattctcatctattcaattttttatacaacaatgtaataccaatcttatgcgtacgcttatcttgttgtaggtattactatgcagttgtggtgtgtgattccagtgcaactgcaaatcacctgtacatgaatcttgatggtacagaattattgaaaacatcaaatgtgttcgacttgcagtttattcctgactctatggaatttaaacatcctgctcgtgatgttgctacagaggtatcttactttactacattgtatcatcagcaattttggtatataataaggttgaaacatgaaacattgaaataaaactgatccttttccttcttcaaaagtgacttgccatgttatttttccattgttcaagttaacatcttttaagtttagtataacttgcttttcaattgtgctaaaagaattacttttagtttgtcagtgatttgtttgatattatgcaggcacctccaagttacaaggagcctaattttgaaactcgtgctttgcaacatagcaaggttaagctcacgtgggacgatgatgaaccagaacgcaaaaaggtcttgaggcgaaagttcactgatgatcaggttcattcttatataaattattttgtttgtgttacgagtttatagttttttggtaggtccaataacatgataaacaattatggagtaacatgtcatgagctgggccgctggcactaaagtcaataatattttgcaattcatctccctttttatgtgaaagttctttccctgtgaacggctatgagttatactggtttgtctcgatgtttgcctatcgtgtagggatgatattttccttattcgtttttattaggcacaaattgatttggcacaatcttttaaattgaaatgtgaccatacatttctttctcaatatattgttgctatatagaaaaatcatgtccatatgtaagtacattgaaatacaaatctagcaggtaccgcctttgtatcactaaatagttatttgaatgtcctaattgttggtcaaaactaacgaagtttgaatcttaaaatttctgtgccttatgagttgaatggatatagtacctttgttgttgtgtccttgtccttttatttttgttttggtctacagttttggtaactttgttcatgtttttgctgcagttagatgatcttgatatgtacttagcaagtgatgacagtgcatcagacgatgaaggtgcagataatcatggtgacgagtctctacaaagtggagccaaaagaaagttaacaagggaggagaggttggctcttctactacaaggtgacaaatccgaggaggaacaaactgatggcgaggacatggagataacattcaacacagagcttgaggaccttagcaagcgtatacttgacagaaaggtcaacaatgagaagactgtctgggagaagcaccaagagaaaatgaaagagaaacgtaaatctaggaagagaaggtcaaaggatgatgatgatgatggctatagcagcgaagatggcctggatgaacatgacgatttctttgatgatgaaatgtctgatgaagaaattaagccaaacaagaagcagaaggcaaaggccaaagataaaggaaaggggaaaggaaaggacaaactcccagaacaacatttggaggatgaagcaaccagagaagagttggagcttttggttgcggctgacaaggatgcaggcaacggtgcaaagggttataacttgaagcgcaaaaagggtacgaagggcaagaagggtaaagagcaatctgttgaggacgaacttcccgacatagatcttagcaaagatgagaggttctcagccatgttcaattctcattggtttgcggtggatcctactgatccccagtacaaaaggtatactatgcgcattcgcccatcagactacttcagaattcatactactagtgtagcctacatgatctgcaattctgcatcttcttggttcagttttacacatgttaaattgctaactgttgctgatggttacttacaggagtgcggcctttatgcgcaagcaagctgggataaagggagcacatgaaccatctctgggaggtagaggtagtggtagaggtacattgccacctgatgatgtgcctaccgatactcatgaccagaaacctgatggcacatccacggagaagctggaaacaatgtctgcagtcaagtcactaaaacggaagcttactgcattaaaaaacacaagcaagagtgaccgatagagaaaagctttgctttaccctgatgaccaatgaacaagcttttttttttatttgtctatgacgagagttattttggctttagaatagtttttaggtatgttatttatgtttgctacctacctatgaaaatgtgtcaaaatttgggttttgacaatgatcaagtaggacaattttgttatccttaatattttcgaatatagttctattattttcaggctataaaattaaattatgatggtggctttgtaccaacattagtggaatattagaagccaccttctgtttttttggccttctaaatataattttagaaataaaccctccaagaactaatgtcaaacctgaaatttttggtcatgtagaatgataacgctgccacatgggtaaacctgttgtatgccaggctgcaagccatgaactgtggagctatagtaattggcatgtgcatgtttattttttataagagtttttagatagtagtttatttttaaaattcaaacaaaaatgttcaagaaattaagaaaatccatcagacaagaaccgttacagcacgcgagcaggaatcctctcgcttagctccgacgaaactgaaaacgagcagagaagtttttgtgctgcgtgaagctgcagcattttctgttttttttctcttttttttactattctccaaagctggagattttacatacaaagcatgccgaattaaacacaagattcaccaaactcgtgccatcccaccacgtttggagtgatcagctcggcatgccgaattaacacacgcaggaacagaaatgcaggatgcaactaaaacaatcttaaaaacaaaaatgcacacaagattacaatgttgccatcaacactgaatacactgaatacataaaagtaggaagaacatgaaggccttatttcatcatcttttcatctttattcatagtagaagaaactgtaatagaaataccatcttttcatctttattcatagtagaagcaactgtaccatcttttcatctttattcatagtagaagcaactgtaccatcttttcatctttattcatagtagaagcaactgtaatagaaatacctcccaagttcctttcatctttattcatagtagaagcactgtaatagaaatacctcccaagcaggaggagcagcatcaacaatccttatccttgacgatcgaaggtaatttgagcgtgaaagtaataccaccattgttgtgttcactgactttgattctcaggtagtttgagcgtgaaagtaataccattgctgtgttcactgacttttcttttcagtttttccagattctgcgggttgcacgttccccccttgagttcgaggtgtgtgagactctgcagcttacggacccctgaaagcttctccatgtgagtgaaggaccaaactatctttt

SEQ ID NO: 78564 - DNA, 8543 bp, Oryza sativa
ctttcaacttttccatcatcacatcgttccaatttcaatcaaacttcaattttggtgtaaactaaacacaccctccatgttcgtttttttttaaacaagggagtacttaccaaaaaaaaacattgtagaatctatgaatatgatctaagggaaaggggatgggcaaaacagatattacccttcagtgttgctaatgatgataaagaccatgttaacctaaccagtcaaataaaaaattctgtgttccaaagtacccaaaataaaaactgggagctagtactagctggcttgaatggcgaatggcatggacagcaacatgtgaccgaacagcacagcgagacatgctaatctgatcctgcttcaccaacagcttcgctccacgctcgcacgcatcaaccgaaaaacgttagcatctcctaatcagatttacgagtaccatttttcttctgaaaggtcctaatcagatttgtgcacaagtgtcatggaatactacttggcgagcactcgaggcattctgattggcatcctttgcattctgttcgaggtgatctttcaaagaacgccgtgcaagtgcaagcaatcccgtgatagcgagaaatctgtcaaaaaaaagtgctgtcaaaagcaagcaagcggcgagctgtgtgttaggattttgctgcaaagtcaatggtgcagtgaaccttctgaattctgaacatctggctcggttcatacttcataggactttttatgatttaagttcagactttagaaagtaactctgcaaccaccggacataaagattatactactaccgtgtagtgtgtagtaccgctacattgtactcgtcattgtgtagtataatactagtacactatggtgttgtgaatggagaataggaaagtaattaatggtgtcaaatgataaatggtggtgataatagtatgatttctacagatagagtgattctgctgagtccaatatgctgcaagccagaccctgtttagatgggactaaaacttttaagtccctatcacatcggatgtttggatattaattataaatattaaacgtaggctattaataaaacccatacataatcttggactaattcgcgagacgaatctattgagcctaattaatccatgattagcctatgtgatgctacagtaaacattctttaattatggattaattaggcttaacaaatttgtctcgcgaattagctttcatttatataattagttttgtaagtagtctatatttaatactctaaattagtgtctaaatatagggactaaagttaagtccctagatccaaacagtgacttagcctgcaaaatagcagaacatggcttcaaataactatactccttgattgacagatgctgttctggttgtcgttaatgttggatcggtacgaacagattaggtttccatggcacgtacggagcaaggattaggtttggtggaccgtgaggtaggtgacaccgtgtccgtgtagtgctttgttatgctctggatcttatggtttcatcgctttcagtttcgtttgctctctcactcaacaccagttagtggttgctgacgtcttttctgttgctactattattttaggatcattctgaacttctgaattctgatccttcgtttgtgtcttttccctttagtggtgatcggttgctgtttaatggagacatggcaactaacttcattcgagcaatgtgatgtcatgcatacattaaggttcactaattcataaaagaggatggaaaaaaatagagaacttttacggtacaatttactagcattgaaaaacataagcgttgagctgttcacagcattacaggcattacagttagatgttcagtaggttactgcaagtgcagcatgatgtcgatgttcttgcgacgagtcagtctgacagatgatgcaatggcttaaacataacttaacatgagattaggagttcatgctccatgcatcatctggatcaggaaactggaatggatcatgtgaccaagtaaagagggccaaatgcctctctgcttattgcatgggtcaccttgtcaagctgcatgtgaggcagatagtcatagtcctcatcagcatctgacgatggcgagaagcaggctgcagctgttcgtctgataatccgagccaatttgaagtattctctgactactatctccctagagaggagcggtctgcggaatgcatttctgcatggggaggattcagatgccaaggaggcaattattctgttctgaaactttgtcaagaacgtcgagttcttcttcttcgattctcgatttgcagcttggaggcctgaattgcagaggtattgatcctttgttgcttcatccgtgaactaagatgcagtattgacaatgaagttaaagagggttgcttgcttcctaaatgatacaaattccagaaagaagttcagaacttacattgtcaggcagaccttgagaagacagtaacatattctcaggactacttgaagttgtcttatttgaaacttgagtgcattcttcttcctgtgttatcgttgcttctatgaactgaaacgacgagagattaaaagcttcatcactacagtttcctactttattgcatgaacagtactaaacagtactgtgcgtgctccagctactcccattgtctcagcgaagaagaacgcaatgcaaaaagagagagattcttgcaatatgatccaaccgaatgaaccgagatcaccttgcaatgttcgggatgatgatcgcaactagctctacgacatccagagctcttgctcatcctcatgaccagcttatataacgtgcagctctacaaatccagcttcatgcagaaatgagcaagataaaaccaagacactttctcatgatccatgcaagaaatccaaagtataacgccacttaattaaagaacaaagagagagacagacagccatgaatgaatgaagcaacacaaggtatttggctgcattaccctcgaagtaatggcaggcgagacgctgcaagaagagaggatgagaaatggatcaactcatcaaggccattccggagcaaataggagacgaagcattcaatggggttgattacgatggtatctgctgatgagaagagatccttctcgcatttaaggttggcaatggcagtagctggtatgaacagatcaacaagagacagtgtgtgtacgagagtgtcagcagcatatggtccatgattttgccttgcttctgaagcttttgctactcatcatccgtggcgtgtaacaacgcctgtgtgtatgattatgtcagcgcacgagtgttcagaaaaaaaaaagataactacttcttgtgtgcttgctggtttaattaggtgatctgatcgattgtaaaattctcattccaaagcttcttggctccaagctcctccagtactctgaactttgaagcttcttattcctgtgatttgcagtggctttgtgaatcatgaatgcaaaccaatcatgtggctgctcctcctgcctgcatgcgtactgtctgtaattaagtaagaaagaagcagcatcgatcgatctcagtatctcactgtctgtaatttatcaccctactagcatttataattggtgagaagaactagtaaagaattggagaggaatgtattcatgtgttggaatccagagttttacatgattaattcaactggggagggagggagggagggacagacaatacaagcacatgtgtgggagtcagcagttttcacggtttcagtggtccttgtgatggatgatgaatctgcagccaggcacgcgctgctgtaccgggagggaggagcatggcttcccatgacgagaccttgggaccatgccaagccctagctatcttgcaacattattagtatattatacttcatgggatcaaaaaaataaaatgctagtggtaactactacctaatgtttcatactttcagtttcatagggttcagtatttcaacctttttttcaagacttcagtcttcagcttatgctagcaatgaactactactattataagtgttttttttagaagctattataagtgttttgagaggatgggaaaggagagaaatacgtaaaacaagaggcttgttcactttgctataattttcaaccttaccaagttttggaaaagttaccaaaaaagtggctacatttagttgttgccaaattttagtaactacatatgaaatcttgtcaaaatttagtaaccttgccaaaattttgacaaccttaccaaaaatttgacaatgccaaaaattgataaggttaaaaattgtagcaaagtgaacaggctcgagataaaccattagcacataattaattaagtaataattattttaaactttttaaaaataaattaaaaataaatattaaaaaacacatcattttagcagttgaacgtaagcgcagaaaacgactaatcgagggacttttcctctttatcctctcctaccgaacgggcctatttcaactagatccggcctggtccaggaggcgatgtcgcactcgcaggtgtgcagctctctagtgggcttgcagattaggcccattagtgttgattgggcctcgaagtgctttgtcgtggacatcatccgccgccgtcttcttcctcgaccatgccgttgccggaaccggctagcgcggccggccggcggcggcggggaggccgcagtgggacgacgggtgaaggatcctccagctgcggaaggaggtggtcctcgaggccgaaggggagaggctacggagatggagggaagccgaagagaagggaggctgctgctgctgctgcatttgggagacgagaactcgactcgagccatggcggcagattggtgtttcacggcggaatgctaactagatccagcatctccatagcaaaggtagaatggtagattgaggtgagttttttttcccctcttctgcagttttgatgtattattactgccctcatctgatctgggtaacatatttctgagctcagtagaactgttaaaaaaaggcagaaatgcacaaactcttctcacaaaacaacatacaaatgcttatattttggagcggaggcaatacatggtatattttttaaagtgaaaaaaacaatcagacacatggtattgagtgatagcaaagctgggtgaccacagaaaatacctcctgctttaaatactttatacctgggctgtcaatcctcggagttcctcccaatgtaatgtctgaggaagaagtattgcagctaaattttaagggtttcttgtacgaaacagggacaatcagagattaagaaactctatgtggaaaaggccatgcgcattttgttatgtgattcaacaaataagatgaggaggcaaagtcatggttctgttctaattaacaaatctactatgggggccgttgctccctattgtccacgctccttttcttcatttctctcctgcaggatatcttgtcttttgattcttcattttaggtcttataaatatcacgtggttcaggcctccaatgtcaaattatcattacgtggaactctcttagatgcttgagaaaagttagctcttacctgtccatagaagctccaaggaagcgagaatagtagatactttggttggccatggccactggtgtttctgttgagaacataaaccccaaggttatactagggccatcatcgatcgctgagtgcatagtcagtaagttgtgttcttttgtggcttgctgattcatattctttatttcaggttttacgatgtgaatatgcagttcgtggagaggttgccatccatgctcaggtttcgtggtttagtccatccatgttctggaagtcaatttcaatttattctttttcagcaaatgctagaagagaaattaatagatatctcacatttttcttccagcacctacaacagcagctacagacacaacctggttctcttccatttgatgaggtcattgacaactataatttgcagatcacgtgaataatcggtagatgattcataaattttcaactattatatgcagatcgtgtattgcaacatcgggaaccctcagtccttgggtcaaaaaccaatcacattcttcagggaggtctgtaaatattagacacccaaaacttcatctttcctttttatgctctttcagtatttacgagttatgttacaggttcttgcactttgcaatcatccaaatctgctggagagagaggaaattaaatcattgttcaggtaaacatcaactgcatgccatgattcattaccaagctatgactatacatatatatttatgttctacactttctacatttctaataaaaaggtatgtaagcacattagggtatttcatttatgtatgatataaatgtttcttcatctctttgcagcactgatgctattgctcgggcaaagaaaattctttccatgattcctggaagagccaccggggcatatagtcatagccaggtaaccatctgccaattcactcaactaggagcatcttgagttcataattttccttatagtaagtttcactataactatgttgtcaaaactatcgatttctgcaaatttaactacgcaataagaatgcaagaatagctgatgatcttatcagaaaattgcaaccttatttgattggtctggatccatctgtcacacacacatgcaatactcatgtcgttgcaagtttgggcctacacatcagaaaccaataggagataaggctgcaggtttctgataaaatcctctgctattgttgcagttgtgtgaaatattcaacaaaagatgcagatttaaatcaaacactgcagtttttgtggaatttactcttctttatcctagggtatcaagggactgcgtgatgagattgctgctgggattgcctcccgtgatggtttccctgcaaatgcagatgatatattcctaactaatggagcaagtcctggtgtatgtcctaccttggttatttctgaagaaacaggaatgtaagatattccagtctgacttatgctttccctcttctaggtacacatgatgatgcagttgctgataaggaacaacagagatggcattatgtgtccaattcctcaatactcattgtactcagcatccctagcacttcatggcggagctcttgtatgtagtttatttgtctgacgttataacttcaagctagctactcgatgcagcgcaatagcctgaagacatttcatttcaggtgccatattatcttgatgaatcctcaggatggggtttggaggtttctaagcttaagaatcaacttgaagatgccaggtcaaaaggcataactgttagggcgttggtggtgatcaatcctggaaatcctactggacaggtttgctctcaccgcttctcctatcgtgtgcgatttaaaacatcttatatacaattatacaagtatctattatataattaaaggaatagaaaaaggagcctccacgttcgctctcatggcctagaaattctcacattaaacggagaaaaagaaaaaacaaagtccatatagaaatacaatttagaaatagctgaaattcggaattaaaaaataaggaatattaaaagaggagactagagtccatatagaaatacactttagaaatagttgaaattcggaattaaaaaataaggaatattagaagaggagtatagagcccatataaaaatacaattaggaaataatagaaattcagaattaaaaataaggaatattagaagtagagtatagagtccatatagaaatacaattaggaaataatagaaattctgaattaaaaataaggaatattagaagtagagtatagagtccatatagaaatacaattaagaaaaaaatagaaattcagaattaaaaaataagaaatattagaagtagagtatagagtccatataggaatttaaaactaactaaaattcggaaaaaaaaaggagcctccacgttcgctctaatgacctagaaattctcacattaatcggagaaaaagaaaaagcagagtccgtatagaaatacaatttagaaatagctgaaattcggaattaaaaaataaggatattaaaagaggagactagagtccatatagaaatacaatttagaaatagctgaaattcgaaattaagaaataaggaatattagaagaggagactagagtccatatagaaatacaatttagaaatagttgaaattcggaattaaaaaataaggaatattagaagagaagactagagtccatatagaaataaaattaggaaataactgaaattcggaattaaaaataaggaatattaaaagtagagtatagagtccatatagaaatacaattaggaaataaccgaaattcggaattaaaaataagaaatattagaagtagagtatagagtccatatagaaatacaattaagaaaaaaaatagcaatatggaattaaaaaataaggaatattagaagtagagtatagagttcatattggaatttaaaaccaagtaaaattcggaataaaaaggagccttcatgttcgctctcatg

SEQ ID NO: 78565 - DNA, 528 bp, Oryza sativa
  unsure (1)..(528): unsure at all n locations
acaccctgagacttagtcggttacgactgtattttacctctatcttcatattccgttaggaatatagattatcttttgtaatccggactccttcccatatataaggggggtccgggcgcctctaggggcatatgctgatttttcccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactccgttttaaaatgtttgacaccgttgactttttagcacatggtggacagttngggttatgcaaaaacttttgggaaatatgttaaatgatatgcctacataaaaatatatttaactatgaatcaaatgatagaaaaagaattaataattacttaaattttttgaataagacgaacggtcaaacatgtgctaaaaagtcaacggcgtcaaa

SEQ ID NO: 78566 - DNA, 538 bp, Oryza sativa
gcagcccaactcctacccaatcttgtgcaaagtctagatttggtcctaggggaccacaacccactcaaaaccgtggctttctttgcctcatcctccccttcacgcgcaccgcccgagcatccgacttagccacgcgccgtgtcgccgcgcgtcggcctcagggccgcttgcgcgtgcctgaccgccttggcgcaccgtcgcccgtccgacgccctcagcccaccgccgccgcaccaatcttgacgacgacaaagccgggacgacgaccgccgcaagaaatcgccgctcgacgccgtgcgcgcccgtccaaagctgccgccgagtacgatttcgcttctacccagggtgaatcgcgccaattcttgccgcacggttagattgaagatagacggtggtatctcctctcacaattcaaaccattcacccctgagccagccgttttcaccctcgccgccgccgcgcgtcgcgcccggattagcgccctcacgtcgccagctgattccaaccgcggtcaagtcaatacttcatcggtaagtat

SEQ ID NO: 78567 - DNA, 1919 bp, Oryza sativa
ttcacaataatttagggattaattcggcctttttcaaaaaaaaaaatgtaaatgcgagcacctacgtcaagttattgaaccaggtgcaggtacattttattgtattttgaggtgcgcacatacattttattttacttcgcttgaatttattttgaggtgcacatacattttattttaacctttttaatacaaattttatttgacaatgaacgatcaacagatagcttattttgaacataacctttagtaagccacaccgcatgataagatgacgcatcaactcacactggtgaaagaagaatgccatttttggcttttcagagtgtttgcgttgtactatgtaattctcaaaaaagaaaaagtgaaataagttgtaattctgaacatgaaatcctttacaacaaacctaggtaagctagcaatattggtgtaacaacggtaacatttgttatgaaaaaaaactggatatatctatctgatattgtcaaaacttatactttaaatgaaaactatataccctgtccgttttctaagttgatgacaccgttgactttttatatgatgtttgactattctcatatttaaaaaatttatataaatatcagttattttgttgtgatatatatgttttaacattaaaggaaatttaggtgtgatactttaagcatatttacacaatttttctaataagatgaatggctaaatattattttaaaagtataatagcatcatctattaaaaacaaaggtattagattgccgtgttttaactgtatacattgtatatgttgtcatacatttcttttctgaccatagaaaagtattgcttcctccatcccaaaatataataacttatagcgtttaaaagttgtaataaaatataaaaacttatatatacctttctcaaccaatcacaactttctacctttcgaattaattttcaccaatttccttttcccaactattcacaacattctcttatttaattctacatactttcttataggcatatttaaacctaaaactcttcgcatttaggaaagaggtggtattaagcagctaatgatatatatatgtgtaaacaagtgtgagaagagccaccagtttcagaagacaccagccgactacagcagccacagtgaatcgaaccagaagaaattaactagcgcttctgatgcatgcacagtggtgtcgtcgatcgatcgatctgcccagcctcctctataaataacagtacgtagcaacaacacatctacacccctccagctgctacctcgatcatcatttgtgcactatagctagagaaacatattgtaaccagctaggccagcccaatcaatggcgtccgccgcggctaagattgccgtcgtctgtctggtggttttgtccgtggggcagtccatgatgatgacggcggcggcaactactgccgccaccggcgccacgacgtgcaactgcgacacaagcggttgctacaattgcatgctggatgtcgtcaccaactcgtgcaaaggcagagatttcaactggatggtgttcaccgcctgcttgatcaaatactccaaggaaaaccagtgcttcagcaagtaatagacttatcggagctagccgacatacgccgatctatcgtttgacgcgtacgacatatatctatttctattatctattatctatttctattatctattatctattatctatctattctattatctatctatctatctatctatctatctatctattctattatttatatctattatctatttctattatctattatctattatctattatctatcgattttgctatatatttatcgacaaatttttccccaaaaatttgacggatgtaattacagtacaatcgtagtgtaattacactgtaacttgcatgtaattacactgtaactatag

SEQ ID NO: 78568 - DNA, 12985 bp, Oryza sativa
taataatataatgagaaaacatatatgtttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaagattcttgatgagcaacagcaatatgagctagtaaagttctgcaaggacgaggaacttgttcttctggcggatgaggtaaggctagtcatgttcaaaggtgtcagtgtgttgagtgatataataatgttaacaaagtatgatgttaacaaacacaagagaaaactgtccagataatcgttttttggggggtgttgataggtataccaagagaacatttatgttaccaacaagaagatcaactctttcaagaagatagcaagatccatgggatacaatggagacgatttacaattagtatcattgcattctgtttctaaaggtgaaatcccatcatccgcctttctttctccaagtacattgtaactccttaccacatagatatttttttgcctgccatcaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggtgcaataacatatctgtccttacacgaaatgtaattgccaatatacactagattcataacacagagagaccatgcatattgtgcaggctggggacgcatcttatgacctctacgaggaagagaaagacaacatcctaaaatctttatctcgtcgtgcaaaggtgtgtggagtttacttttaacagattcacttcttgctatctatgcagacacttgagctaagacatcattttgtctggaatctggatcacaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaagtgagctactttctactcttgatctttgaaccatagtgatatgtgctgtctgaatcccacagaatgataagtgaactgttttggggaacggctgaagctcacgcagcacaatctatattcctgaagagtctggtagtagtagtagtctcgttctacaagaacagatagcaccaattaaaaaaaaaacaataacagatagcaaccgttttttctaccatttcagatcatcagatgttatctgttcacctgcaattctgaattcctgaccactcaagtttggtcctttgtgaaaggttgcagggacatggcacgtgagatgcacgatcctgccgcaggaggagaagataccttcgatgatctcccgcttcagggaattccatgaggagttcatgtcacagtatcgcgactgatggactgaactcataaggcttcgccatccagaagacgagaaataaagcaaaacgccgttaatctgcgatgtgttaacggaagatgtgcagcaaccttaatctggaaaacttgagcatactcagtttgggtcgtaaagaattcacgggctgttgcatcagtgtttgcccggtacaaggtttgattggattagcacgatgaatgagtgcagggagacctgcagctaaataaatactccctccgtcctataatataaagtattttgaatttttgattgcaacgtttgaccgctcgtcttattaaaaaaatttaaaattattatttattttattagtgacttactttattatctacattacttcaagcataacttttcgttttttatatttacaaaaaaaaaattgaataagacgagtgatcaaacgttgcaagcaaaaactcaaaatcccttatattgtgggacggagtgtgggacggagtgagtgttaatgttagtagttgtgagttagtgactcgtacctaaaagtaatgctacgaaataaaaatgtgttgagagagtatcttacattcagtaaaggttttccaatcgagttggctatcttgaaacggaacgagaacagcagctattgttttgagctctgaaatctgaagcaggcgacacggagcagcagtctatagcgaatctcttcttgaagcgaaactcaaactcctcgcgatcccgttcattggggcgtggtcgcgtagattcatcattcatgggcctcgcactcccgcggctaagagcaagaacaatagtaggctttatgccagctataacaagaagaaaagagaagagagaaaaaagcgggctataaatttgtatccagctgaaacatggacttcaagacactttgtgtgtttgagaggtgagaccgagtattaattgtgtagtatatttttatagataactatttaatgaatgagctattagattagttatagataatttgaagctaacatttggctatactattaaacttgctctaatcgggccatgtgggctgcaccccaaccatccgggctctcggctctccagcagcatacgacctctcgggactcgggagccctacggatttttcttaattttaatttttatctattaaaacattttctaaaacattcttaaagtataacagatctacacctttaacgtcctctatttttacgacgtggtatatgttctaaaaaaaattaaatcctagctactaacctaaacatatatgtgtctaaattctcatattaggattggattgagttttttatgaaacagaggtgtagctgttaatgcatgttaactgttgttgagaggggagggttgcaccgtagtgcttgtaaaatagccagccttactttacgtagtcgttagcattaaccaatgactatatgtatgtcacgttatataaagaaaaaacgctaacacttttccacgaggccacgttgttgccgccttgtctgctactacctcgacattttggtaccgagaaagtaccaataccgcacttccaccacctgtagccatatggacacgatgcagtggctggcatgttggtagtggcaacgcagggatatgtgggtattggttggcacatgacaaacggcgtcgcccaaacacgtgctgcacgcacgggtacgtcgtaaacgtatgtgcggccacacaccagccgtcgtgctcacgcgtcccagttttaatttgtactttttcctccgtctctttttaggtggagtcataattttcgtgtttaactttaatcatctatcttattaaaaaaatttaatcaatatttttattgttattatatgataaagtatgaatattattttatacgtaacttatttttttattttttaaataaaatatcaaataagagagacgattatggttgcgtttaaaatagaatgcatggagtactagtgtactacatcgagcaggagcgccatagctttgcggcgtccacacaacacacgccgtgccttttcccggagtggcaattggcaaaggcaataacatgcccagaattaagtatgcaaagcggttgctgccaacgccccgggttgtgcacatgggctatttggagaattggattcgcccctacgagtagtagttgctcagctagggttgctgtttgtttgccaaagatattctctgccactccctcctgaatgtttaacgcagttgatttttttaaatatatttgaccgttcgtcttatttaaaaacttttgtgaaatatataaaactatatgtgtacataaaagtatatttaaaaattaatcaaatggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgctgagtacattccttccttcagaataagagatggaatactcccatattgtcccatatgcgcaaggtagaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttggagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcacagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagtttactgcaactatgcattttaacattacgaaatcaaaagctgatgttttgccacggcgaagtcttaactctaaccgttaaatctcttatcttcacagtgaccgtagcagagatcacacattcacatgcaaaaacacgtctctttctctatacttcactttcacctcgataaaaaagataaataatccacatggcaggtgagaaattaaactattatcccgattatgtggcgcccataaagccagcagcgcaagcccatgtcatgccaacacagtagagcattgcacgcgctgtattcaattcgatcgccatgtgtagcatgtgcgaatattttttatcattagaaaaatatataatcttttcgaggttttgacaaggagagctatagctttcagctggcccaataataataataatcaaataaacaaggaaaacaccacatgtttcactgtactagttgagctctgaccactatatataatcacactgccacacaatctgctagcaattctcctccccctcttgcaatccattctgaattctctgatcttgaattcttcatcttctctctctgcaagaatctcgagatttcaagatcgaggagaacttaaaagtttttacgccatgattccgagagctccgagcctcttccatatcgaggatggagctgtgggtgtcgcggcgtcgacgaagaagccaatgccggctgactccggcgagctcgtcgggctccggctgatcatacagcagtcgccgaggcaacggccgccgctgtccgtgctcaggcggtcggcggtgaggccgtcgccggcggcgacggcggcggcgagtcaggatgaggctggtgctcctgcaggccgggggttcatggggttggggttcttgaactgctgctactgctgccacaagaagctctacgccgacatggatgtgttcgtctacaagtaagacattttacacaacaaatcaagaactccgccttaatccacacttcaaatagaaactttatttggtgattagtgatcatgatcgagctgaggaacttgtggttaattaattcttggatactgactgactgatttatctgtggttttttttgttttgggcagaggggagcacgcgttctgcagcgcggaatgccggagccagcagatggcgagggaggagaggcgagagatcgagatgctggtgaggcggcgccgcgacgcgttccaccgccggcgagcttcgccgccggccaagatcggtggacacgcgaggctgcagatcgctgcttcatgatttatatatacatatgacagacttatcgagatcgaggttcatctccgctagtttctgaacaatttttcaggagaaattagggaggacaatacaacggagacgtacggctactcattctgtcacagattttgttgtcctcgtctacttcacatgtataaattgtaattgtatttttcgatctcttcttttcgtctataaccagcggtagtagtgtagttgctgcagggtgtagatgctgcaaattaagttaagagtgtacaagaaagtagatgaaactgatggacatttgacaacgtgtttacggagtgtttgagatagattaagatgaaaataaagttagcatacgtaaaacaagaaaaccattaatatattattaattgagttaattgttataaactttaaaaatagatttatttgatcttttaaaacaacttacatacatcaagtttttcagacgtaccatttagcagtttgaaaaatatgtttacgaaaatcgagttaagataagtatcctaatcgaaaagaacgtgataactctgaagacatattcacttgcgtggacttaactgatggaatgatcgagctgagacccggaaaacattgtccagatcgaaaataaccatgaaaggttccttaatgcttttcccgaatttcaatcataaaatggcgtggacgttcagtatccgcatagtgcaaatgatctctcaccatggaagcatgagatctgggtgctcatccaacaaaggcctgtcgctttgatcaggcagcgactagctactccctctgtttcagattataatatgttttgactttgatcaaaatcaaattggttcaaatttgaccaagtttatagaaaaaatagtaatattttcaacccaagataaatttattataaagatatatttaattattaatttaataaaactaatttggtaatgtaaatattactatatttgtctataagcttagtcaaacttaaagaagtttgattttgatcaaagttaaaatatcttataacgtgaaacggagggagtacataacaatagatttgcactgtgacaaactatgaacagctagctgcagactgtcatctaaaaaacactgaaaaagttccaacaggatgtttatattagtgtatttgaggaagcttccgattcaaatgtgtactctcttgtgatagaaatcaactatcagggaatctgttagtagtaaatcaaccatctgaactagtatttatctgaaaaccatctgaactatccacggtcctgaactttgcataatgcccccgtttctgtcgctaccaatgatagcgaaaatttttgcataacacggacaactccaaaacacgcgagtacaaaatgggcctttagcccactcgcataaatgggcccccaagtcctcaacgatccttccgctgttactttgccgatgggcctcgtaggccagccatgttagggttcagtagatgggctttgacgatccaatagttagttggtcctttgcttcggcgggcaagaattaagaggcccaactctgaagatgtactggcagacctgaacttactacttcgagcatgttcagattgataccattttttaaagtaaagttgttaaatatgtgtatccatttagtttcttaccaaactttagtaaataaataagaaatcctgccaaaacttagcaatattactaaattgccaaaatttagtaagatttattttggctacaatctaaataggcccttcaactacgttggagttcactgaacttgttcgtaatagatatctcgaacaagaattaggaagtcctgagcattcagctaagtatttttttagcataataaaaaatgactgccagcctaggagaagcagccgctttggggtgggctggttgcctgcggccatggcaatggatagagatgccaattgtgccgttcaacgcacaactgaactggaactggataggaaggctgccaggctggaagggattcctagggtatgtctgggaagtttctacattgtgcagcttctcatgaaatcaaaatcttctctaaataatttagcttttgatataaattctaagaagctatagtagtaaaatgcagaaaatgaattagaaatcaaaagttgaaaaacctactacctcaaaaaattgcatttctagctctaaagctttgtcccacaaaaattgtatttctagccatgtggggcccagcaaattgattcatctagataagtttccttctctcagcttgtaatttaagtatgctaattatatgggttaattatctcaaacttatttttaatcatttgtatatatggaatgtgtgcatgcaatgggttcattaaataaggtcattgtggtcattttctaatcctactgttttatcctaaattagctagaaatgtaatttttatgagacggagggagtagctttttttataatctcagaaactgaccatctacgagctgtttgttactccaatcttaagcttctcaaatagacccatagttgaagagatgccctgtgttgctgcatggtctctgcaccgcacggcaggggagatgtgccgcttcatcaattggccgctccgcccacatgcaagatgcaacgccaacgcccagaaagtaggcgagagagacacatttcttcatttttcttgactatgaatgcgagacactgaacctgttctgcctctggatgataagaaccccacacgttccaactacgcgctgcttcaatttgtagtactgtagtactgtttagagcaggtacaatagcaggctacaaaccagctgcaaatatattttaagaagataaataaggagagagagaagcagcgggctacagatttatagccacctgtagcacggattttaagacgtattgtgtatataacatgtgggaccatatattaatagtgtagtatgtaactatagtataaataagctattaaattggctatagataaattggagctagtagttggctactattgaacttgctcttataacccgcaagttgccgtcgcctcccgccatctcgcatgattaaaagtttaaaaccgaaccaccaaaagcgcgacggcaaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctaggacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcctaattaatccctcatcagtaaatatttattgtagcaccatattgttaaatcatgacgtaattagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatatatatatatatatatatatatatatatatatatatatatatatatatatatatatatgtatatatatatatatatatatatatatatatatatatatatatatatttgctactcgtagtactagctttgactgtagctgcatcctgctgcctgcgacccttggttgctaccaacagatgatgctgtattaataaacgagaaagtgagcaggtcaagttggcaacttgacaataccggaattccaagaaactggggttggggagaaagttttggtattcgcaggcgatgcagccccgatctccgtggctcacccgtgtggccgtgatgccgttggtcgcacacgtttgggtgaggggagtccatggtgttgcggaggaaggtttggtaggaaggatcggcgagctcaaaaccggggaaagctcttcttcactgtgttgtttggcttgttgggtttcggattcgtgtgatgatactccagtttgatactacagtaaaatcacatgaacccgtaaaatgtactaatagtacggtcagaattttgaatggattttatagggttgatatccatatagtctaagagcaattttaatagtatagcccactactaagtctaattcatttatagccgatataatagtcaatttatacaatagttgtttactatactattaatatatgatcccacctgtcatacatatattgtgtcttggagtccgtactgcagctgactacatatctgtagcccgctactcttctctctcatcttttatctcattaaaatatgttcatagctagctaatagtctgctattgtacctgctctaagagcatccacaatgtagtccaaaagtgatccataagcaatataatatgtcattcaaccacctagtaacattgtgaaattagtacatagcaaaaaaataacaaaagctacccataaacatatgggctggaggataaaatatattatttgtctctacttcttctctccttctaatactatttgctatctatatacattatgaatgttacaatagttaaaatccatacatgtgggtcccgtctatatggactacttttgctatacattgttgttgggcccctttaaatcgtagaattgataaaacgtaggaatagaaaaaacgtaggattttgatagaaatgtaagtgtaaaacagaggattgaaaaaacgcaggaatgactgtttgattgaatcataagaaaaacgcagaaattggatgagagagatatactcaaaggaaagttaccaagaggttgaagctcttgctaaatttcctccaaaatctatataagattgttcatttcataggaatttcaaaggattggataggatccaatcctttgtttcaaagtgtttcttaggaaatttttctataggattgaaatcctccaaaattccaatgtttttcctctaaatcaaaggggccctaactacatgtagttagtaacacttacttcaatcaaatcaagtttattttaagttttgttagcacctgtaaccacatttcaatattgaaaagacttttgttgcttttaggttttctcatcttagtttattttagagcctttgtttctaaatcactaataatatatatatatatatatatatatatatatatatatatatatatatatgaaagttttattcataaattgtttgtttgcaaatatgtcgtgggtctcgtttaagggcctgtttggttggtgccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaagcagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgaccttatcccttcgcccccctcctcctcctctttcgccgcgatttctttaggattttttttcccgcgatttcggagccgcgggatggatggcccccctcccccctatttaacaccgcctcgtcgctctctccttcctcatcacaagctcacaagttcacaacccaacacccaaaagcaaaagaaaagcagcaaccaaagatgtgcggtggagcgatccttgcggagcttataccgagcgc

SEQ ID NO: 78569 - DNA, 11516 bp, Oryza sativa
acgtcggtgtcggcgtaggtgatcatgtcggtcatgtaccgccgggtcatctcgcgagacacgatggactccttgatggggctgaacctgatggcgttgaggtcgtaggggggagtggacgacgacgacgagatggagttgcagatggcgccgccggtgcgcggcgcgacggagacggtggggttgcgggcggcggcggggaggcgcgcgccagcgaaggaggtcttgaggaggctggacgcggtggtggccatggctgccatgcgagaggaggaggagctgagcttcttgctctgggatgaggagagtgtgtgtgagtggatagagcgtgggttggcgggggtataagaagaagaggagagcgcaaatatctgggagtgccgtccacgtgtcagcagtatgggcctctgggtttcggattgattggaggagatattttgggaaggtttagtgagggtttttggactgtcttcaggagaacgggacaagtgctgctaagtcacggactcacgggaacagtggtgctgtgttcagtgacagtgtccgtgataccgtgacgactaaggctgtgtttgcaatcctatgttcccaacccctctccctcgttttttgtgcgtacgcttttcaaactagtaaacggtgtgttttttgcaaaaagtttttatacgaaaattgcttaaaaatcatattgatctatttttgaaaaaaaatagtaaatatttaattaatcatgcggtaatgaatcgctccgttttccgtgcggggagtttagttcccaacttcccatatcggaacacaacctaataatggtttttggtgatcgattttttttatggctacctgtagtgaggggtactagtggtggagcccgggtggtcactcgacctgtacaggagctggctttgtcgctgactgtaataacatatcgagaattttttagtctgaaagaaatccaccataatatgttgttgatatcgtctaatatcgagaagtgcggttttaacttcttgtcacgcgttggtaaacctaagtgtctgtccctaagaaaactatctttgccaacttcttgatggatcgccttgactgttttgttgcacgacagtcgttgggaacaaagctcatcttcacaaattacatggaggcatggggtatactagtggtaaaggttccgggggatgaaaaccttctagttttttgggtttgacgatcgcgagcggggatcgcactacatgtttttgttgagcaacaatcatcgtttatttgttgaagttgtcatatttaggtctttggacgtagatctaggtctaatttcatatgatagcggctatctctgtttatgatagtaattgttttccctaaaaaagttgctttgttaatatatcctatcaatcaattgttttaatttctctttttttctaaataattcttttagaacttagttgtatttctctgtttttttcctacatccttgttcctaataaaagatgagaaacacccaggggtctttcggctagctccacaaggtggtgggctagacgacttggattcgaagcctcaacccttctaattatttgatattaggttattctctaatattcgcgttcctaataaaagataatgatacactttcagggataaataatggatgttttctgatctggtatatatttttttcctctcgaactaatctgatataaacgaaaagagacaaagtcatttttatttgttttttatcattgcagacaagcttaaatgatctacctaatttgaaatgtctcacagatcaatatgcatgatattgattataattagaatgattttactacagggacagtgaatttcataacttgaggctagtagatggtagcttctcttgcactgaaaaatctctggtaaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacggaggtatgattttgacttcagatattttacagcgaagtagtctgagtgggtttaaattattttacttttcttttttggaaatatcaaacctgagaagtaaaaaaaaacagagacgaagttaagttttgagtgaaaagcacagggaaaagaactttttttttcttttataaagagaactacattcaggggttgcaaggtttgttttaagggtaattttaccatccttgagaaaaatactaggtgataagttaaagtgagttcaaatttaccctttcccaacttctgctctttcgtttttatgcacacatttcctgaactagtaactatatgttttttaaaatcttctatatgaaaattgctttaaaatattatattaatccattttaagttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacatcaatagacgtgaagtagatcccttttaaatcctcttctattcctttaggtagtgtttggttgcaaggatgggatgagatgggatggaatgaacccacttttagaggtgtttggttgagaggtgagtgggacgggatggtccctagagaggaatattcctctcagatccgggatgaaacggtccgccaaaatcggccggaccaatccatcccacttcgacggagcccacggcgtcacctcccgtagcctcccgctcggctccgccgccgcctcatccgcgtcgacctccgcctccgcgaccggccgtcatctcgtccgcgaccgcctccgcgaccgaccgccgccgctcgtcgtcagctcccacagcctcccgctcagctccgctgcggcaccgccccggccgcccgtccctcccccagcgccgctccgtcctccttcgcctgctccctccaccttgcctcgcctccacgaccggccgccgcctcgtctgcgactgacctccgtcgctcgtccgcgttcgcctccgcgactggccgtcgccttgtccgcgactggccgccattgctcgtccgcgcctcgtcgcctccgggaccagtcgccgctcgtctgcgcctcgcctccacgaccggtcgccgccttgtccgcgaccgcctccgcggccgaccgccgtcgctcgtccgcgcctcgcctcgcctctccttgcctccacgaccagtcgccgcctcgtccgcgaccgaccgccgccactcgcccgcgcctcgcctcaccttgcctccgcgactggccgccgctgctcgtccgcgcccgcctccgcatctcctccgctcgcgccgacgagctcctccgtccccattctcaccactctctccaacctagccgctgggagcggacgaacctaactgtccgtgaaacattatccatcccatcccatcttaattctttctaccaaacaaaaaactataaccatcccataccacaaaccaaacacacaactagaaccattccatcctaaaaaacagggataggtctaacccatcccacttggtcaccaaaccaaacacacccggtggggggtaaaccaaccagacctacccagcctacgaggaaattcggatataagcctaaattttactacagaagaaattcttgggttcttcaagatagctgcacaacctgtatttcagtccttgcaaggagctatttgtcatatacttgtataaaaagcagggttgagaatatagttcacttggtgtaaatagcgcctacgagaacttgggcctaacaaaaagtgcaacagtttgtgtagcggttaattttggcccatggtagcggtccagatggtagctgtcctatttctatagagaaagtctatactcactcttgtccttaatcggatcgcttccctcaaccacaaaaccatgtataacgtcggggcttgctatctcgtgcgcgcaccaacaactaagctggcacacgtgccggctggcggcccacgcccctcccctacatgcgtttctttttttcttttttttgcgattttctcctattttcaagcctcttatcctaggcgtgttttaatttctttcgtgttctttttaatttttttaatctgcaggcacacttgttttcaaatctttaagttgaaagattttaaattaagttgaaagttttggaatcttgacttgaaagttttccaatctaagctgaaagtttccaaatttcgagttaaaagttttcaaatccgagttgaaagtttcaaatttgagttgaaagtttttcaaatttcagatgaaaagttgaaagtttcaaatttgagttgaaattttttaaatttaagttgaaagttttcaaatcttaacttgaaagttttccaatctaagttgaaagttttcaaatttcgagttaaaagttttcaaatctaagttgaaagtttcaaatttcagttgaaatttttaacatttaagttgaaagttttcttgacttgaaagttttctaatccaaatcggaagttttcaaattttgagttgaaagtttccaaatctgagttgaaagtttcaaattcgacttgaaagttcaaatttcaagttgtaattttttaaaatttgactttacagtttcatattttaagttgaatttttaaatttcaggaatgttttaaagttttaatataaagttttaaatttgattttaaagtttctttcacgtgtagatttctttcagcctgttagtaaaaaaatacttatagaaaaaagaaaaaaactaccttaaattttaggtttgtttttaattttcaatagaaagttttaaattttatttgaaagtttctttcatgtgtagatttctttcggtctgttagtaaaaaaactcccagacaaaaaaaaaacttaccttgaatatcatcaatatccaatactagacagagttagttacaagagttagttacagtagatgcgcgcgtctcccggaaaaaggaaaaagtccgattgcggattgggtgacatcgtgtgtgtgctacttctcttcccgacgtgtactcacggtacaagaattatgtgtaacgtctcccccaactcaaaaaaccggtgcaaaatcgattcctcaatggttcggtaagaggttgtgcggtgggcctcacctatcagttacactttttccccttaccccacctctccctctctcctctatcctatgagataggctatagggaaagcggctgccgccaaggaacaccggcagtagagacgaaatggcgcatggaggaatacaggagggcagagaatgaaattttaaaatatgcactattttcctcgattttgtatatatacatatatgcttttgaaaattttatagaaatatacatccgcatcaccgtgccgtcggcgcagctcgaagacgcgccgcagcgccaacacacgtgaccgggacggtcccgtgaggcccggcgccgcgtcggcccgttcctctgatgcacgtctgccagagcctggcagtggcgcagaactggcatgcactacgggtgcgtttggttgctcgtattcccttagcctggctcatctcttccatccaggctgagtctggcctggttgagaggatacacatgcagctgtttggttgcccgcatctgatgaacctggatctgttgagatgatgtttggttggttgcagcaaaggattggtggaatggttgcatgcaggagatgttgtttggttggatggatgcatcttgggtgtaaacaccctctcctatgagtggtgaggttaccctcataagtttgtggtgtgaaaattttctcaagtgtctacttctgtgcggtgaggttactccatgaggtcgtgttaaaattttatttgctctttggcttactattatttgtgagctaaattgcttaaaatattgctatgcacgtctattttatttggttggtctttgagtatatacaaggaacagatcaaatattttggtctttgagtatatacaattacattgatgttatacaaaactaaaccaattggtatattagtaacaaattgttatacatatgcaatctggtaaatgacaagtgcatatagtatgttcttatgcatcacagatcagtactattaatcatcaattgcagtattttccagcttgaccctaacaaaaaagaactaagtgcaggaaatatgttattatgcattacaaatcaacactattaatcttaatcatcttggaaatatctcacaattgcatctcttcatatgcatcggaagcatcttggaaccataacaacataaaaaaagcaagtgcagaagcatcctttcatatgcagcacaaacagtggcgtgaagcattcatcagtggcaataatcatcattgaagaatcaaggcagagattcaacaagggtcatgcaataccatgcagtttacactacaaaagccattcaggtactggtgttcactaccaccttaatcaacaggtagccaacattctacaaaagacatatatgtggtgtccactaccaccttaatctgcatctaagcaatattacataatatggtgtcccagtaccacctctccataatagttagttaaatagttagatgctctcagggtgatgctcattcaggaacttcctaacccaacgagcacgacaagcctcattcttctgaatgtatacaaggctttcagccttctccttagttagataagctagaataaggtccagctgatcctcactgaaacctggaagatccatcactgtgttgcacaaatcagggtgaacctcagtatgtgcagtagcgcctattgctgaagccatgttgttcactgaatctgtcatattgctgatgagagcaacttcaccttcattcaaagcagatgctctcttcctcttcttatctgaggtagaatcctcatcagtaggcccaacaccacttgctcgagcagcaattccaggaccttcagcacccacaccacttggtccagcagcaataccatccccaatagtgccatcaagaggtcccagaccactgtcagcctcaccagcagggtttccaagcgcttcatttgaccccatagcaaatctcccagtggcttgcctatttgaaaaaattattgccatttgtgtatagttctctaaaggcacattgagaaactcagcatccttagggtgttcctatatgagaacattagatttaaagtgagatatgatgtgtactaatgcagtgtgttttgtatgtgatagttagacacaaaccttgacatgtcccatgtagtgctcctcttctaggataatcgttgaggtctgatcatcccaaagagccccactaaggtctttgagcctagtgatacgcacccacctttgacgccatttgcgaagatggttatacacttgggttccactaatttcaattccatagtgatcagacaaagatctagcaacttggttaaggtgagcttcattgaaacccttgtcagtcctaacacctgttgctataagctcaaccatgcgccttagcattaagctagacatgttggttgtccaatgcaaggctccatggtgtccaccatggccaccattcccgccaccagcctcagccatcctatatttaccacatgcaaatgaacaaataaatttaacataaatcgatagatgtaataaacagcatcattgcaaatatctcgaggtctcaaattaatagataacagtgcaacagggtacaacaatcatcatgcatgaatagataacagtgcaacaccatcctaagttcacagatagagagttacaaattaatccctaagcatgttagaccctggacgaccctctattgttccacatagcaccagccaaatcatccctaatttgcgccattcccctattgtcttcatctaagtcatcgggctcctcatcatcgctatctgagttccaatcactctctagtggcacatggtcatccatcccaaactgaagtatccagttatgaagtatgcagcatgcaaggaccaatttgacttgggtcttgtatggatggaaaggcttgttatagagtattctgaagcggtttttgagtgcgccaaatgcccgctcgatcgtgacccttaaagaggagtgtcttagattaaacaactctctcgaatcacgagggtagtttcttctatcatactccttcaaatggtatcgacacccacgatatggcggaaggaaccccggtctagcagcatatccagcatcaacgagatagtattttcctaagagataaaagctatgagtgtaataatcatatgagataaataagaatccttattaatcgttagttttaacacttctattacctgaggggacactaagaccatcatccctctccaaggcatctgcaagtatgagggcatcatgtgcagatccttcccacccagcaagtacgtatgtaaatccaagatcaaagtccactgcagccattacattctgggtggtctctttcttcctacccctaaaggcagcagatattgttgatggaactcgagcaagcacatgagttccatctattgcaccaatgcaatcctaatgaccagtgagaaatattaggacatgattgttgaaagaacatattttgtagtcaaaatgctgcaaacaaatttttaccttaaaataagggttgaatcttcgattggatgtaatttttgaatgaggctcagatgagggtggttttatcatctcatttcgcagctcaccaatagagaataatacctcagcgaagtatctactgatagtttcaattgacctcctaaaagtgggttgcaaagctctaaatctgtggttgtggcctacaacaagaagaaacatggcaacttgttcttccactgagctatgtatactgtcccgcaacaacgctctttctcgtaacaagttacacagctgaaaaaatggggctctcttcattctgagctgatttaagcaatttgtatcatctgtatgatagatgaaactaagattggattgtctagctatgtccctttcggacaatgggccataggagatcctaggggtacgtcgcatggctcttcttgtaataaacagaatgtaagcattcattacagcaactaatccagctgctttagcaatcagggaccgccgaatgcgttgcatttcttccatctatgcaaataacatatataatgcatagtcaattcagaaataaaaggatggtcttgtcgctgctaagtactgcaaatcaaattcgtatgcatgtatgccacggccgccacatccaagggatgctacctccagtggcataccatcatcgaccatgaatatttacttacacaaaacacaatcggcaaaataatgtgcacagccaaaatagtaacaaaacagcacccaaactttgctctgacattgaacattcatctgtagcaaactgaaaaaatagtagatctggcaaaaaatgaacaactaaaaaggataccaacagtagatggtttcaacatttaaatctaccataatcaactaggaaaatgtataagtttttactagatctagcagatttatgaaggccccatgttctcatccactcaaatcacagcaaatcaaccaaatagaggagaaaaaactagggaaggagggacagggaagaggatgcccaaccttgcaatgggcgacgaacaaccatccatgaacttaccctggtgctcaacggagagtgacggtggaacaggggggcacgacggagagagccggcaaacgagagggaggatgaccgacgccggggaaggaactgatggagaagagccggagtcggaggagagggccgccgctcgcgaccggagtgacgacgagagcagcgccgcgccgcgcctcgcctcgccgccgccagagctagggtaaaccctagttttttcgcgagagggagaagtgaggcggggagggagcgattctgggaagcaacggtgaccccatcctccgtgagttgcacgcgcgggtgcaggcgcgggtgcagcggtgtgcatcagtcgagccaggctgagcagcgaagtgggaatcggccgtttctgtcgggcctggctgaggggctttttttgcatccgcgtggacaggctgggaggcctaagcaggcaaccaaacatcaggaatttgcatggactggtgcgggccaaccttggtgagggcaaccaaacagaccctacgtgaatggtcagcgtagcacagtgatgcatatatagcatagtacagactgcattagcagcattaggaacaagagttttatttgattccgcttgaccattccgcggaaccgcgacctagtctgacgtttccacatcatgccgccgtcactcccggctgctaccacactaccacctgtgctcgggctggtggggacggcagtggtggtgatgagccggacgctcagtttttgttgtgactagggaagtaattaagtttttaaagcaatatcatccatgtatgtaaaggggtttcaagagcatcaaagctggaggacagaacattgtgccaaatatcaggtaactttatctagagcaaatgtatcaatactgcacttccttgtcgaagtgctcaggaatcgggaccggtctcccggcagcgacgcggacctccctggtagaccttaaggtgtcttcagaaagtt

SEQ ID NO: 78570 - DNA, 2005 bp, Oryza sativa
atactacctagattccattttagcaatccctttgcactaccatgctcccctctaagctgccgatgtgagcacggccgccgcctatggaggcgctcgtcggcaactattctccgcaccttgccaaaggtcggcaagctgccggaatccctctagacacctcgtagatgctctagaaccccctcccctagccatgtctaactcatatcaccttgatcaccattacagcctaaccgtaccaccgccgccctagtcgccaacccatccacataccaaattagctcctccgccgccgatcgccgtcgccggagatacctagctccctcccctcttcggccgcaaccactttccccctccatcgccgccgtaatcccaaaccctagcaccgccggctgcatttggggaaacggccgaaggtagaagaagagaagagagagagagagagagactgacaggtgggacccgcacacagtgccatttcacttttatttgatttttaaactttagaagctcatatcttttaaaatatagatccaattccaatgaaacttggaccaatattcttctaaaatcattctctatcttttgagcccctttttgctatttttgcattttattttattttctctatttttcatatttttggatttcatttgaattccttttaaatttgaattttacatatgtctaaccctaggtcttgaggattcttctgactcaatatataatatccatcaatctcaggacatctagcaaggcaagttaccatataccttttgatcattcaagcctatattttataaattatttaccatagccttctattcaatattctattttctatgcataaatcaatcatagaaacccagataatttactattgcttattttgctcacaatctggttaaaataccctatacttagatcgggacagtacgtaagatttggctgatttccgggtggctagtactgtctcaatcaatataagttttaccagatacttatgttgaacgaacgactacgaccgcagtttctacactagggacacacctacttattatgttaattagcaatatggcacctctgtatagtggttcttatttttaagtcctcgtgcaggaggcaactatagccgcgaagggaaactttaaccattaccatgtacaggtaaatggtatgtgatactcaagtataaactatatggtatatttctaaaccctgatcgagatgacgaggtgtcatacgatcagttccccttaaataccttgggaaagccagaactccttttgctgctgttaacattacattcagagcatatgaggatatgagttcatggaacaggtgccacaattgttaatgacttaatactggagcatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggctt

SEQ ID NO: 78571 - DNA, 1484 bp, Oryza sativa
tttccaaatagacaaaatcgattttcttatgcggttgtctggcccgcatgcgagaaaatgtctgcgaaaatccctattttctatgtggttagcgcatatgcatgcaaaaaggtaattttcgcatacgaaaccttaagccaactacatgcggaatattttttggcaaaaaaaaaaaaaaaactctagccatcccaccacgtgccggacgcccgctccggccgcccaccgccgtcacctcgagtccttgtcgtcatgcgctgtcgcccttcgctaccacccaccgacacacccactcgcctgctgtcgcgcgtcttttgtcgctgccactggatccgggcggaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaacta

SEQ ID NO: 78572 - DNA, 1138 bp, Oryza sativa
ctgcagggccgtgtatttggcctcctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 78573 - DNA, 697 bp, Oryza sativa
ccagtacaccgtgctgacaggcacgttgtccctcacaacccaaccgctgtggcgtacaaaattcttggctgcttctgccgaggcactaggtcggccgtcttcgtccacctcagttatgatgtgccgaccctctatcttcttcgcggcacctcgttgtccgagtgccctcttctgtccagcggagggatgacttccactagcctcctcctcatcgttcccctcctcgctcccctccgcatccctctccacgttcccctcctcgttcaagtactggtttggatcctcgttcccctcttcttcgttccagtactggctgcttctctctgcgattgtatcgtatagtatctgttcctcatcgcgatcagccatctgtgcatacaaaaaatacttgttaggtatataggatgtatttgctaaccgtaatattaaaactctactaatcttatattaaatctctaataatcttatattaaatcgctactaatttcatattaaaattgtaataatcatatatatatgctaagtataacaatcttatattaaatcactgctaatcttatattaaatctctactaatctcatattaaatcgctactaatattatattaaaattgtaataatcatatatatatgctaagtctaagaatcttatattaaatctctaacaatcttatattaaatctctaataatcttata

SEQ ID NO: 78574 - DNA, 39593 bp, Oryza sativa
  unsure (1)..(39593): unsure at all n locations
cacctagggcgagaacggtcttctctggcccacgttcatgtgtcaagggccaagcgcatgtccattgctgtgtaaccactcccggtctacaccagccatgcgcacaatgcttgcgcaattgcgacacacacgctcgtgaacccgcgagagtcggctctgataccattttgtaacgtccggcctcccccaggccaggccctaggccgggatgttacaccctcaccccctcaagagagatcgacgcccccgtcgatcaaccctaggccaggaacgtcctctcttggccacgttcatgtgtccagtgccagcgcatgtgccatgctgtgtaaccactcccggtctacaccagccatgcgcaccatgcctgcgcaactgcgacacacacgcacatgtcttttctgcacactttgtcctcactcgtgtgcacccgggaagaatttcccggtcagtcacccatcccaaattgctccagaccaagcacgcttaaccctggagttctttggagattggattccggaaaagaagttgcaacttgttgatatgagtattctattaatcctattaagccctaggccgggatgttacattggatggatcatggacagagacaatgtagctagggggtgtttagatggggctaaaactttttagcccatgtcacatcggatgtttggacgctaatttgtagtattaaacatagactaataaaaaactaatttcataaatgagagctaatccgcgagacaaattttttaagcctaattaatccataattattaaaagtttactgtagcatcacattgtcaaaatcatagcgtaattagactcaaaaaattcgtctcgcgaattagtccaaggttatgaaataggttttgtaattagtgtatgtttaatacttcaaattagtatacagacattcgatgtgacagagacttagaataagtccctggaaaccaaacaagaccaagtggcaactgtcaatgagcagcactgtagccatctcctaagagcatgtacaatagcagactataagcctaatataaacatattttaagaagataaaagagaatagcaatgagctacatatttgttgtcagctacaacacggactccaaaacacagtgtgtgtgacaggtaggactatgcgtcaatagtgtagtatatgtttataggtaactattgtatgaattggctattaaattgattatagatgatttggagttagtagttggctatattactaaacttggtctaataggaggaacactcaaattatggggataatgacagcacaggacaggacacacaagggatgcttctgtctctcaaacacatcatgcatgcagtgatgcagatgactcctccattgtctttctcaatcatgtgccccttgacaatctgaggccaatgagatcagaagaactcaaaagccacactcctaactactgctccctgtgtgcatctccatggatttggctggccccaacaactcgaggaacaacaggttttgtgtccttctggcgacttacctttcctttctgcacaaagactgggacagcaaactggctaaaagcaaagaatctgtgtcatggatgtcactggtgactcgtttacatgctcatcaaatcggaatcaaaacaaatgcagctatggaaaaccatcctaggtacctttagtaacagtaacataagcagtgacaaatgctgctaggggattagtaccacttactatcagtaacaaatcactagcttcatgtttacctgcagtccacttcattcttgcaatggagaaagatagcttcatatctctgtgatcactgtattttgggacagagggagtaatacattggctacgttagttcagacgacgtgaaagttcagagatttaggatgtgcatggacaagattgaatgtccggtgataaaatgggaaatgattcagcagaggaaggaatcaaaagatcgagtggtgtcacacgattcagaaaacgcagataggagcagcagctttcgcaccgagttcgagccgctggctgaatcatgcccagcgcgacacgcagacatgaatgcaagctgcagcaggcaggcaacagcaaacatcactggtcaagactcaaaagaacacactctttgattagcctccaatagaatcaaaagtacctaatacatggtgcattggtgaccagggtttacgtcaccgtttccaatatgagaaccgttttcgataaaaaaaaactgctgatttttggtcaactccgtacgaaaactagctgaaatcgatcggttttcacaaactggatcctagcggtttcacaaaaattgatcaaaactgtgaaccatggtggtggcattgcagagacgctgtcctaaataggatttaatctttcggtttagtcatttatataggggtggacaattttagaaatttcggtccgaaattatatgaatttttaaataaaatttaattaaatttgaacaaaatattaccaaaatcacgaaaatgaaaaaaaaatcagccgaaataatattatatcgagggtctgaaatttcgaaccctggtcctaaacctctgaacctaaacacaaccacacggtccaatcaaccaatcccggcctgaacctgaaactggggtgattgacagaaacacacaatgccctgcaagtttcagggagaggctgaccggaattggcaagtcatgtggaggcacatgccggccatgatgaggtgcatcctccctagatactactctcgtatcgtcgtcgtcgtcgtcttcatgttacatgttcatgtcacaacactcgcaatcacaagcgcacaaagaaaggacgcccgcattactctgatgatatgatcggttcttgcagcagctactccctccgtcccaaaagaaagacaaaccctgtatttttgtgtccaactttaactgtccgtcttatataaaatttttttataattcgtattttcattgttgttagatgataaaatattattaatattttatacatgacttgtctttttaattttttttcataattttttcaaataagacgaacggtcaaacgttggacacggaaattatgtttgtcttttttttttgcgacggagggattatagcatacgccatgatcgatcaccacgttaattatctgccgttttcggacgcttgcgagaacaaggcgccgcccctggcctacttggaagagtcaagcttagaggagaagaagaaaaaaaatttcaggtcgtggcattcgtcatgcttgaggagggacacagaactctatccaatcatcatcatactaatcaacctcttgtctgaatatgattgcttcagggattaagatagcaaactctggagagcgtcattaattggttcgttttttcagttatgaatcattcagaatcttcagcttggtggtgcactggtgcataaactactgtaatgcggattggaagatcggaaatgcaacaactatctcaaaagaattctcatacgctgatcaagagcaaatccgagatcaggattctgaataaaggctgatttttttttactctatgctggatgctaaatagcctgactaatgatactacttggtagtaatatacacgtactagtggtggtgaagaactgaaagaacacgtatgcattcggatgcagtgctcgctggtgcaagaacagagtgtgtgtgtgtgtgtcacacagtgctagtagcagatctccatggagaagttggagtcgagcagctcgtcgatcatctgctcgacgtgctgctcctcgaggaacctgccgctccattccgcgccgtacgtcgtggtggtccgcgcgtcgtcgtcggcggcggcggcattgccgagcggcggcgtcgtggcggaggccgaagaggccgcggcggcggtggcggcggcctccctctgccgctgcgtggcctgcacggacgccaggttgaaccggtggagcttggcgacgagcgcggcggagaggaacgacgaggacgcggcggccgccgccgccgccgcggtggcgtcggcgagcgggaagttggtgcgcgcgcggggcccgcacatgatcctcgccgcctcgtcgtacgcccgcgccgcatcctccgccgtctcgaacgtgcccagccatatccgcgtcttcctgcaaaatcaccccacggtgcaccaccatgagcgaacccctaaccaaccaagaaacgcacggcgacgacggcgaagaagaagaagaagacgacggtgtcgcgcgcgcacgtacaggagagggtggcggatctcggagacccaggagccccagtggcgctgccgcacgccgcggtatcgttgctgcggcctcgccatcagcttgtaggcttgtctatggcggcggcggcttcgcgggtgatcgtcgccggcggcaatgggggcagtgatcgagcacttcgccgacgtgggtgcgcgttgccaggttgcaggggagggagtgtggtgcgggagccatggaaatgggctataaataaggagggaaacgtcggaatctttttcattgctcggatggctgctcgggtggggcccacataaaatgcctcagtagcattgggtgtatggccactgggcccactagactgttttaagctcgtcttttcgcttatacttatacttataagttaaaaattgaattttaagttgattttggaatatgttcatcgaagtttattttttagcatttgcgatcgttaagaacacgtatataaaagtagtatttacaaattatttttcgtttgtaaatatgttgtttggcttttttaaaaaaaataagtgcaacgatgggccgtttgtttagtttagtttgctttggtttgattgtttggttgatccttcttgctttggtttggttgatctttagttgtgactgtgatctgtatattcttttgatttagttttacttgttagatagggaatagtaataaaattgactagtaagaccatcatgggcgtactactactttatctatttcctaggaatgttacagaagtttctttgaatagtttaattctgatcggatatgggaatgaatggatagagaaatcaattttaacctatttggaaatttgattaaaattgtagtatttaaagtaaatttttaccaacccatagtagaacaacgtacacgtattccaagttgtattttgaagaccggttcaaccttcaaaacacagattcaacaggttgtctgaactgatcgagttggattgtcagagatcaaactggactgaactttcgttcacttcacctatcacaggattaaagatttacttatcacagaagaggagatatgcagagatccagagacagatgcaaagaaaaatctcccatttgatctcactgactcttctccctgattatcagacaacccatcatgctgaagattatcatgccatttcgccatttttcctgtggccttgcccaagaacatgcaagccagacaaaataaacctcacatggacggaaaagagccatctgtctccaagcttgcgactgatcacacaccatgcatctatcatccatccaattttggtgtgtgctatccagaaaattaaacatatgtgataagcatgatatgatctagacctagctacccaacgtctcagacacaccacatgtgaccctttccctttcacctcatctatagctatagctcccctgtattaaatacaaagatgataaggaagagaccaattaaatggcaaatgggtcgtttgattctctgccattagtccaaacagcattcatgcatgcatgacatgaacatgccatttcgatgtgtatttaattaagtttgtaacttcgatttctgggacattccagatcaaactgaaactgtttgaaaacgagtacagaaaaagtatcggagaggagtcgaattcttggtctttatgattgattagttctgaacagaggatagagatttgtgagcttttaatcttgacgtacgccacatgacgatgcaattgtttcacaaaggtggatcaagttaatccagtcaattcagtcgccgaattttttaggaagactcgaagtcaccgacgaaatatatgctcgaagaatgaatattacgcatgttgactcgcaaatcgtcgctaactgtcccccactctgcttgtgatttttaatcatgatcaatatatcgatcgacctcaaagcaaaagagagtatccaaggaactgtcactgtgcactagctgctaatactacatgtatatgacgcttttaatttttagatataatatttgactatatgtttaaatttgacgtaaatataaaaagatataatttttttgacgcaaaaaaggatataaatcatatttaaagtacatttaaaaatattttttcgtaaacccgtaaaaagattgcacgtcaaaagtactttttaataataaaataagtattattctaacaagatgaatggttgaatgatatgtctaaaataaatattccgttataggacgttttaactttggttaaaatcaaactactttaaataaaaggtagtaatatttacagcatcagcatagtttcattaaatctataattgaataaatgttcataatatatttgtcttgggttaaaaatattattatttttttctataaaaattagtcaaacttaaaataatttgactttgaccaaagttaaaacgtcagtatcatatattttaaaacggagatactctatcattgtctataaatcaaaacggcccgaatcgacgacggagatcctagaaagaatcgagaataatcctccgcctaactcaatgaccgggtgagcacagaacagaaggaatttagacctaaccacgatataaatactgcaaccctctcgtaggtcagtgatgcatggtaggtaggtaaagccttgcaagctgcattgcagataaaaggaagaacatggcatccactgatgataagactactactacatggatgtgtatagggtctacgtacccaatccgtgtatagcctactataatagtactaggctactagcagtgcgtcatatcttacactaatccaatgaaatgaatacctccataagttactcccaacaaccatatgtagcatcaaaattcagtctgacattgcatatattggctccaaactcaaagtctgaagatatatggatggagtccgaaagacaaaaccaggaatcgagagttgcatatatatgcacatggatgatcaggacttgatgcatcgaggagtatgcaagcaagcatggatcggatggatggtccctggctatagctaagtaggctatagctatagctaggagagatgagctgagcatggatcagtggccggccgacgagtcgcgagttgcaatcgtctctggaatatggatggatcatgcatgttcacctccactgcgtcactgatcgatgctaattgctagctggtggacgaggggtgcagagagcggacgaaggatcctctaccgttgaagtcacgtgactttatcactgtcacgtggacccccgatgattcgtgggtttacatatcagtgacaaaagcaccgcgcaaatcaccagcgcgcgccaactttcgttgcatcgggaagaagaacgtagtgtagtaacaatgcgatggtatcgcgacgcatgtgctgcggccgtgtgcgtgcgtgcgtctctccgttgaatcgtcagctcgcgcagcgcacgcacgacgcgctgcggcgccggcggcagccttatagcctggaggctggaccgcgctcgctgtgtgatggcgtaggctgcagtagctgcagtgtttgcagctagctagcgcaacggtctcagcgagagctggagcccgcattgctgctggcctggctgcctctctctcgatggctctcgcaccacgtggagttcagtgcgcgacgcagataggataggcagggtttcagtgttccacagacagggacaatgcaagctctctcatgagcatagtagtacgtagtatcaggggcgcggattcaggaaggactaacagaagagaggccgaagaaactatacaaaactatagccctcttttttaatgggtgtatgataaaaaaatttagtgagacttaatggaaactctcatagttttaacgcttgtagtggtgactctacacgccgtcgctcccatggtagatccatcactgctagtatccaactatccatggtggtaatttgcaaatcgcatgcatgctcacgctccgatcgatcccctcgatgaagatgaatctgatcagacatttgctatgatcgctggctggaacactgaagcctgaagttacaactggtttattaacaatgagctaccatatcctgaaaatacaataccttgaaacttggagctatatatacagcctatttttttatataagctctcgtatagctgtaagcctgtaaatgtggacaaagttcagttcttgtattgttgtcctgttagggagcgctgcagatggccactggtttcagcctttcaggggccctccagaaaccacctagccatatttttgcacaaattttatcttgatttctcttatagttaactgcctgacacgtaagaaattgaggatcattccggcaaaagaatctagctctgtagctttagctcactagcttttacagtggatagctgctgttctttgtagatcccttttgtatctcatctgttccatcccctttgcaaaaagaagaagtgatcaactgaaatttagcaactaacaatttgttaacaaccttcttgccgaaaaaaacaggaggaaaatttctttcagactgtcaccaaagtcgagaaaaaccaggatcgatgcagtacttgtttagctgcaatgtcttttatgttttgctgcactagtctgtctgtctgcaggatcggagcacactgaaagcaagcgcagctgttgcacatgctgcatgcacacacactgaagaactgacggctgaaacgatggtccaggtgcataacgaacttggtcttggtgcaggtagagcctgacatagtcatgttactgtcaaaccacaagtcccaaccatcctatgtaatccaaaatggacaatggctcaatgtgagacagctgctacaacatttcacatttcaaggatatcttgaccaaagatacacttttctgacaatttctgtcattttttaattcccagcaaaccgtttaagctaccttaaaatctttgcagaaagattgtaagttgtccacaaggactactgtgatgaacacggcttgtctattcggagataactctataattagttcgcccatcattgtccggtatgggtattacttgttagcttgctgaagtgatcaagcagacctgatcatgtatggatgattgctaattagttttctgctggtcaattgcagtcattagccctcgcgaatgatccgcatttcgtgggatcttacttgacccgactgacacctaatgattgggacgcaatctaggctgctactaaatgaattttaactagttgcgtttgacaaagattaagacgaacagtaaacaccctaaaactctgaaaaatgaaaatccagtcaaaatatctccccttaatttcttctgtcacggcttcagctattcagctgtattttggggagatgcagaaactgaactttcagcgaacagcacgacacgcatcgttcgcatcacatatattcatatgccgtcatgaaacttcaatttgtcccctgcaaatcacggtgaattgcatgagaactgcctgccggtgagagtgcatggcaacacggcatgcagatatgcaatgcaagatgcaactcacctgaggatcatggcagacagaacgcaaaaacacccacatggctgcgattgcgacctgataaaaccggggctaacgatcatatacgagcagaatcagttaagcagattagcattggtccggagacagccactcatgcagcagatgatgctggggataagctagatgatcgccagcgactgcctgtctgcctgtgccggtgatcgcgatgttcttgcagagattgggcagatgtgaattcaattcaggcgaccgatcgatcgacggcagccatccagcactgcatcatctagcatctgagtgagatcgatcgatcgatcgaccagaaaaatccccatgtgacaagaaccaatccagcgattgcgatgtccacagggatgaagacgtcgacgcattatcgtctcctcaaagattcatgcattcatccatccatatgttcgatgaatcgatgtctctcgttcaagattgcatccatccatgcatgctggctctctgtgcagtcattttgcctgcagtgcaggacgcgtttaggagaggaggagatcgacataagctgtctttgagagggacatcttgtgttttcttctcgttgtttagggcgcgaacgcacgatcaagttgtctagctgcgacgtgcctacgaaaaaaaatgtaggttttcaggtgagaagaatgagataatggacggctccggaaattgcggtccgggcatacatatagctgggtttgtagatgatacggagtcggttgttattcaactgccagttgctaagtgactgtaggcccgttgaatggattgaaatagaatcttgattcgttctttgaacacacgcacgtaaaccctacccggcaaatcctgtacctcacaggtacctcactgtcgacgggtacgtcgcctaacactgaaagcacaacaccgttaaatcctagaaaattcgctcccatgtcaacgccgttaaatcttggaaaattcgctcccatggggggtcgaacccaggaccttaggtgctactgagacttttgtaaccactaggctacatgccccttcgctttttcccaattattataactacacgatagcacaaacactgccgcgttttggagcctcataggcatggtttaattattcggtttggccgattctatcataggtcaccaatataccgaaatcttggaaaattttgaacaaatgttggtcaatttttaacaaaatattaccaaattcaaaaaaatgatggccggaataatatcgtattggaggtccgaaatgaccgaaatctccatctggaattttaaaaaccctgcccatcggttgcttattggggaataaaaattaattggtaactaaatttttttacgtcaagtaagtaaaatttttatatatttattcataacgatttaaaagccaacgctaaaacaaaattacgtggaaaatatctaaacatcaactcgaaatcaattttgaaaattttaatttttgcttttgttttggcttattagaccaacccatgagtctcttaattgcagatgttggaaaatgttcgagatttttagtcttgtgtcaagataatttttcaagcttgtttagaacttggaagcgatggatttgacaacagaaaacataaagattctgttctaaaaaaaagacgatataaagattctgcctgaatgtagaattttcctaattttgagtggaaattattgagctgctttgcgtaaattcattacgaatcctactacgacaaggtgacctttcagtaataatcaaatgggccacgaaatataatcttgatctgggcctaaatttctattgtatcaccctcttaaagcccagtttaccaatgttgacgagcccaacaagccataaattaaccatcggaaagtagcccaattaagaaattgcggaaaaaaaggcccatcccagttagcccattctgaaccgcactggtgcccactatataatccccagccacacacttcttccacacttcacgcacctagggtttcgccgccgccgccgccgcttcttcgtccccgccgcgacgatggtacgctcctcgatctcgcgctcttctctcgtcgaatccattccggccgaccgaccgacgtttcgttgatgtgattgcttgcttgtttcgtttcgccgcagccgtcccacaagaccttccgcatcaagaagaagctggcgaagaagatgcgccagaaccgccccatcccctactggatccgcatgcggaccgacaacaccatcaggtgatttattcttcgcgctcagtctttgctcctcccgagttcgattcggcttaggcatatccgctgagatgtcgtggtttggtttgtgttgttcaggtacaacgcgaagcgcaggcactggcgccgcaccaagcttgggttctgagcaggaggtagcaccggttgctgcctgcggaggctagggttactgagttatctgcatcattttgttttatggatgtttcagtgtttatgcaagcttaggatgtgattccaggatgctttttattaaggttttctgaaatgttaagtgtagttgtactctggtttactgaggataccatgctatgctgtgctgagtaaaggaaccattccaatatatgtcttttgaagttatttcacaggcttattctgtttcatttttaaatttgttattgcatagctggaggggtgatttgttctcaatatcgttggaagtatgattgctccattgttattctattgggccgttgttagagtatgattgctccattgttattccatcctaccaaaagcattccgccacaaaatatagcaacctaggattggattagatgcggggtttgtctagatttgttggactaggatgtgtctaatccagttataggttgcaatattttgggatggagtgggatccttaggcaggtcaagctgttgatagtaattcttttgtatgtatggagtttacgtggattacgtggttttgcaatggtccttctaggaaacaaagctaatattgtgcttgtaccaattgtatgtatggggtttatgtggattacgtggttttgcaatggtccttctaggaaacaaagctaatattgtgcctctaccattggtgcaatgctatgcaattgaaactaatgcaacttattttctgactgttataatgttgcaaattgtgattgtctacgaattggcaaccatcactctcagatagttacttgatctctttattgaacagtggcctcatttgggactgtttgaaacagattattcagctgattatctacttgatcatagggatgaatttaatatttttagaaacaaaatgaacaaatagtgtagaacatgagggttacacaatgcagtaagttttttttgagaaagcatatttttagatgtgtggagcaaacactccacggccataatctgcaggagtgtacatttttggtcgtacaacagtagtgttaccttttttttttttgctgtgttctacttctatccatgttaaactgaatgtagtcaattcatgtgcttgttaataccaacatggattctctatcaatcatagaagactttggttatgtttaggctttatatttccatgctgtaatgcttgtgttctgttgtgaactatggttatttgaccgagacacgcactaaaggattgtttatgcttgtttcattggtgttctattctacttgagaatacatggatataatacatggcgatgatgcttttttttggttggatggtctgtctaggttcgtagctcagaagagtgtactagcttaaggatggggtcttgtttgtcacagcagtgcaaggtgtgttttaggtttgggttgactgtatgattcaatgcctaaccttttatgctgaactcgatcatatggtttggctatgtttgtatgagactacatgctagttcattactgtgaattatatgacgtacgaactggtgtaaatgatgtcattattgattcgtctactaagggccaagtttgggacttctgtccatttgtcttacagctcagtttgacatcaatgatctgtccattaggttttatgccaagttacatactaataatcttgcctgagctgtgagcacacttctacatttcggtgccgaatcatttcgttctctctgttgagattgttccgactgatgtttcattccactggcctttgaattagacgccgactgcaaattgatatacacatcttgctgcgtaagacgagtttacgtttgcctttatgagcccaaggtcacgtttgccatagccgcatgggttgtctagccgagcccacgaggaaattttatggccgcgacaaaatctcttgtatgctaagtgtattgccatcaattattgaaagaagtaagtcattgagtgattactcattaatttccctttaaaaggctattacctccgtcctaaaataattgtatttctaagattcaaaattcgtcccaaaataattataattctagagttctaattgtcccatcgatctcattcaaatttctccttattttaccatcaaccatcttctcactctcatataaacactatttaatgagaggtatcatatgctttcttctcaaatatttatatatgctaaataacatagaattacaattattttgggatggacgtagtattttattgtaggatgctaagtgtattgacaccagtcgcttagggtatcgggcgaacgtacgtacccacaagcaaaaaaaatcgcacctacactcgtgtgtgtatccggcggatccatcgacaaaaaatgccatccctatatatcctggtacgtctccttggtgcaaggccgtacgataggaacgagtttggaaaaccgaagacgttggtctgacacgtagacgactccggaacgaatttctccgtgtcgtcccgtcgtccggccgcaacaaaaaaaaaaggtttgaaaaccaaaagacgttgatctgacacggtagacgactcgggacgaacttgtccgtgccgtccggccgcaacgaaaaccaccaaacgtgctgcaatgcatggccattggccagcaatcaagcctatccggtgggtgcggacggacggcaggcgcggcgaacgggaggccagccgcgcgtcgcgcccggggagacacgcatgcaaatccaaagccgctagtggagcgcgcaacgttgccgagtccccgctgcttataagaggcggcgaggcggtgccacggccatctccgtccttccatcccagccgcgcgcgcgcgctcggactgacccccacccccaccgaggcaaagcctcgtactccttccctccaccaccaccgcgcgccgtccgcgcggctgcggctgcggctgagggcgaagccctccccctaccccnnnaccccaccccacctcatcactcaccaccaaactaataaacccgtcctcccctcccccccatggcctccatctccctcgaggacgtccgcaatgagaccgtcgacctcgtacgtaatatatacagtcgtgcaattcttttgtgcgttcgttcttagttttttttcttgttttgtttgtttgtttgcaggagacgatcccggtggaggaggtgttccagcacctgaaatgcagcaagcaggggctgtcggcagcggagggacagaacaggctcaacatcttcgggccaaacaagctggaggagaagacggagagcaagctgctcaagttcttgggtttcatgtggaatcccctctcctgggtcatggaggccgccgccatcatggccatcgtcctcgccaacggcggcgggaggccgcccgactggcaggacttcgtcggcatcgtcgtcctcctcgtcatcaactccaccatcagtttcatcgaggagaacaatgccgggaacgccgccgcggcgctcatggccggcctcgcgcccaagaccaaggtgctcagggacgggaaatggcaggagcaggacgcgtccatcctcgttcccggcgacatcatcagcatcaagctcggcgacatcatccccgccgacgcgcggctgctcgagggcgacccgctcaaggtcgaccaggcggcgctcaccggcgagtcgatgcccgtcaacaagcacgccgggcagggcgtcttctccgggtccaccgtcaagcagggcgagatcgaggccgtcgtcatcgccaccggcgtgcacaccttcttcggcaaggcggcgcacctggtggacagcaccaacaacatcggccacttccagctcgtgctcacggccatcggcaacttctgcatcatctccatcggcgtcggcatgataatcgagatcatcgttatgtacccgatccagcaccgcgcgtaccgcgacggcatcgacaacctgctcgtcctgctcatcggcggcatccccatcgccatgcccaccgtgctgtccgtcaccatggccatcggctcccaccggctgtcgcagcagggcgccatcaccaagcggatgaccgccatcgaggagatggccggcatggacgtgctctgcagcgacaagaccgggacgctgacgctcaacaagctcaccgtcgacaagacgctgatcgaggtgtacgggcgggggctggacaaggactcggtgctcctgtacgcggcgagggcgtcccgcgtcgagaaccaggacgccattgacacatgcatcgtgggcatgctcgccgaccccaaggaggcccgcgccggcatcaaggaggtccacttcctcccgttcaaccccgtcgagaagcgcacggccatcacctacatcgacggcaatggcgaatggcacaggatcagcaagggcgcgccggagcagatcatcgagctgtgcaagatgagcaaggacgccgagaagaaggtgcacacgctgatcgaccagtacgcggaccgcggcctccggtcgctgggcgtgtcgtaccagaaggtgccggagaagagcaaggagagcgagggcgagccatggcagttcgtcggcctcctgccgctgttcgacccgccgaggcacgacagcgcggagaccatccgccgcgcgctgcacctcggcgtgaacgtgaagatgatcaccggcgaccagctcgccatcgggaaggagacggcgcggcggctcgggatgggcaccaacatgtacccgtcgacgacgctgctgggcgacaagagcagcgagatgagcggcctccccatcgacgagctgatcgagaaggccgacggcttcgccggcgtgttcccggagcacaagtacgagatcgtgaagcgcctccaggaccggaagcacatctgcggcatgaccggcgacggcgtgaacgacgcgccggcgctgaagaaggccgacatcggcatcgccgtcgacgacgccacggacgccgcccggagcgcgtcggacatcgtgctcacggagccggggctcagcgtcatcgtcagcgccgtgctcacctcccgcgccatcttccagcggatgaagaactacaccatctacgccgtctccatcaccatccgcatcgtcctcggcttcatgctcgtcgccctcctctggaagttcgacttcgccccattcatggtgctcatcatcgccatcctcaacgacggcaccatcatgacaatctccaaggaccgtgtcaagccgtccccgaccccggactcgtggaagctcaaggagatcttcgccacgggcatcgtgctcggcacgtacatggcgctcatcaccgccctcttcttctacctcgcgcacgacaccgacttcttcacagtattacaaaacacatagtacattttatacgttctcttagagcagagcctctttgattcctttgtatcctcctattataaaatgactggaaaaaaaaacgcaggagacgttcggggtgaggtcgatcaagacgaacgagaaggagatgatggcggcgctgtacctgcaggtgagcataatcacctgggagagtggtgggctctgcccccttcccgctgtttggagtcgtagtatccgagtcttttttttttcccttggtttttttgtttccctcctcttttgatataagtcggtctggtttagtgcgttgagtaacatatattcttttcttctgatatattgacgtgcaatctttttacgtgttcgagaaacaaaggtgagcataatcagccaggcgctcatcttcgtgacgaggtcgcggagctggtcgttcgtggagaggccaggggcgctgctggtgatcgcgttcctggcggcgcagctggtggcgacgtgcatcgcggtgtacgcggagtgggagttctgcaagatgcaggggatcgggtgggggtggggaggggcgatctgggcgttcagcgtggtgacctacttcccgctggacgtgctcaagttcatcatccggtacgcgctgagcgggcgggcgtggaacaacatcaacaacaagacggcgttcgtgaacaagaacgactacgggaagggggagcgggaggcgcagtgggcgacggcgcagaggacgctgcacgggctcaaccagtcgtccaccagctccgacctcttcaacgacaagaccggctaccgcgagctctccgagatcgccgagcaggccgcaaagcgagccgaggtcgccaggtaaaaacttgctctatcccatgatataataatggcaacatatcctatgcacacaggccctcacgtgtacacacgtgcacaccaactaaaaaatgtcaccaaaaaatctagaaaaaatcatacacatactttcaattgtattacacctaagattaaaatcttaacgtcaaattcattatattttagccgtaacaaaaaaaacaaagaatctgacagttttaaggttgcaattttgttagaattttatcttttttgttattctctatgtagaataaatttgaagatgcgactttgcacgtagatgtaatactattgaaagtacatgtatgaatttttctaaaattttttgtgataatttttagttggtgtacacggtgcgtacacgcgagggcctgtgtgcataggatacgctccctataataatacagtactccctatgactcccttaacttttttatcaacgtttgatcatttgtcttatttaaaatatttatgtaattatcatttattttattgtgacttgatttatcatcaaataatctttaaggcatgacataaatatttttatatttgcacagaaaatttgaataagacgaatggacaaacgttgtttaaaaaattaacagcattatacattgaaatacggaggtagtacatagataagacattatctagattactactagtagaatgtcttgtccggtactacgcttctatattacgggaccgatgtagtacattctctgtactgcaaccaaccaatgttcaactttctagctagcacactgcttgatttctcatctccatggacagactgagggagttgcacacgctcaaggggcacgtagagtcggtggtgaagctcaaggggctcgacatcgacacaatccaacagagctacaccgtgtaacatacagcatgccatcgatgtgttgttgttgttgttcatacctgtgttttactcctccccatctgcaagttatttggagatgggggtttcgacttgtgttttgacatagatgtttcttcccttctttgtattttgttaacagggaatagttcccgatacaacaggtggtgcacttttgagtatagtcaagttatttgtaagattttggctttaagccggtttttttggcaatgttattgttcccattgcagatttgcagtctatcaactttgcctcaactcagtctgtatactactgtttagtcaatcatcatcagttttgacccagcaaaaacatgccctgattactcagctgaattctgctcctttaaattcttgtctgggcactgcagaatattagccatttatatccatgaattaatactgtagtttaatacattagccatttcagaaccctggttacatggtttcactacagttacatctttaatactgtagtttaactacagtttcatcaaggacggagtgcatttcttctactcttgcagattacaatggtcatgtcagtgatcaaccgaaactcaaacatgtccttgtcttctcccagagattacagtttcagtgaactcatagccttatacagtctgaatagaagttgtcctcgatttataaatactccacagttcacctcaagccttccggacaatgacatggcgctctctcttgtactccacttcatccctttggtgcatgatcagaagggctcttcgcacctgaagcagccgaatggtagcataagaaaaatgatactaaatcaattaattaaatagcaaatagtatgacaggttcctcacaatggattcattcatccccatcctatttagttcatcgatcaggcgtcgctcggatatgtggcttccaattcccatccttctctttatttgtgcctcagcttgctgttggaacaaaatgggcaacaaaattcagaaaacaaagttgacaagttggcagttcacttttggatgggaagattaaccttgatctcatttgcaatatctggtgataggttcaaatgctcattgattccagatcttgcggcatcaacagtggagacattgaacagcctaaatgcctcttcaacatgctctggtgtagccacacttgtcctgataattattcaaagtgccaattaggaacattataaaacatgtaagttatgacccactggaaataaaagccaatatgtgaaaaatgtaagatataaatatactgctagttgagctactcgcaaaaagaaatgtcaaatgtatagtaatgctatattctcacaatctcatctttgcaagagattcactcaaacgtataatggcttcaagctgccgcacagtgatgggtatagctgcagccctccctgtttcatgagcttgttgtctcattttctgcacaatgaaaaaaataaataagtagaacagtcttaataacagttagactaagtgaaaaatctttagcacgtgcctgtctaatctccacatatttgttctgaagcatctctgctgccttttctgagagtcgtggtttacaagtaacacggcaatactcaatgtacctacacatgtgaggattatgcatttacaatccaagaacatcatatcaaaactgtgtagtatgtatatcagaacatagaaggccaaccacacctttttagccaattctctccttcactagcatctgtattcttggatgaagcagcagcaccactggcatgcaccttaatgatgtggcttgcaattcgctgcaattggaagtttatttagtctctgaagcacatcaatgagctggacaaagaataatgcgtcataccttgtcttgatcatacattctgacatctttaacaataaagattagatcaaatctagaaaggatggttgtctgcagatcaatgttatcttgtgcagtctgaggagtagcaatagaaaatgtgtcaaactgattgccttgcatataaggctagaactgttaatacattttcaaaatatgaaaatagtacaagtcaataataaaaactttgactgaccttaagatcatcgtagcgccctgcaattggattggcagctgctagtaccgaggtccttgaattgagtactgttgtaatgccagctttggcaatcgagatggtctgctgttccattgcttcgtgaattgcaactctggaatcacagcataaaggtaactcaatatggtttcaactttgaagagtaaggaaaaattacatgtgcaatgcttattttagtttctagaaagaagactatagatcaatgcttaccggtcctcaggcctcattttgtcaaactcatcaatacaaacaactccaccatcagccaaaaccatggcccctccttccaaataaaactctcgctgtacagggaaaataagtcttttagttctaggaaacagaactttgagtaaacacaataatccttgcagggaagacaagcttacagagctaccgtcccgaattactgacgctgtgagaccagctgctgatgaacctttcccagatgtatagacagcaatcggcgctgtcttctccacaaacttgaggaactgttggaatgtacagtttcatgtcactggactagagataattcatttctaatagcgaaaaaacacttgcctgtgattttgctgttgatggatcacccagcagcaagacatgaatgtcccctctcaaacggacaccatccggtagcctctgccatagaagaaagtttagttacagctcattccaactagccactggatccaacacaactttgtattttcacatattagccactgataagatcaaaaatataccttctttgagccaccaaacagcaagcatgcaatagctttcttgacatcagaatggccataaattgaagggccaatcattgagcaaatcttgacatatgcatctggcctctgtgcaaattctttgaattccatttcctacaaaccaacaagaaaattaacattgtaaatatgctgtaacactcttaaaaaagaaacttggaattttggcaaagcaatctacctcatcaagtgtaaaatttgagggaccattcgagttggcatctcgggactgctccaaccccacaactctaatgtaaggctgtttgactccaacagcacccttttggctgcaaaatgaatatttgagcgtcatcagctatgcaagtagtctagctcaacaaaatggaaacaaactgagcagatgttttagatccaacatactttgcagatgcttggtagacactgtagataccaattacagttaatctagttccaggaacaatggtctgaacaagatgcctgtctacggacagcagcatattcctcgggagctcaccagttggaacatcctgttaaccaagtaatatacagcttggtgattgctaaatcctaaggacatataaccaataaacctagaaaaccatagcatcgcagcgaggacatataatgcagtaacaaacctcaggattttcctgcaatttgagggtctggagatccacatacttgctcttatctggaactgcaatccaggggtccaaggggcaaggctcttctccaggctgaaaaatggtaaagaaaactcactcatatacatcagaattaaaacacaaacaagacaataacccaattatgtttagccggagttagacctgaggaacatggtcgcacgatcgtgggacaatagccccaccaaggccaggcctacacggcaccgttttcacacttctgcagttcttgcagagcagcgtgacatgagtggccttagctttcaccctcgacgcggcgattgtgatcccggcaatcttcaccagcttggacatgtaatccgcctggaatttggaatacagttgtgtcaatttgaaattcttcacaaggctactaacaaaatcgtttcagaactgaccccaatagacctcatggacaggcagttctcctttgaggacaagaagatctgcacgtcgccggtggcgggctcctccatctcgccggtctctccagcgaccttggaccgaaggctcgcgaggacctcggacgcagccgtctcaaactacacaaaaccctaaatcttaacacaaaaaattgacatcaacagaacccagagccaacaaaaattcagaaagaaccagcacacaccagcggtaggtaatcagcgggagacttccggatcttgtcggacagctcggcgtcgaaggcgtcgaggtcctcgatggcgacggtgacatggtcgcggttgtgcaccaggctctcgctgcaaccatcaaacaaaaacacactggattggtcagagcgaattcgaccatccgacgaggcaccagatctgggagggagggggggcgcaccggtaggggaagtcgccggttgggccggtgaagccgcggaggaactccttgaacttgcggagggcggagtggcgggtgaggtcggcggaggggtcgccgccggggccgccgcgcgggaactgcgcctggtcgctgtagaagacggcgccctcgtcccaacccgacatggctggatggctggctggctgcggcggcggcggcggcggagagagagggagagagacgcgtgggtgcgcgggcggcggggaaaggggggaagacgccggagaagtggcgggaagagggtaatagaggaggagatttggcgggaaactgggggagatttggcgggaaactggggaggtagggtagggtaggagaccggagaggcagctaggcaggccggtttttgtgggcctgggctctcatagcagggtgctaaaggagtagaatgtgccattttggcccaaaagcatggcgatttgccgatttttagagtaaaaagtatagttggggtctctcatttttttgtcgcggagttataaaaccgtcgttgaaccgtaaaaccacacacagtatatcatataacttataaaaccagcgaaaataagatcccttgacggtattgtccgtagttttgattgatgtgatgcctacgttgctcctttaactaggtttttgtctcacgtgatattgacgtgacgcttatatgataatttgatcccgaaaaaaaaataaaaagatatgacttgaaaaaaaataaaacataatatgcggagccatatatcagtcaaacaaaaaagataaaaaatagtgggacccactaacccacttcctccacctctatctcctctcttcgccgacgagccaaagctatccggagttagtgcggaggcctgccaaggggacggagagcccagtgagtgtgcacggagagagaggaagcaaagaggccggtgagggggcaaaattcaaatccatcgtcgcccaacactacatccaccacacggatatggaggcggcgaggaggctcctccaatgaagagtggcaagtccaaattcgccgttgccaacatcacctcaactgcatggagagggagaaggcagggaggccaacgagctcctccaagtctaaatatgccgtcgacgacaccacctccaccacagtcgtcgctgccaccaagcacaggagagaagcaagatggcaactctgatgttgagggcaatctcgaagctgtctcaccgcttgctcagacgacgcatgccaccggcttcggtgccaagatcaacgacaacgacggccaccccgctgcatctagagaaggagaggggagaaggggaagaaggccaccggtcgcatctgcgagggaggctgccatcctcaaaaccaaatggttttcgtgaaaacattagatcttggtttgtaaaaaaaaagagtcggttgatattagccaatttttatataacgtgcgtaagggctggtttagatggcaaaattttttattttggggtgtcacatcgaatatacgaacacacattcgaagtactaaaacgttgtctaataacaaaccaaattatagattccgcatggaaactgcgagataaatttattaagtctaactaatccatcattagtgaatgtttactatagcaccatattattaaatcatggtacaattattaggtttaaaaaattatcttgtaatttacacatgtaattgattttttattaaaccacgtgatgggtgtaaagttttttttgttctggtaaaaaaaccaacaagcccccacatcccaccgattctgaattttcccaggaatctgagcggccgcaaggcgtcacgcgaaacccgtccaacccaactccactccatcctctgcagccgcagttgtgacggagactccaaggccatcaccatccacccgctctcctcctcctcctcctccgcttgatccctccatctcctcgatcgatctccacactccactgcgcactgcaccagcaacgcccccccctgatccctctccacggctgcaccggagatggcttccgcccccttcgccgtctcctcctcaccggcggcttccgccgtggccgcgcgctccaaggcacgggacactcgtcttactcatcttctgtgtttggtttccttgatttggatttggattttttttttaattaactcatgccgcggttcgttggtgctcgcaggtgttgcgaggagggaggagcgaggcgaggactggatgccgcctggggatcacgaggaaggtggtcgcctgtttggattatgatttctgcctctagcttgtttagttgatggtttgttttggatggacatgggttctatcgtctatcttatctgtgatttaatagtgatactgattgcttcctccctcgattagaaattatggtttgtttggtttcactatgaatgactacctgtcagttggcactgtgatctcttttacgacaataatagtaattcacgattcaggagtttatctgctttttgggtatgatatctctgctaatttaatgctcctggagctcttctaatcagggatgggtggctcttaattaaggttttgaatccatactgtcatatgttgacacctaaaagctctttgatgtagaaaataaaatcgaaatgatatatagaaatcggttgagacttgagaacacgcagctgctgaagcatgactaattatcaagctgctaataaaatttggcgatggccttcattggaaaggcatggtgttttgatcctgtaacggaattctgatattttatgtttgttaggaactctcaactcttgagaaatataaaattgactgtatcgagatttattccatgtcaagcttcagcatatggttgtgctttggattaacatcctttcattgctattctgttgcagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggtaagtctaataatacctatcatttccttaatataactcagttcttgttgtgacacactattcttacacgtggtaggctgaaactcttatgttggagaaaggagaaaacaaggaggtatggtgtattttccttcaaattcaagtagctggattataaggaattatttctggagttttctgtatttctgtttctgaaggttgatgacaaaattatgttttttttggtgcagtatctgccaattgaaggcttagctgcatttaacaaagcaactgcagaactattgtttggagctgataatccagtactcaagcaaggacgtgtatgtgctgtggcctatgcagctcttgctgtacttattttgtaaatactaagattttctggaatgctgctacagcgaagcatgtccttatatttagtaaacattatttaatgataattccttctgtaggttgctactcttcagtctctctcaggaaccgggtcgctgcgccttgctgcagcatttatacaaagatatttccctgaagcaaaagtactgatatcatctcccacttggggtatgtatgtgaattaatgtgcttaatctttgagcattcaacttcatttttcatagcagagtgtctcattggcaaactttgaactccaatctatattcttacaggcaatcacaagaacattttcaatgatgcaaaggtaccttggtcagagtaccgttattacgaccccaagactgttggcttggattttgagggaatgatagctgacatacaggtcgtgttttctaactcatttatattcaatactactatctgtgttttctattttaaacttgatgagcattgtttagcataactttgtcgttcaaattggcatgtatccatcatagaaatttacacctgtcacttgtctgtttactattgttaattgtcaattttctgtttactattgttaatttctatgtgttgagtattggtttgtgatattgatttgtgtgtccaataggctgccccagatggatcttttgttctgctgcatggttgcgctcacaacccaactggaatagacccaactccggaacaatgggagaaaattgcagatgtcattcaagagaagaaacacatgcctttctttgatgttgcatatcaggtgaaatgttctcactttattatttcgtttttctctgcatgaaaacaaatatcttactgactagcaaatatttctctgcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacaggtgatactttaatctgaatgattgccttcgtagtcaaattgttcgtttctatccagttattgcagcgaatgttaataatagattattctgtttagtgggtaatatggaccaacctcttattgatgtgcaaagcaacttgatttttcatggtaggttaacaagacttctaagcaaatttcatccaggcaaaaaatgttgtaaattcttggaaattagtgttatgtacagattaatagacactagtttttactccagaaaagaaaccaccagcaacaataattggtctcaacccaaacaagcaaagcactgaatttgatgttaaccataaacaaaactccacagacaagatgtatacttcaaattttctcttaaatcaacatgtggcataagaaccacagttcttgatccacttcagtggtatacaacatatccagtgtggaaaatctcatgaatactggtacatggcatttactttgctttttatataagcctgcacacacacgagagtcctaggaccacacaaggacaacttaagatttgtaacgtgagctcagatttgactagcgctagttcatctagcccgtgtgattttacaaactcggtaagaaaattaaactatataactccagtttggacaaagacaccaaaccaactcatcatagttgattttcctggttggtaacttccctccttgatcctctcttgcttatcgtgcataccatacaggcatacacagcttccatgcaaagtacatgccatgtgcaaaaatgccatcctaatgtttgcaacagttgctttgtatgaatcaatacaaaatagtactcttactgtgacactgcaaagcttatttttaactgaaattcctttccttgcagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcaggtgacatatgctttaaattttcacagataacacttccattcttctatcgactggtgatttctccatatataatgtgactgcaaacactgcaattcacacaatacactaagtattcttaatttgattcgtttgtatttgcagagtgataatatgaccgacaaatggcacatatacatgacaaaggatgggagaatttcgttggctggattgtccctggctaaatgcgagtacctagctgacgccatcatcgactccttccataacgttagctagacgaggattcaggtcactgctattgtggttaatccttcaatatgctgggatttttggttccttccagcttgagttcttagccaggattgtatatccggcgctacgtaatttggagataataatgaattttgtctgtgcaacaaactttgcatatgctttgtcgaatgtacactggcactatgttagaagcttgaaatatcgaattgaataataatgagactagcaataagccaaactaattccaattttacctggtctgcatggttcattcttttatgctcattgctgacaaacaaaactggcccaagccgtgccatataatgggtctggttagggagctttgtcagctgcagtttcttacagaattaaaagctccctaaacagtttttccagaattaaaagctctcctatatagtttagttttccattcagattataacttcagattttaagaagttatagttatagaatctaaattgctgtaaatgaattaagaagtcagaagccgaaaaactcataatattctcataagctagctgcttctcgaaattaattttaagcaaagtaagtaaacccaatatcactgaccagcctaccaagcactcaagcagtacacaagcgcatgggaagcccaaagctggcccagccgcgacgtgctgtcctagtcaacacgactttgacccgttccattcttctcttccatgtgacatgcgaggatttcacttgacaaaaaataaactgaagggaaaaatcgaggaaacagggaaaaaatgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggttgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcatagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgaggtaaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaaatttagtgaggcctcaactacaagcaatgcaattatccctcatactgaatcaatactgaagattgagttaatgcaaaacgaaatcaagttggagggtgtcaaaaattatttgagttggtcaaggagggcattactaatactaaaaacaaaggggttagaaggatatgtcacaggagaagtgaaggagcctgagaacacatcaagtgtagaatggaagacttggagcactaccaactctttagtggtggcatggttgttgacttcattaatcccagctattgctacaactgttgagactatctctagtgcgagggagatgtggaaaactcttactaaactatactcaggagaaggtaatgtgatgctaatggtggaggcacaagagaagataagtgctttgagacagggggagcgctctgtggcagaatatgtcgtagagttgaagagtttgtggtccgatttagatcattatgatcctcttggattagagcactctgattgcatagcaaaaatgaagaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctacttcaggtagttttaatcaagcatttatgtctatgaacacttctcattcaagttggatattagactcaggtgcatccaggcatgtcactggcatgagtggagaatttacatcatataaaccatattcatttgcacacaaagagaccattcaaactgctgatggcacatcatgtcaggttaagggggagggcatagtgcaatgtactccatccattactttgtcatcagtgttatatgtcccttcttttccagtgaatttaatttcaataagttctcttgttgataatatggattgtcgggtttcccttgatcgtgagaattgtttaattcaggagagaagaacagggaagaaacttgggattagtatcaggcgtgatggactttggtacttggacaaaagaaggacaaatgaggatgtgtgtgcactaatggcttcaacaagtaaagaagtgactgaggtattacttttgcattgtcgactaggacatatatcttttaaaattatgagtaaaatgttcccggtagagtttagtaaagtggataaacatatgctgatatgtgatgcatgtgagtatgggaagcatactagaacatcatatgtgagtagaggacttcgcagtattttgccctttatgctaatccactcagatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcagtttattagaactgataatggaggggagtatatgaatagtgaattcggtcactttctttctttagaaggaatattacatcagacttcttgtcctgatactcctccacagaatggagtggctgaaagaaaaaatcgccatcttttggagatagctcggtcactaatgtatactatgaatgtacctaaatttctatggagtgaggcagtaatgacggcagcttatctcatcaaccgcacaccatcaagaatacttggaatgaagacaccatatgagatgatatttgggaagaatgaatttgtggttccaccgagggtgtttggctgcacttgttttgttagagatcatagaccatctattggaaaacttgatcctcgagctgttaaatgcatctttataggctattcatccaaccagaaggggtataagtgttggagtccatcagaacggcggacatttgtaagtatggatgttacgtttagggaatctgttccattctatggtgagaaaacagatataagctctttatttgttgatcttgatgatttaactagaggtgaccatgatcaacaaaaggaaggtgaaatcttgggtctcaaggagaatgaacaatcaaagggaaagattatggttggtgaaattccatgtgctataggtgatcctgtacaagaacaagaatggagaaagccacatgaagaggaaaatcttcaagtttacacaaggagaatgagacttccaacaactcaacaagttgaagttgatgatcaagtatcagatgatcttactcatgtgcaagtgtcttcggagtcagggggagaacaaatagaaattagagaagaagaatcaaacttgccaattgccataagaaaggggatgagaagcaatgcaggcaaacctccacaaagatatggttttgaaattggagatgaaagtggtgatgagaatgatatagccaattatgtatcttacacttccttgtcatcgacatacaaggcctttgtggcatctctaaattcagctataattcctaaggattggaaagaggcaaagcaagacccaaggtggcatcaagcaatgctagatgaactagaagctcttgagaagaacaaaacatgggatcttgtatcctatcccaatggaaagaaagtggtaaactgtaagtgggtatatgcagtgaaacaaaatccggatggaaaagtggagaggtacaaagcaagacttgtggctaaggaatatagccagacatatggaattgattatgatgaaacgtttgcaccggttgcaaaaatgagtacggtaagaactataatatcttgtgcagttaactttgattggccattacatcaattggatgtcaagaatgcttttctacatggcgatcttcaagaggaggtatatatggaaattccacctggatttgctactttgcaaactaaaggtaaagtattgagattgaagaaatccttatatggtctcaaacagtcgccaagagcatggtttgatcgatttaggcgtgcaatgtgtgctatgggctataaacaatgtaatggagatcacacagttttctatcatcatagtggagatcatataaccattcttgctgtttatgttgatgatatgattatcactggaaatgattgctcggagataactaggctgaaacaaaatctaagcaaagaatttgaagttaaggacctaggccagttgaaatattttctgggtattgaaattgcaagatctcctagagggatagttctttcacagcggaaatatgcattggacttgctcagtgacacaggtatgcttggatgtcgcccagcctctacaccagttgatcaaaatcataagttatgtgcagagtctggaaatccagtgaataaggaaagataccaaaggctggttgggagactgatatatttatgtcatacacgacctgacataacttatgctgtcagtatggtgagtcgatatatgcatgatccaaggagtgggcatatggatgctgtctataggatcttgagatatttgaaaggaagcccaggtaaaggcctatggtttaagaaaaatggacacttggaggttgaaggctattgtgatgcagattgggcaagttgtcctgatgatagaagatcaacttcaggctattgtgtgtttgttggtggtaatctagtatcttggaggagcaagaagcaaccggtggtgtctcgctcaaccgctgaggcagaatatcgggcaatgtcagtgagtttaagtgagttgttatggctaaggaatcttctttctgagttgatgttgccggtggatactccaatgaaattgtggtgtgacaacaagtcagcaatcagcattgctaacaacccagttcaacatgatcgaacaaagcatgtggagttggatcgtttctttatcaaggaaaaactggatgagggagttttggaattagaatttgtaatgtctggtggacaagttgctgattgtttcacaaagggtttaggtgttaaaaagtgtaatagttcatgtgacaagatgggtatgatagatatctatcacccatcttgagagggagtgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcaaaaaaaagtcgtcctccatctcaaacacgtttggtgggtcagcgtagcaaagcagtacaaccactgggttcgtagaatcgcgtacgtacatcatgcggtgcacgtgaggagaggaggcagggccgctctcaagtcggcatcgccctttcaattatcacacccttacgtgtcgctgccttttctttattttttttctcaccaaaagctgatgatgaaacgatacctctcccctccctcctgtcctctcctttcgcacccatcaccaccaccatacaccccaatgacatgtgggccatggagttaacgccgggtcccaccacgctgcaaaggttgggggccaaaggtgagagaggaaaaaaaaaagcctctccaccttctgtcgcctcgggggagggtactgacaggtgggccctacggcccgcgtataccgacgggttgttgtgcagcatccgagaagagagatcacgaatattggaaattattttttttggcatcgaccccggattatgcgagtgctttaggggtaagggcggaattaatttggtgggtggagtgattaatgataaggacgcgcccggggggtggggcccacgctggggaaaccgccttgtgttgcaggccgccggaacggcaacacacagctgtcgtttaggcccaccacccaccccacttacgcggctcccacggcacctatttttttcttttttttctctcgaattttatataattattttatttgctccttcaaaataatttatgcccctatttttccaaataactcaaaagaaaaagaaggtatactctgcgatggcaagggcgtgaaattataccaaaaaaggagggcaggagcctaatattgacaataattgagccgcccatgtcggtcatcacccaaaccgggccactcagcggtgcagcgcggggcccacctcccctccgagtagaccccacaacaacatccatccgtccgtgtaaagcaattcctgcatccgacggcgctcgtgcggccacgcacaacaaaaagatctcctcccccaacacccgacaagcccagtgtttttcctttctttcataaaaataaaacaaattattttattttattttaataaaaaggaaactgaaccacgtcgtgtggcactcgtactcatccatctccgattataaaagacgcctcttagccaagcgtttctcccccattgtgttctctccccccacccttccaatcccaatctcttctcttcccctctcgttagggttaggtttttattttctctctctcgatttctctcttcgcttccacttcccaaaattctcgagtcaaacctcgtggcgttcggccatggcgacggcggcggtgctcggatcccacgacgccctcgacaaccggatgcatctgggggccttcgccgtgtccccggcgtcgaagccgaggcggaggcggcacagcaaggcggcgtcgccgccccccaaggtggcggcggtgagctcgccgccggtggttaagtcggcggcgagggtggcgtcgcctcctcccaaggctgcggcggcggcggcggtgcctcaggggcgtcgctcgccggtggcgaggaagcaagggtcgccgacgaaggagttgccgaagcagaggctcgtgatgggggagatccggatcctcaagcgcggcgaggagccgccggtttcctcgccgtcgcctgctccggttgcggcgcaggccgcggcggttgaccagcgggcgccccgtgttccggctgtggcgcaagccgcgccgactgaccagaaggcgcctcgccccgccagatcgaagcagcagcagcacacggccgctgtgccgacgaagatcaagtccgtcgccgacgcgccagtctacgccggcccggccttctcctcggcttcgcctgagccgagctccctccccttcccggccttcatccgtcgcgccgaggccgaggcgacccgcggcctccgctgcctcctccgcatcggcgagctcccttgacggcctctctcaccgccgtcttccccggagccgtgagccgtgcacgctcctctcctcgtttctcctcctcttctctgatggatggattgcttggtggtttcgatccgatcgaaagcttgtccggatcagatcccggctgcgttccgatcaaactctcccggtattttttcagaggacgagtttgggggaacgcatctgccggtggttggatttggtagtggttaggttttcaaaagtttcgtggtggaattatgttgggggtttgcttctacgaagaacaacactaggttgattagttctttgtcttttgagtttggtttttaggtggtgtcttggttgggaaaaattggggttagtttggtggaaatttaggctggcttggtgttgctgatctgttagtacagcagtagtggtaataatagtagaggtttggttagatgaataattcgtcggtagtgattgtgatttgtggtttggtgagcgtgagttcaatgtcaggtgaagaatagtagcactaaattcgtgttaggtattatgtccagtgtcaaaggcaagacatatatagttcttattatcagtaattaagttatgttaggtgttatctttctgttcgtctgtaagatatatatagatcttatcgggtaatcaaatcaactatgtatcagatcctcgcagtggtgaatttcattcaacacatcagtggatgtttggttatcttcttttttttctcatgctgattagctgtggatttgtgttcttactttgtgcaagtaataagtagactacccttggattctcaacgaggttgcttcacaatcatcatatgcataccaagatttaattaagaactgccacttgttatacccgcagtttccgcttaagttccgctgtgtatttgttcttattcggatgataaactttgcttgttgatgtggtaatcgccaaattgcttaaattagtttgtgtacgcaaccgggtaggcggattgctggcgtctaatctaatatttcaacttgcaaattgaggtgcatcttgctttaatccaagtcctcttgctgaacaatttgctcagtatgatcgatcccagtagtagaggtgattatccccacctgatgttttgggtacgtttcagatgggttggggcgatataggttctcattgcgtatttgcaaacgataaataatttgtaattaaaacttctaaataatttgtaattaaaaatttatatacgtcgtcttagttttagcgatctaaaaatagaaaataaatttagataaaaaaaaccttaaaatcaactttaaccataaacttaaaatcaacttttaacctaaaatttaaattttggctgctaatcataaacggaaagttggtgctgataatttctgagagttcaatacgaaattgatcgctcaacttgatagggtcaggtcggcgacccaccggaagccgctggtagttgagatagctgaggtcaatctctctcctggcagcgtgtggtggcagactcgcccgaggcatggccaggaagctgcatagcctacgtcgtttcgacgtggcactcgccctcgcacgcgatgcagccacagcctcttgagtttcggagccacacaagcgatgagccgatgagcatgtgagagctgatgagttaaatttgactccgttcctattactgccaaaaacaaccttaccaaaaatttgtgaatgtcaaattttaattaagttggcagaattaccaaatttagtaggatggaattatgttgtgccaaaaaattttatatgttaccaatactagtatttaagtaacaaactaaatgtatctatatatttaaattttatcaaacaatgatatgatttaaaatgaaaccaatctaaaccggccctttacctaaagttgggtctactttgacggagttcttctgcacacggtaaaatacggtggcttcaagccttggacgtgtaccagccaactactagtccaaccacgactgacggcacacggcacggcatggatccgtgctttggtcaaaaagccgagtcaacgcccaagacaaa

SEQ ID NO: 78575 - DNA, 48530 bp, Oryza sativa
  unsure (1)..(48530): unsure at all n locations
cgtacgacgagcaggaggactacgtcgtcatcaagcacgcggcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatggtacgcaccaaaaaaacatcaaactcttcaccataatctctcccccgttcttggatttgaacaaattcgttgttgcagggcccgacgttcggagccatgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcctgagcgaatagaacagggtaaaaaaaaatccgcaagacgtggtggtgacacggaggagttggggacgagaagaagatgtggactttcccctgtgtttttttttcgggatttgcattgatccccttgtttgttttagctctggatgttgattagcgtcttgttcatagcacttccactgccaccgtgtgtgtgtgctctgcttgcctgatgagggcaagaaaacttccatggatccgtctctctgggaggaatgaataaaaaggatgaggaaataaaaatgattcagtgccattatatttgttggtcaggttgatgctaatatgatggctgcatgtttttatatgtggacactggacagagtgagaaactctgttttgttttagaacagcagcatgaccacatgaccaagaaaatgcaacagctcatagaaaatctagccagaacccataatatctggaggcattcagcatttctattcactggaaatatgtcgaaaaacaaaaggtccagttaatcagtcactaatgagaacggtcgatatagaaagctatcaagagcaaagccactggccagctgccctgctttcgagtccttctcaaatctcaacagtggttttctcaccattttcttctctctctcaataattgatgctaaatcccttcttagtatcacacatttatcagtttcagaaaaaggaattaatcagtcactaatcaggtttagaataaggttatagcaattttcattttcacaacaatgttagccagagcaacctcagcatgtctggagctagtgggatattccagactattcgaaatttgatattggtgacaaaggcatatctccatcattgattcctttccaattcgttttcgtttttggcacatacaccaacagtttcctggccctaccataccattttgtcacctctgtacaagaacagacaagcagcaagccagcaaccatggctgcgtggtcctttagttcgagaaatatctctcatggaaaattctttctggagtaaaaaattttcattcttagcaaggtagtatattgttacggcgttaccgcaaaactatcacacgtcacattgaattggtgttttgtggccgaagtagactagatgggctgagttaagaccaaactaccgatgggtgatggcccatgagttgatgtgatccaactacagcccataccgtgtgaagggcccttggatgacaacttctcaactggcccaacgtccatccacctgagccttgaactgagaaccaaagcccgtttggttttggttgcatctagctagccatctatcataggcccaatttatcaaagttgccaaataaaggctttgacccatgattagagtgtagtacacctgaaatcggagggacaaaagtatggcgatatcatggttgcccaaacggccgaagtactcgcagttcattcaggtttctgaacccccccccccccctcccgcgctttactcgtactgtaccaaatatgttttctgagaaaaaaattaagtgcaaacctgaaaataccgcaaaatctaaaaatgtacgtatgatatttatccatgttatcatagtaaaaagtttactcatagtaacgtaaacacatctcatatgcccttttttttaattgtacagtagtttccagatttatactacttatgtataggttgcattatatatatttttccattatctaaagaagagtgtactgtgctacagctgcacagtagaaggtataagaaacagtacacttgcaatgtactagtactaggtaggctggatttttcaccttttgaccaattaaaaaaactgatttaataaatagacccaaaaaacttattttaaaaatggaccattttcatggcgccaatgttattggcacgtggtctaacatctccccttgccctctagtggaagttaagtcactaatatgaaataggtcatattattggcgtcgatgacctatttttaattttttttaattacaaatagattttattgaattcttttacaaataggtgtcaatttcattagcgttgtcatgttgtaccacggcgtatgttggtgtcgagaaaatgtccatttctacaataaactttttgggacctatttgtagatattggtgaaaaattcagaccagatagatgtctacatgagttgtcctttttctttctcctgctgaaacatttttttttcctttactgcccctcgagtcttgagatatctcccttgtgcaacactgcaactgtgcaccacacgcagaagccaacaaatgctcctttattcgttgcgccctcgtcaggagtgtcggccgaggtcctacagccagacacgacccacgcaatttgcaagaaagcatctcttttgcctttcaagaaagggataaaaaggacagacgtccaaaagaaagggggtaaataaaaacgggacgtgaaaaatctaacagcattgccagtgtactgtaaaagatgacttacaagtacagcacgagtaaacgtgtagtacacgagcacggatcaacggtccggatgcatgagagcacgtggccgtccgatgaacaaacatgcgtgtggtttcaactttcaaacacggccccttccagtcatcaatgcatgaaataaataagggcttgtttggatcagtgccctactaatttttttagtgctaaaacatatgtaaattttggcactaccaattacttggtagaataaatttatattcatcttatttggtttgctattaaaatatagctaaattgtgatatcatagtgaagaaattttggcaatccaaaactgccgtaaatctggtggtctttttttttactgcgaatctgcactaggggtttcctgttcgtgctcacttcctccgtcacccggtctctcgcggcagagggcagaggcacagagggcaggttggttgggcggtgcaccgcctttaatcctcccttgatccccttcctctcctctcggctctcgcaatcaacagcagactgactgactgctcattctcactcgcatcaagtcatcaacagtcacatgccctgctagctagtaccaccatctcaccattaatccaccaccatccatgatccatccacagatccactagtacactcgtaggacaggagtatgtaacgtgcctcgtcaacacgacgcgacgaacttcatgtgacggccaccacggagcggataaaactgatgagaatatatatgagataccctgaccggtccaagccccagatctgatcgaacaccatgcgtgatgactgatgagtgacaacaactagttgccctccctccccataatataatccactatcgctccaactcaaaaaacggtcgcgataaacaaagggagaaaggcataaacaaagggagaaggcagctgggtttctcgatagaaaaagaggggcttggtgcggccgcgcgcggcagcagcagcagcaacggtgcgattttcaccgcaccacgccgcgccgcgccgagacggaaacagccggcaaaaactacacgcttcgtgaaccccggggcgcgcccaagccccaacttgtgtctttctttaggcttttttagtacagtagccacttcacatctctctcacgcctataatactacgcggtggtgcgcctcttgtctctctgtgctgctctcactatcgatcgacctctgctgctgcctcgctgtcctctgctacgtgagctcggccggctcgggtgtcgaggacgatcgaggatggggtcgctggggcggcggccgtgggttggtgggttgacggcggcgatgatttttgctgttgctgtgtgcggtttctgcttcagtggggcgtcggcggcggcggcagcgccgacgttcggcgacaacttcgagatcaccggagccgaggatcacgtcaagacctccgccgacggccagacgtggtacctctacctcgacaacaagactggtgagtgagagtagttcgagctccactccggcaatggctaatgctgacgctgccctgtttcttgggtttgtgtttcaggcgtcgggttccagacgaaggagaggtatctcttcgggtggttcagcatgaacctcaagctcgccggcaacgactccgccggcgtcgtcaccgcctactacgtacgtacgatgaactagctagctcgtcttctttgtgtcaactccgaactgaaactgaaaccgagctcctcgacgacggcgtaatctgcagatgtgctccgacgtggacgcggcgccgcagcgcgacgagctggacttcgagttcctggggaaccggacgggtgagccctacatcatccagaccaacgtgtaccgcagcggcgtcggcggccgggagatgcgccactcgctgtggttcgaccccaccgccgacttccactcctactccatcctctggaaccccaagcagatcgtgtaagtgatcaaccgaacaatagtaatcaagcttctagttgtttcaatcgtactccgtggccatccgggctcgccggagatagcatccgccgccgccgccgtcaacgacgacgacgactacgagttgaatgcgcccacctacctacctaccccttgaaatgggtcgctccgatggcgattaattgaacctgcagatattgccaaaccctgccgcttgtacgagcactccaggttgctgctacttggccacattctgtttagaaccaagcaatggctgccaatgccatgccaccaccttcgtcttccccgtgccgtgcccacccaaatccattttctgtcaattaatctcgatttctgatgttctttgcaatggtggtggtgattgatcatcaggttcttcgtggacaaggtgccgatccgcgagtaccggaactcggacaagcccaacaccttcttcccgatcatgaagccgatgtacgtgttctccagcatctggaacgccgacgactgggcgacgcgcggcgggctggagaagacggactggaccaaggcgccgttcatctcctcctaccgcgacttcaccgccgacgcgtgctcctggggcacggcggcggcgagcccgcccagctgcgcggcgtccaccggcaacagctggtgggaccagccgccggcgtgggcgctcgacgccggccagcgcgaggactccgcctgggtggcgaggaacctcgtcatctacgactactgcgacgaccgcaagcggttcccctccccgccggaggaatgcttgctccggacgaccagctcgtgaggccatcgccggcgccgccgccgacgtacatggccgtacgatgtgcggccaggatcggatcgtccttcgatcgtgcggctcagattcactgtaactactacagtactactatttttggattgggccacgtagagtggctgtcacgttggaaaccatattctttttggatgatgaaatggataaaattattatttttcctttgctgctttcagtgtacacgcatcgtagtactagcctgacaaatgacgttgtaaagcatgtgttagtgtgggggtaattttagtggtgatccaatggcgagatgacagccaagatgaagatcagaagatgtactacagtacagaggcatatgggcgaaacatgcgtccagatctcacatctcgttaggcatggatgtcagagaaaaaaataatgtttctctcctgccacagatctgggtgatgaaggtgaggataggctggaaaatgcatcatgatgtgacgagattgttcttgaaaaaaggaaaatgtgacgagatgttcctttcgtttggcgagcacgaatcggaagaaaaagggagatagcaaaaggaaaaggttactactgctgatgaagtgatgagcgatctgtgggcatctgcatgtgtgtgagaaaaagaaaagatggagagggggaaagaaagaagcatccaaaaagattgtgcgccgtttcaacggcaggaatgaccgtggagggccataatctccactctccagtgatctcgtgttgttctaacagagacataagctacatatttttggttttgttttcgtgtgacaaggattttatcctggcatgaaaatttgtctggggtttactgaagaaaagaatatgttggggtttgattcgcagtttattttgaagagaatactagtagtagatcaattacaagcacaatgaggcactgactactctgatggtcaccaggtcatgcagagagatgtcccagcgtatttgataattggctgacaacgttaacggctactacagtacgtggttaggaacactgattatcttaaccaaatcgatctcaccgtatttcaggggcaggaacacatgcagcccatgttcaagtcactgcacgcacctgcaaggattccacggcaacatcttgcactataatcttatctatctgaacacatcatgagcaataggttgtacacattgacagagaagaagcaccacgaaagtctgaagttgaactatactgtttgaccacctgtagcagcaggatgagcgaattcgggactgaaaaatgctgtgatgtactacgtgcacgtctgactgaacaggggacaagattgcatttgatttctcaaccttgatggtctggtcgtaacatcattttgtttgttgaaacttgggggaagaaatcactcaaaaaagatggtacacatacatgctgactgatgaaggcgacgtagaagcactgaaggcttcgagaatcagatccaactttctgaatcctgaacctttgtgatctactagtactacccatgttcatttctaacttacccagctttgtgaatcctgtaactactagtactacccatattcatttcgtacaatacactattactagcacgagtactgtacataaccataagaataaactcattgcagtacactggaaatatcactgttgaagtgccagaagtatcatgagatgtcctgcagacatgccggagaatgactcatgcacagaatgaagctagtgtaccgtacccagcagtaatgaaaaaacaaacagttcacggtctggagtttggatcaacagctagtactccacagtagaaggcatgcagcttcagctgacactactactagtatcaattgccatatacatatacagtagccagtgcatgccgacttcactacttcagcagttcagctatcgtccatgaaaaagaatgagaaaatgagcaatctaaaaccacaactcctggagctagctgaagcataactgtatgccggacgttggcccattctattccactcaaatcaatcaccataaaccgacaggttgatcaagatccaccttactcttcaggaacatatgaacataaaaaaatgcagaaaagaggacatccgtcccaaaaatataagggaattttgctctaaactgccaaaataccttatttccttatattgtgggagtgtgggacggatgtaagtattaacacaatcaggcaagcaggatagcgctctcaaagtagcatatattattcaatcttgatgaaagagggacacaagccatcatctatagtgatggtgcctcttacaaacttcaacacacgggtaacaagcatacactcaagagtcaagaggtggctaggttttgtgtgtacaatggaacacgcaggcatgtacacaaccaagtatactccaccccaaactatagtctttgcaatggttttggcagttgctcagaaaccatgaatcttgatgtgttccttcttcacaatgccggcctgcgggacatagcatgttacaacaagtcaagacgtattcttttcatacatcacagcatgtgtacatctaattgcagtaagcatgcacaagaagaatgatccctacctgaacaagaaaatttgatacgtttttcctctgatcaccctgaagttgaatgacctacagagtgaagcattgatcagaaaaactagctcagaaagatagaaaaacgtaaagatcaggcaccacaaatttcggttattacacacacctggccaagctctgggtcctggacaacagtaccattgcagcaaaactctttcttgagatctttgaggatcttgttgtagctgaattccttcttcaatccctggacagtggtcaggctcttacggccattacgctgctggatgcgtacatgaacgtagtcctttgatcctgcagccgcaccagagtctccagcattggcctcagcaaagggatctgtacatgttcaggaaaacatgatgagcacaaatattccaggcactcagaccatcacaaagagggaagagaacaacatgcataccgaaggcagttgggatctgaatgtcgagatcagacatgaaactttgctggtgaaagtggcaagctacaccaagaactgcacaaaggaaatgaatcataagaacaagcagtataactatcccgattacagcttcataaatttctttctgtaatcaagcagtcaaggaataaccaaaaagaaacttctacaggtagatacaagaggataatcgatagataatcgatgtgaatttgaaaacaaaattgaggacagttcatgccagactttcagctcagaataatgaaggggtgaaagctaataaaaaaaataatccaaatgaatactgcttatgctacagttcatttcatataattaaaaatggagatcagaaatcggataagttcttctcctgactaaactataggggtattacctataaactgaactacagctaggataacgctataaaagcattatttgtagcaatcaattcattgaactgaaccagaaagtgactttttaagatatttgggaaaaaaaattctgggactaaagcaaatcggaagaacagggaatcccctgttcctgaggattataactgttttcatgaatttcgtgatggggactactgtatctaaacaagccagctgcgaaattttggacaggcttaagaatcaatcattcaatctcatcaacgggaccgtcttcaaagttggattatttttgttcaatagggaataaacaaaggatagcttcgtcaaatcgagaagcatcactaccagaatcgaggaccaaacaaatgtactttattacaccaagcaaaatcaccggtgctctgattttacctcaaacaaaaggtactcacaaaatcgcaagattccgatccctaaaccatttcatttccatagagctctccagacgattgaaaaccatactactaatcaaaccgaaccgataacatgcaacatcaagaacccctctatcccaaatccaagaacaggaatcatcacagatacagatcccctttcctaacatcaaggcccgtactacacaacctagaacaataaattcaagaacaaccgaagggaggcacataccctgtgaggaggaggtggaggagggaagagatcgaccaagaactcgaccggaagatatggatcgaggaggcggtcgctcggcttctgctagtcgcgtgtccttggtgctctccctcttcttggcttggatgcctcctatatagagaggggaaaaggggggaggaatttatagacgggaggaggaggatgcttggttttctttgcctctcctcctctctcctggccgcaaagcctgctgttaaaaggttgttgcggacttgctgtcctccgttagatcatcgttttttgtgggttgttctgtgggcagccactctgttgttgcctgtgtgcccaatatgggagattggcgctcgcgcacgagcaaaattctttttttttttgtatgtgaaaaacctaaatagttcgtttcatacttttcatgctattctgtaaaattattttttgtattttagatattattaaaagtggtctggtgatggtggagtgcttgaattcagatattgctacctaaatgtattaaataggcgagtgatattagagatgtgtcgctagttgaacgtgtattgaggaggtgcactcacacatgcacatgagcacaaagtgtgtgcgtaagtaccttgcatctaatcgaaaaaagataaataataaaaataagtcaattgtctttaattactaaataaaaattgagatggagtaagacatgtccttaatgacgtgcgatataacgaatgcacaaactataaaattatataattatatgtttaaatctttgccgatacgttcagaatatcttcattctatttttttttaaaaaaaaatatctctctttacccattgagttcagctagaaagatttttttattcaagaagagtttgatgacaattatggctacctcgaataatttaacttcatgacagagatgtgaacgtatattctaagcaataatgatttcattttcccacttaattactaaggaaaacgaaactagtgtagcgactcttttttatttagcccgattgccactaaagtaggtggatgagtttttcttacatagttctagttatcagcgctacatatataaggtctcattttatatttagcacacgttccctatattgttagttaggacgtgaaaacggtgcggaaacttttcggattccggacctatttttgaaaataaaatctgtcggttggaattttctcgaaacttctgaaaattttatgactgaaataccctgggttcttttttttagcactgaacagtgaataccatggtgtttagatgttatttttaaaaaatatttgttatgcaaatctgaagttacataagaatttttttttcccgcatttgggatttatcaacagcattactctcttaaatatagataatttatttcatacattgtgttttgtgatgtactgttgagacttaacaattgaacttatataatttgtgttttatgatgaattgttgatcgttgaaacttgagaattagatttatcagtttgaggggtttttgtattccgataaatttccataccgtattcgcgtcggttcgtttttgctccgttttcggtttcaataatattcgattccgttttcatatccggggtttctgattccgattcagaaaaaaaaaatgaaaacgaaaatgataaaagttgttttcgtccgtttccgtaccgttttcacccctattgttagtgatggccagagagaagatagcttgtgtgaggcacaaagtaaaaaagcaatattgaactgatgagcacaaattaaaattatggttactataatccatgccattgcaaatttgttgaattgaaaaaatatcactactatccgttgatattggtcgtgtgccattggtatattttgtaaaaattttaatttctcaaattgtaagagaaaatataccactatatacggcccggacgtagttggacttgattttttcataccgtattttcgtataaaccaaaatgcccccaaaaccttataggctaactagtggaacccacatgtcaaccttatcttccctaacacttccactagtacagcaagactgacgggagtagagtggcagtggcgacagtggtggagagattgaaggtggtgtcagtggtggagaggtcaacgttggggcttgtcgatgacagcgacacgagaaacgaccaccgccactggggttgcttctactactgctcctcaccgccccaatctagcccgcctgcattgaccttgccgccacgttgtcgagaggctagcgatggggttttcacacgaggaatgctgccaactccctcgaactccgtggcagtgatgtggtgaatgggtcggtgctgggactcaccgacgataatgagacgaggaccgaccgccgccactggggctactattgctcgctgccacaatctagatgttgctgttcgcctctggggctgcaatctacgctcaagctcaagcacaccgttgcaggatctaccacaccatcgggaagccaggtgcggggacgtcatcactggtaagctctagtgccagccctccaccactgttgttgttgcagtcggaatcgtcaagctagaggaataatcggggaagaagataagtttaacgtgtgggtcctccttgtcagcctctaagggatagggagcattctggtaagtatgaaaatacaatataaaaaacttggtacaactgtgtttgggatgtatataatggtctgtttcaaattttacaaaatatcgatgccacctagccgatattgtgaatagtagtggtattttttcaatttatcaaagtacaatggcatatggatccaattaactttaaaattaaattcatattagaccacacctataatagaattcttaaatactctaacaaaataaaataggacattgtgtatgaacatatttaaaaatttgtttgtatttttaagtagagcccattagatctctctaggtacgaacatgcctctatttcgtaataaaaaaatagctataattattgcatagaaaatacttcatatttttttctcttttgtcatcgaagaagtagtaattccttccttcattctctttgtattaattaatgaaatgttgcttaactaactaaaactaactactacattcttttaggacggagacggatggagaaaaaaattacgaggaaatggtgacacgattcttcctaaaggaatgaagcatactacgtgcccgctacttgcagagaatccggaccagacgaccgacctacgctaatggtcattccaacccgcagcatcagacgcggtctatgccgggattacgacgaaacgtacgtgattaaaccaaaattaattatattaatcaatcaatcaatcccaaacggcaacggcgcatagcggagcatcgtcgatctcccgtatccgggaatcgatacgagcagccactaggcggggcccaccttggccgaggaggtgagagagcgaagccgtcgcgactcgcgagacgcgactgggagggatggatggacggacccgattcccccccggactcgcggttcgcggattcgagattcgcgacggtgacacccacccacccaccaccaccgccacgcggggcccccgcgagcgcgcggaccccgccgcccgcggattgataggggcgccgcgcgttcacgtggcggcgggcgggcgggcggcatcgcgttctttcactccttgcgttgcgtggggcggacgcgggtagcgactagcgagcgagacgtcgagacggcgtgcgacgtgtgcgcgcgcgcgtcgcgtggcgcgcccggctcgcggagggaggcaaaagcgagcacgcaccggcaccggtgcgcggtgcggtacgtgggctcttggtgcgaggggtcggcggggggcggaagccgtggtgccgtctcgtgtcgcgtggtggcccgttggtgggatgggggcgtacgtacgtaccacgcgattcatgcggtgcgcgcgcgcgccgtgtcgcttggtgggtggtggtggcggcgtttaccctttggcggatgcggccgagggaagcgtcgcacacccccgtgctcgtggtcgttcatacggcgggttggtgattgaatcaccgtgatttggacgaacgcttcgcatcacccgatcgatcaccgacgacgattctcgtctaggatcacaacaggacgacggaagcgagatcgtcgagtcaattgcccctattcttttacgcagtaccactaatttgctgctttcatggagcggctcaaggcaaggacagccgcaagaacaagcacgggggatttctggaaaaagctggtttaggtagcgtcctttgcacgttaaaatttcagatcgctatcgctggatgacgacggactgtaggagtactactctgtaaaagaggatggaggcataaacatcacgatcggaagcagacaaggcacacgattcgtaccaacaagaaagaaaatatcctgtgctcgtacaaattagtaatagaaatatctaatctctcccaggaaatagtactacttcctgctaatggttgagtagtgggcactgacaggcgatcagctaccggccttcttgttgtcgacatcggagcagggttagcctttcattgatcatatattgtccgcataccgcttagctaaccatggcgcggccagactgaaccatacacgtccttctttgtgtacctcttgtcccaagaccatgggacatctgaaagtaaaaaaaacatttctaagtgttttactattgttactccactgaagttgtatcaatcgttaaattaatccagctcaccttctgtgccgtaaggctttggaggaagttgatatggcactggcaatctgataatttccgtggattgttctttttcttcgtcgcttttccagcagagtgtgaccagtttggttttgatctctttcccaggggccaggttattctgggtaaggaacttaaaatgatgaaaaaaaaaagcaaagtgatcacattattataatacaaaaggaaggagaaattagatagtaccaggtttgaattgttcttccccgtacatgaaaattgtggtacagattggtgagttttgggcaagaacagtacacctaactgaaaagagatcaaatggcaaggtataagctacgattccatgatgaccaacactatgttgcagagcagttttcctgtaaaagtctggatgttcagaaaatttcctcaattcaacaatggaacaaaatcatccacctcatatgagcgtatcatcagttgtgtattattcttctgcaacgcaccccaagcagctttgcttaaatttgccgaggttagtagaaaccatctgatgaggatatacaaagattccagacaatgattcaatggaaatactgttattaattctagagttcaaaacagtttatatggatgcttacgcaatgtcttgaccattgtatcgagtaaaagtttttatgtgaggcatcgcacgactggtaagaaaacccaaatcagaatgtcagtccaagtcagtgataaagtaataaacactctaaaaaggatcaaaatattacagatctaggtatggcagggatgccaacctttgcaagctataacaaatatccatcgatcaactaaatatgctcaaggaatactataaaatatagacaatcataatcattactccctcttgtttttattagtatatatgactacttcaatgaactgctgctttttagattacaatgatattcttcgctatctttgcaattaaatataaatttgccttgcctaaccttgggggtagagaaaatataaaactcattttgcacagcactacagatcatatagaagaaacattaggcccctggtatgtggtattgattttggtaattaatgacaagcgctaattatggactacctattcaatttgagtaagagtttgagttaggaccacatgatgtgcatatgaaggatgattaccacggattaaaaactgatggccaagcaatgagatgaatgtgataaatatagcttttcgtttttatcaattgaggtgttggatgatcaaatttgctaggtttcttaatagctttgctgtataggggtggtaaccttggtgaggaaattatcaaaatgccatattaggtcacatgcatgtgggtgcttctcttggtccaaatctgcttttattctctgacctcaggtggtttgaccgaaggtttcatgccggtctgaccgtggtatgtgctccggtctgaccgaggccttgtgggcggttagaccatagagttctattctcgcggttgcctcaggctccaagtcctgaaagccgatctgaccggcgcccttgtggtggtctaaccgctgcggtctgaccgggcccagcccggtctgatcgggagcacttggagcaaaataggaggcctggacttggcgctctagagccactagagcttaagacggtctgatcggtggtagctcaatctaaccggagccacccgcggtctaaccggccagcctatggcggttagactgaaggtgcattaaatgtactgcaacggctagttttctatccgttgcactagaggccagtctaaccgaacatcccttggtggttcgaccgacagactcctgtgagtcgtgtttcagcccccaatagctagtttttatgtgtgggggtatatatactcccccaccagcagcaaggaggttctcttggcacattgttcaattgtataaacctcttgcattcactctcacaccacttgagcacttcttcatcctttgtgggtgtttgagaatagtttgagcgaagtcaagtgcattgcatcatcgattgagctagtgtgccacttgatcatctacgagtttggttgctacttgttactcttggaggttgacaccttctagacggcttggaggagttgtccggtggcctctccgagaaggttgtggaggagacccggtgttgggtgtgagtggttcgaaattcacctccttcagagcgaaggaactaccctagtgatcgaggttttgtggtttgagcggtgaagtagggctcacctcaacagggattaggaaaccagcgagtttccggacctcggtgaaaaacaccttgtctcttgttctatttacttattgcatttacatttgtgtaatttacttttatacagattttttgagcccttatcaccctaggattgcaaaacttaatctagttgcttggttagacttcttcctaaccaaacctagcaacttaggttagttttgattaggtatcatttattttaaaaatcgcctattcacccctccccctctctctctagtccttgatcctacacatggacacataattaaggttgaacagcaccaacctatcaatttaatgtttggtcacaaatgaccgttcctccaaacatggctgtcgtgattaaagaaacatcaccaaacaatttcttgtgatatgcagcaccatacgggcaaggtaaccattaggaagttccatttgaacaagacaatagcttgttagataattgaaggaatcagggaacataccaacgacccacatggtccgctttccacctggcccaatacttcctcaagaaatctttttcaacattcttttgagggcttggaatgcaactaccagctgcataaccctacataagaaacatttgacataaaagaaaatcagataagcggtgatactagtactcgggtaaaaggattagaaaaaattcaggtcatggaacatgctgattttgagagggaacacaatcggtttatacttcttttttgttattttggggccagcactgatctatcataggacatcatatctgaagaaggttctcaacagatcaagaaagcacaaggagctttcatgctcgtgtgttttacgatgcaatatacaggaagtatgattagagaatttttacagatgttaggtttatacctctattgatgtcctaacatcctccactgtaggccagacaatcagtggtttaccaatacccaaaggtgaaccattatctgatttaccagctgatagtgagaatgcaaactcactcatccatttctcatcaagtgaccccaaggaagagaactgcatacaagagaattaaaatgctaaatgtcctttaaggagaacaagcctgggaagtaataggcgagtaaaaaattacaatataaactttcagtgaaacagaaaggggagatgaatgccagattttaagtccaattaatccgtgatgatgcaggtgacaatataacatatcccgcactccttatagtctcgctcattcttgcaatacaaaacaagaaacagctattaactaagtacatattcctttgaccattagtgcaaatttttttacagcttctattaatggcattagtgtgctacaaagtgcagggttaaggtactagaaggtctttcctaaggtaaactaggcaccatgtgatttttgtttctcaatcttaagcatttctgcttcaaccttaacagggttattaaggcattcactacatcacttcgaaaagttgcctgtgctaaatgctaagataaatggataaataactcacacattcaaagatacctgataaatcatgggagccttgcaaaactgttgttcaaatgtgcacccttcaagaacactcctaagcttcatatgaccccactttttaatattggggccaacatgataaccaggaacggatccaatcaacctgacctataagatgtaaaatcagctgagactaaattatgaatacacgagagaggagaactggtgtgtgtgctagtatgtttgcttctatgtaaaactaatagaccttttgcgagtgctgctgagcttccatgtacagtttatttagtttttgtgcatccaacagggagagaaagatcaagggccaaaatgatgaggcaattcctcatttttcgctttaaatatcacttcattccttatttgccattgatgtcttactgacaataggaggattgggcaagttttcagtggcatatgtggactttatcactaaacacgcaatacagaaggtgcagaaaaaaaatgcatagattaatttcaaatgcaaccaaactggtaaggtccaacataagattttaaaatggataacaaaaggagcaatagaatggtttcttgtgaactgaaaatccttcagaacagtaaatactttgtaggacaagcaataaaaacagtgctaaaagatgatgaaatctgttcatttattgaagaaaagggaacttttgcataaagcagcctatttacggcggaggcacaagcataaatcagtgatcacgtgattaagtaattgccagcatttatcatgcaaagcggacttcaattttttttctttttcatgtcagcctattgcatggagaaaaaaaaaacgagatgtttacagctgagcactgcacactaagtgtaaactaagattaatggattatactaaccgatgagctcttataatcaaacttcctaaagaatgctgcattgatgttgacatcaccaaccactggtaaatttaccctgaactcaggccactgcattgtcatgaagagaataatacattacaacatacatagagaagatgtgtttagtacactgcaacggtagggaattaaactagaacaaaagtaatagttagaatgaactggggcttttcgaagctagacagcccgagacatcctattttcattcactccaatttagaggtacttattacagaactctgtacaatgttccacagaaaataagaccatgttttgtgatttgctgaaactttcattatacttattttaaggtattctttaacatggctcattgcttttagcaatgagacagctactgtcttactataagtttgcaacatgttgccagcaattccaagatctctctctaacaaaatcatgatatgcatattttaccaattcagtgttttactaacatgagaacagtggatccccttgtgaaccaattcagtagtatttaatatgatttctttttattgagtagcagaagagtagaaacagaagttgccagtgttaactgtgattgttcgagaagtgcacagttatttgttaatttttattctggtaacctccggcaaaacacattatgatgataatttaaaatatatcagtaagaaaacaacatttaacttcttttctaaaaaagtgaaacacaattggagtgatacgttaatcaagaagcaaagacaagtgccctgctagctgctaccttaattgcactcagataatcaaccaaatcgttttcaaaggaaacacttctattcacatcttttgcatctttccagggaaaatcttgcatccatagcccctgagttttgttattccagtcgacatgtatcaaatttgctgtgtgcacaacaacacgaatcccttgaggatatacaagcagcatggcctttgaatgatgtgttccaaatgaaattggaagtggaggcttgtgaaggatccaattggctggcttcactntctgtcacccaccatgaatntgagatgagaaaaagggaatacannaatatcatgaattactctagtaatgttgtcaccttcagaagctccactgatgcaccatcttctccatgtataactaggacatgtcgaactttccttaagcttggacatgctgcacagtgcaatgttatttacattaaaactaaaggatgtagataatggcaatgactggaaaagaaagcacagtgatatttcaccacatagcatagggaacacagatgggcgctggttgccaaactccttagtaaatacatacatttcataactaagtgcatgtcaacaaaaagatacatgaagtagtggaaaatagaagacaaatgagaatcataatcaaaaatagcaaaataaaaggccaaaagtacatgttttgcttatctttgtagtccagtttttttattccacaaatatattatgctttacaattaactagtaaacatacaaattgtaatcctagccatagaggctcagaaagatgagcttccaaaattattgcacaggaaacaatttaggtaaatcaataacataaatgactatgattctagaaaccaatagagagtgaccaatatagttacatcaatttatcagtaatgaagaatatgagatgagttaggttgttaccagcagctactttcacttcaaaaagaattataccaatgaatagttacagcaaacaaaacattgaggggaaagctaccaggatggcagaaactaaatgcttattcaatgaaaaaaatgtggcagattactttcagcaacaaagaaaggactgcttttcctcttaccaacaagcacgtagaatttagtattaattgtgcagtacaaaaaaaattaaaaggagcagacaaatataaatagcacaggatcgtagttggtttcatgattgagtgttctgacttctgaaactgtaaagtggcagaggcgccaaatttattttgtttgcaaaaaaggtcactacttatggtaaaaaggaagcagccctcatacaaggacaaacaatattacttgtatgatttccaccacaataacccacctgtaagcagccattccatgtccaccatataatttgagagtacagcaagaagcacttcaccctaataattcattcatcatgtaagaactagtatacttctttgatgaatctggcaatgcatgaatagagtgtgaacataagagaacatttgttttagagaaatggttgggaaatgatatgcaacacagtatccctgaaaactgaacagatcagcagaataagaactagcctttgctcccccaccatacacgataccattgacaatatagacagaaatctttacaaggtccaactagagaacaattccatctttcaaacagcagactacatgagttgaggctatatagtgataaatcacaaatggtatatgagcaagagtttgtgttggtaatgattttctttttgaacaaatatgttggtaatgatgagcaggctaagaaatttgttcttatgcaacatttgtgtcctgaacagatcatatctaaaagatgttgtggcacgccatgttaaacgaaatcaaccacataacttccgcaagagctcctgttaaatggatgatacctgtatgacatcttgaatggtaactgaggaagtattagtccatgaaggaagaccttggacacgcatgagccgaaaagtcaatgaaagtacatctttcagataatcaacagagtgtattctctcgttatttctctcagaaaaaccagcactatcaagtgaacttaacatttgatcacaacccaaaccggaaatagttgaactttcttctgcaaagcttttctggaataggacaggaaatagtaatgaaactaagatggtaatgtactatactacaattcaatagtatactggtaattttacacaaggaaagaaaacatacagctaaactaatattcagcaagctaaggggcaccattttttacaatgcaaaatataaaatatgccaacactaaacaacagaagcatacaaggatagcatatccaatgctgagtttcagaaagcaaatccaaacatccaatacttagatactatttgataaatattcaccacagataagtacatttctaaacgcttgcacctttggatggtatttaagtgtaccaggatctttcagtggtatatttatgaatcaggatctttcagtgtcacagcctggagtctatgaattaagacgtaaagactttattttcctaccagaaatatataaagatagccactgatcaatttcataaacaattgtctgacataatttaaattagtttatccacgataaagttatcagaatatacactggaaaatcccttcttttaaaggcattctttaagggtatgtttggttgtttgtcaccttgagctatagcccagctaggcaaaccaggttgttgctgcgttgctaggcttgctttactgagttgtttggttgtttagtttttgacgggcagttagttagtctaaagagaagtttgtcgtcgaaggagagccgaattggctctccactgcgagcgagcttttccttgcccgtagggctagcttgcccccagaagctgcgatatatttatggttccaaacgctgggccttgccaggccaggctaggctaatgctagccttagatccaaacgtgccctaagtattctatgtccagcactaggatcatttatgttatattaaaactacagcattgcccagattaagccatgatcagactaaacggaaatatgatacacggaaaaccatggattgctctcttctaagttaaacaaactgcacaatacaggcagtgcaactagaaaggttaagtacttaagttacctgtaaacttcttgccaaagcctcatcttccataatctgacgatttcttttgataactacagtatcatcctcacagagcctcttcccctttttaaaatcacttgaacccattgatgtggaacttttatggttatcgcccacattcaaatacttcacaaaatattcaccagggatgagttccaggacatcatcatgtgcaatctttactctctcttgagcacagaccttcctcctctggccctcagatcgaacaatgataggatttggtccttcctgcacatccaatgccaatgaacaacaagttattttctgaaaaaaaagccatcagaacaatactgcgcagttaattggaatatccccatgccttatcacactcaccactaccgcttcaatggaaccatccgccgaggcatgtaggctcagatgcttgcggctgactctcttgtcgacgaccaccaaatgattcctccctacaacattggcacccagatagataggaatgcttgacaccgatccatttgacgagctcgcatttccttcattgagggggactagattgccaacccttacctaagcaatacaccagttttcacacatcagctcaacaacaaaatcttaaatctcctatggaaaaacactgatcagaatacagcgcaatgcactgaagcgattcgctgattctaatcacgcctcccatccccaaacccacccggggagaaaaaatcgcacgcgcatatcatcgccaaaaccacacccccaaaaaaaatcgcacgcgcggagagagagagagagagagagagaggaagataatacagaacgcaacttactcgagacgaggacgtcatgggcgcggtctgggattgactccaaaccctaaaccctagtcccccacattggaatcctacccagcgcaatggggaggaggatggggaagggaaagagaaccggagaagacgaagacgaaggccattcgagagctcgagtcgcgcgaaccgtgattgcagcccaaccaccaaatctatatgggctttagcccatttatcaacttctacaaggctgacgtcgagaaactccatggcccaaaaaagcccatcatcaactaaatcagacccaaaagcttcatctagaggtcactgggctggagccgccgccacacacgtgagtctcctaccctccttcctcctccggtcgtagcggcggcgcccagcggccgcgccaccgcgtcgtccccccgccagctgcggcgcctcgcctggtccaccggcggaggggccgtgcggcgccccgcctctttcgcccgcggagaccggggaaagcgcagttccgttgctatcagcggccttcgcctctgccctgagtaggcggcggaaagcgcggtggctaaggactccaactgcagcggcgtgttccagaagtatcgcggaaactgacgccttcttccgggagcaactgagcaaagggtaactttttttttgttttttttgtttttagtgagcaaagggtaactgaaatcatgactcctaattcagcttgactgctttcaattctcgagtagttgtgacatctagcgtgattatggctttcctacatcttgttttggtttgtttgtttggtagtagtagaagccaagagcatcgtaaagatagaagcgagatttggggaaacttactgttctgtaaagctggagaaacgtaggttttatcttcctttttttttatttcctttttgggcatttcaatccttagaatatcatactaattgaaggtttagaggtatgatgaagacttaattaatgctatgctttagtgatcatggtgttcttttaaataataagtgttgatcctagcttatattgaaagctaatagtaatagcctaatatagggtatttctaccaaaaaaatgtgatcgtgctgcttaggaaacttaggagctggaagttttgaatattactagaatatagtgtatccttattcctgaatcctgaaggttagctaccactttgtttgaatagctaccaccttgtttatcttctgtccaaccttggcgttaatccaacacaactacgcaagggatttatgatggttcgaatgagttgtgtagtgcttatttttgtgtgaggttgtatgactctgcttgttgaagtcataacatttgacatcatacagtttggctcgcactgcattcaatagtcaatataacctttttcaaaagaaaaagtcaatagtaatggtgacatcctaatttctcttacttgatgaagtggaacatgacgttaatgttagatatacccataaaaaaattgtaaagtttcaaacgtctagagtacgtagtttagtgaatcatcatttttttgttttgctttgtttgacgtgcaacacatttttgttcataactcagcagaagttctgtttgcacttttccatctctcgtttctttgatattaatatttttgtcttgttgcatttaggtatgcatacattttcttactgagcaaccttttggaatccctctctaaggaactgtttactgcaacatctttaggttcttattaataccatggatcagaaacctaaggatgattttgatttccttgaaccatcagtactcttagatgagacacactatcaaacgggtttcaagaatggttatagtgagggcttggtgtctggaaaagaagagggaaggcaggttggtttaaagaatggttttcaggtaggtgaagaactaggtttttatcagggatgtctggatgtttggacgtcgttggtttcaattgatcaagatgcattctcagctcgggtcaggaaaaacattgagcaactagctgcactgttgagaagctatccgttgtcgaacccagaagacgagcaagttcaagatataatggagaagataagactgaaattcagggttatcacagcaagtttaggtacaaaactggagtatcaaggtcgccctacatcatccaagcaggatgttgaggatctgtaactagtttagctttcattgtcaaattaccatgttgaaatgatatatgagacccaaacatgtttatgtaggtttcggttaacgaatacttgttcgagtgaatgctgctatattactctgtttctaaacatcttatgaaggccaccgggatcacagtggagacctgaaagcctgtatctgagtatctatgtacactcaagttaatttgaggcagttctggactcatcttgtttttgatccttagtcctgctttacttaccacatatgagtacctccgtgacatttatcataattgaggtgtaatataatgtcttcacaaagaacttatcatttgcttcctatttgcacataccgtgcattccatggctgtgttggggaggtgagttcgcacgcaaaacggagcgacacattttcttatgattaattaagtatttactatttttttaaaaaatggattaacataattttctaaagcaacttttgcataattttttttttaaaaaataccatttaatagtttgaaaaacgtgcgcgtgagttgggaactcaccggtgccctgtaaacctgcattctctatgcggtaagactactgatcgctggtcctgcttttctgcaaacggcgacctggtttcaggtaacgtttctgctgctgttactcatcatgatcatcatcagtatacctgattactctatccagcacataccgacatacggaactttttttttttcacagaaaccacgaacgcagcatgccagcagctaggggtgaaagcggtacaaaaactttccggattcctgacctattttcgtaaacggaatctgtcggtcgaaatttttcggaaacggaaacgaattcggaaatattttctcagaaacggaatcgaaaatgataaagccagtttccgtcggaactcggaatcggtcggactttccggaaattttgtgactgaaataccctgtattctttttttaggcactgaatagtgcataccatggtgtttggttgctatttttttaaaaaaaattgatctagagttacataaaacatttttttcatgcattggtatttatcaatagcattactctcttaaacagataatttattccatagactgtgttttgtgatgtactgttgagacttaacaattggacttatatgattgtgttttatgatgaattgttgaaccttgacttgagaattggattggtcagtttgaggggtttttgtattccgataattttttgttaccgtattcgcgccggtttattttcgctccgttttcggtttcgatggtattcgattctgttttcgtatccggagtttccgattccccccaaaaaatgaaaacggaaacgacaaaggtggtttccataccgttttcacccctaccagcaacccaagctaggcataggtgcatagcaaaccagcacaacaaccaacaacacatcatgctaacaaggctcatcaattatcatccccttcatccactgtccacctaagcatagcggcaccaacctaatcatggctcggcaacgccacccccaacctggtcctcgatgaagctagaacaaaatgtagaggggatgccactctcttgctttattttaggctgatacagttgtctaagtatagacaaaatcgcatatatggtgaaaatttgactcctggttgaaatttctaaatcgggtcaggctcgagttgacaaatttcatgagccaaacaagactcattaggatagctaacgagtcagcccgtgtggagtcaagtttggtccatatccaacctaattctaagtgaatgttctaaacattaatttaacaccaaactataattctatgagctgctaaatgattttaaaataaaaatcaaataaacatgcgctacaatatttctcgtctcgcgtgcatagttattagaaccggaccggaccggcggttcgaccgaaaaaatccggaaccagggctcccgccggtctggtccccttaaaagatcgggcatacaatcggaccggagaaaaccggttaactcgagtggtttttatataaaccggagattaaccgggctagttgaattgggaaggatttgttaatgggctgagatgaggagttaatgggccgagatgaggacccaactagatgcctccaatgcatgcgcacgcaaaattcccaagaaaattggtggagatgcgcgttagccaagccaccatcctgccgcttgtgctactatataaacactcattctatattacttatcggaccgcggtcattctccgatccggtcttaataactatactcgtgtgctgtaggctatagcaggattcgttttctactccatacgatttgcacacgtactccatacgatttgcttgtcgtggacgcagcagacctaccacggaactctcgtcgtccaccccaccccaccccaccgcccgtgtccatgtgggccacggttatctgctagagagccccgtccggacacgccatcctcctaagcccatctcggccgtcgatctccctccaaccctagatcggacgaccagaaaccgcctccccttctcgccgtccgcttccacacccgcccctatatactcccagccgcagcccaacgcggcccagaaaaaccgcatcccgcaactccaccgctcccaatctcgatcgaaacgcgagggtttcgcatctccgccgacgcctagaggaagaagggatccgccgccggtagccaagccatgccgaagaacaagggtaagggagggaagaaccgcaagaggggtaagaacgaggccgacgacgacaagcgcgagctggtgttcaaggaggacgggcaggagtacgcccaggtgacgcggatgctcggcaacggccgctgcgaggccatctgcgtcgacggcaccaagcgcctctgccacatccgcggcaagatgcacaagaaggtgtggatcgccgccggggacatcatcctcgtcggcctccgcgactaccaggacgacaaggccgacgtcatcctcaagtacatgaacgacgaggcccgcctcctcaaggcctacggcgagctccccgacaccctcaggctcaacgagggcgtcgacgtcgacgggcccgaggacggcggcgaccacgacgactacatccagttcgaggacgaggacatcgacaagatctaagctcttttcttctttctccgcagctacaatttactgctatgttctaattaatagctatgtgtggtactatgtgggctggctgttatggattgtttggttgccggtttcatcttgtgatatgagatatttgtcatggtttgaggtggttaaataattgttggattccgtaactttaatctggtatacatgatggttatgcgtaattgggatgacctgctgttctctgattggttcttcctagattagcatcctgttctctggtagtctgattggttgatttcttcttagattgacatcctgttctttggtagtctgattggttgagttcttcctagattggcatcctgttctctggtagtctgatcgattgatttcttcttagattgtccataattgaaggtcttgaaggctttgctccaataatttgaaattatatttcttatacctgatagatatcttatttttctataacaaacatgattcaattgcaaactactcaaacgttgtttctcttaccatacgactttgtaattgcaaactgctcaaatgttgtttctctttccatatgagtttgtgggtttcaggttagttcaatgtttgctgattatcttaggattaatctgctacaagatgtagcaattgaatttatagtgacgggccttacttccctgagataacaaagaattgcgtgtcaatcagcattgaattgatagtgtttattgattgtctccatcacaacgttcttgtgttcacagttttttgacacgcgaaggcttgtgatttctctgagaattgttgaaatgttacatgtgtttcatttgtttgtgtactaatgtgttttgtggtgaaagatgattttactcgtatctttgtgctaaatacagcaacccattgatctgtttaccctaaattccttcaatgctgttgcaacttgcaactaatgtcgctaagttccttcattgttgatgtcacaatttgtcttggttttgttagcttgtgctttgtcggcctagctgggttgtcgagtataaatttggctcgattttggtctaagatgataatcttctacatggtattactgtccttttgttctgcacttctgctgctgggctaagaataggattggctattcaatcaaaagaattgttatactggaaataatttgggggtgcaaggtacttctggcatcgacctctggacatctgacaagatgtaaactacctgaattacatattctttccaaatataatatgctatctttttatagcaggctgcctactgatctgctgccagttttagatgtgatgcgatatatatgctgtaaatagttcattgaatttctgatttgtgctttatatatgtccaaacccacaaatatccaatatactatctctgtgtgcttgatatataccactctccgttttaggttataaggtgttttagttataatatgttttgattttggttaaagttaaactgctttaactttgactaagtttaactttgactaagtttgtagaaaatagtagtaacattttcaacctaaatttattatgaaaatatattcaattattgatttgatgaaactaatttagtattgtaaatattattatatttttctataaatttagttaaatttgaagcagtgtgatgttgactaaagttaaaacgttttataatctgaaacggagagagtaaaaaataaacttaacttgaaaactaacttcacgagaagagtgaaaaataagactgaataggtcgagcgatgagaacagggagcacatcactgaaattgaagtttatgtcaggttcatggctaaataaaaaaagaagaagaagcagaagaccatctccatgcaggcacaaaataaaatatttcataaacaactaaaacaaggattagtttcagtccttaacacgcatggcctaccatcccaaacctttgcagggtcaaccctatctgcaaagtgtagaggttctttagattgtaactaaaataaacattaacaaattttagtgctaaaattttgataatttagcaatattattaagtatttttagattttttatgcatttaccaaagttcgattaaatactaaatggatgcatattttcagcaattttactgaacaatgatatagtttgaaatgagatcaatttaaacaactccgtagtacccttctacctttcatattacatgacccgcggaacttctaaaacttaattcaacctcaaataagacttgattcaacctcaaataaggtacactccttatattgacttgctgatattttaaaaagattagaaattaaggacaaattttatagatacttattattatttatttggaactgaataatttgccttcaatctgtataatcatttgtaacgtcaacgtcccgcttagacagctttcataggtcatccttcaatcaacgtcccgcttatatttgatagttttcataggtcataggctgcccttacaggccaccacatgtcttttctgcacactttgtcctcagaaagaattttccagtcggtcacccatctcgaaattgctccaagccaagcacgcttaaccctgaagttctttgaagatcggcttgcagaaaaaaagttgtaacttgttgatataagtattctagtaatcctataagccctgggccgggatgtcacaatcctcgtccccttaaaacaccgacgtcctcgttggtcaaccccaggccaggaacgtcccctcttggccacgtctgtgtgtagtgccagcgcatgtgccatgctgtgtgatcactcccggtccacaccagccatgcgccccatgcctgcacaactgcgacacacgcgcccgtgaaaccgcgagagtcggacgtcccgcttctcccaggccggacccgcttacatctgatagcttttataggtcataggttgcccttacacaggccaacacatcccgcttacatctgatagctttcataggtcataggctgcccttacaggccaacacatgtcttttctgcacactttgtcctcactcgtgcacacccttacatctgatagctttcataggtcataggctgcccttacaggccaacccatgttttttctgcacactttgtcctcactcgtgcgcacctaggaaaaatttcccagtctgtcacccatctcaaaattgcttaaggccaagcacgcttaaccctgaagttctttggagatcgacttccggaaaaaaaaagttgtaactttattgacatgagtgatgtcacatcattgccggatagattagggttgtagctattgagaacggtcgtgtccagctaatcatggagcaatgtgttggaaatggacacaacaagtgtcaatccaatgtcacgcacgcgggagagcgacctaaacaggcccaacgcgtcgactaaaatcacgagagatgaccagaaatcagaggacaaaaacacaatatttttttaaaacagaatcaatatttttcaaatagaattagattgagatacagacaacctaccaccagtgaaaatatcttacataattataatagtagaaatattctgaggttgaggatggccttttttttctttccaatttcattggtctactgatcaaccaaaatgtttttcttttcttcattggtaagatcttacaattttgaggttgatttttttttgtttcgtcttcatcggtctgctgatcaaccaaaatgttactgggatatatcacatcctcttaaattccttatattctagaacagagggaatactttgtaaagcaaatttttgactctccgttgctgtgttttggttcaatagttgccgtatgccatagtttattttatcataccctatcctgctatcgatgatgcacagtgaagttcaacttctatgctcaaagtccaaaggaagaccagaaaaatgaaatgtcgaaaatagcttgtcctctcttcaatagcttgtctggtggtcgatacggataggttgtatccatattggcacccataaatatgtgatagcacctttcagggagtcagggaggaactcgaaacttctggtacgtaaaaaagttccttctagtatcgtaaaaaagttgaagtaaacaatcataaaataattatgtactcttccaatatccctacaggccgtttagccgtttagttggagggagctttcaggagagattgagagattagagagataaagctattcactgttttgtttagctgagagacatgaaaaatttggtggaatgagaataagaaattgagaaaggaactccatcctttttaatatgtaggtaggagtggtaattgggagagaatttctcctttactttgtctaagcaaatttcaaccattcaattttattaataacctaatctccaattaaactccctatcaatttccaccacctctatcattaaaaattaaattctcatcttaatctcaccatcaatctcctctctcctcgtgtaaacttccaatccccttcctttgtgttgcccaacaagccatatctaaccagcttgcagcataaatgagaaacaaagtcggtttccagaaacaaggcctaaggaaccacagaacgaataacgaatagtgccctattcagcccttttttttttacacttggcctctcagccgcataatatgaggtatcagcggtagggtgattgtttctcaaaaaaaggaaaaagaaaaaggaaaaaaaagcggtgggggtgattgcgagaaaccgcataatatgttttaggactttggacagtacatgttggcaacttggtggtatacatgaacattttgcccacgaataatgctaagtcaggcacacctcatgctagcagaggttaaaatacctcacaaaaactcaagatgcattacaccctactgaacatgacagcgtaggcctccactgtctccaattagcctgaaggaatgtcatcttggactgctcaaagagagtatgaaggtgtcatatggtttccattctaataacgttgaaaaggaacaaaaccgatagaaagaaactcactgctaagaataaatccctgaagcaggctctgagctttgtcagcctgctcaggagtaccagatattcgaacaactttttctatggcgtcaggcctttcgtcagcaagtgtgacagtggcaccagacatctgcgaccaacaaacagttttagagggttaataataggtagagttgtttgccctttgttctacaagaaaaattagaatatacagaacctcgcttatttgagcaagcttgcttccagctctcatagtaaggcttgcaacagcactctttggtatgacaacttctaatgtgcttcttgtcactagaggaacagcaaatctggtggaaaaagaaattaaggtgatcatgtgaaaaccaaacagaacaagatggcaaagacaaaaacataccgttttgcagcactttgcctcatatcatcattaatgttgctcccttgctcaaacgacatatttgcaccacctccactatcctgaaattcaaaatgacaaattttaagtccaaagactccaaaacaatggctaactttagataacctagaagaagaacattattatgcattaaagttcaaatacttaacatcctacattacaaacttttcacatctatgcaaatcccttgtcactgccaagtttcaccatgctcattatgaaagaaagggaaaccatgcaaatcccttgtcactgccaagtttcaccatgcccattatgaaagaaagggaaaccatgcccattatgaatgaaaggaaaattgaggccaaaattggatgggccaaaaggacaagagaggtcagtggtaaaaaatagagaaaattccatacatagtacaaatatatatatatatatatatatatatatatatatatatatatatatatatatatatatatctgtgtgtgtgtgtgcgcgtgcgcttttctgcaaggactaacaaagacattgaagtactaaagaataccttccatgaagctggaacatgctgtgcttgttggtaggatggcattggaatatcacttccctggtatggtcctctaggtgaaccttttgctggagaaatggagccatgaacagtaatattgccaagttggttaggaccaggaatctcgcggtagaagtaactccgtaattttgcagttatttgcacaagagcatcccgtgcagctctaatctctcctacaatctgcaagaacaataatttgttcaaccacacaatatggcaaacatagtaaaaaaatcattcatgtgtcaaaccaagaatataacagtaaaaagaagataacatgcctactaggagcactttggcttgaacacaaattcgagttagaagataggtcaacccaggcttggctcaataagcaaaagaaacaagcgtattgtaaattgtaaatatatggattatggtcatctataggggtgggtgtttggtttcattggttcattcggttcggctttttcggtttccgagaatcacggttttgagatatgccaacagaagtgcatgtcaacaaaaattaaaaccggcccgaagtaaccggattaattcagttcggtgtgtcggcttcaccgaacaaaccgtaaacacatctaacgcacggaagcagtagaccaggtggcagcggcggcatggcgtaatccaccatctacgtggagataaaccagtcaattactggtgtataaattaggcctagttgctatgggcctcgttggatggaggaacgtgggccttgaggtgctaggtggtaccggtggcatggcgtgatccaccacctacgtagaggtaaaccagtcaattactggtgtataaattaggcctagttgctatgggcctcgttggatggaggaacgtgggccttgaggtgctaggtggcaccagtggcatggcgtgatccaccatctatgtagaggtaaaccagtcaattactggtgtataaattaggcctagttgctatgggcctcgttggatggaggaacgtgggccttgaggtgctgccacactgggctgggatcatgggaggtagtttggttgatcggcttcttcggttggcaaggatggaaaaccgcaaaaaagaccaaaagctgaacaagaaccaaacaaaaaccaaaggacaatccgatgactgaaaaaaccgatgatttggttcggttcggctcggttttgttcggtctcggcccacccctagtcatctaggtatttaacacatggatctccactatctagtcaatcctcaagataacaaaaatgaagttcttctgggaaagaagacagacctgtataagctcatcagactctagagcacaagatggaagagcttgccttggtaatatctgtacatttgcactggtctgtctctgtatatcagataatgatccatcccttccctcgaagcaagcaatttcacttgaagggacaagtaaccttgttgtaataatgttgtctttatcaggaccaaggtctacaatatgagtttggaggtgcagcaatgcttcctgagctggaaaaagctcatggtctgggccctataacaatcgtaaggaccattttaagaataaaatattgaaacatgtcagtgaagggaggggtactgaacccaaattccagctataacaatgatggttgatacaaatagcagaaaataccaacagaaagaacaacataatatttcaaataaaatccatcataattgaggccaaactaatgttacacgcaagcagacactgctgtaagcatttttggaacaaagagctcctcagatctgaatagcttactgtataggactataggtgtggataatccaacaagctaaaatcatcttgtttcattcacatcagtaagacaacctacttaactactacaatgactagttaaaaaatagttgactttcatcaagcaatacttcaaacattgcctggactgtgtaaatctagctagcaatctagtaacactactttagattagtgaagcaatgagtagatcagtagaatttctcacagaaaaaggacccgtctgataaatataacttcatatgcaactgagattggaaaaaaactacaaaacagtgtgcgtcactcatagcatcgtctgttgaagctgcaaatgtaactttgaaaaaacccacagaactgtaacccaacccttcctataacgtacaagtttttacataacttaaacagccatgtcagtaatagtatggagagtggtgaactaaaagacataagtgagtgtgtattacctctcttgatgtgatgattatgatcctttcgtcagagccatcaagagaatcagtaagcctaatatcaacaccaacatcttcctgtaacatctctaacaatccatcacgtgttccgactaaactgttaaccttgtcacttgggcaaagaattcgaaatatgatgtcatcgaacagaatttctgtgtgatcattgatcttgccaccatttgaatcaaactcataccctggcagctccatgctagtattatttctaatttgatcaggtcgaccataaggttcttcatatgcaggcatctgctgtgcaccaccatagtattcatcctcttgaggaaatcgatgctctggtgaattcatccgtccacggaaggggccacggtcacggtgtaagctttcctttaggcgatcggagattatcgctacagcctttttaacacaattcccctctccaacaacctgtaacatcatatcatgataataatacacagtagggtgagaagtgccacaagtaaaaagaagtctaataaagagtgtcatttatctttctatgcatccaaatcacaattacaacatgtgctaagagacagatttatcatgttgaacctagatcatttcagatcataattgaatgaatttacaaatcaatgtcagaacagttttcactaagcaaacagaaggctaaagttttcacttttaaggttaaagttgacaagagagatagtttaagccactgttgctagaagacaaatctggaacagtgtctttcatataatatttgaaatatagtctcaaataataagttgttccataagtgagctgagtaaatctatatgtccaactatattattattttatttcatttaatacaagagctcagcattaagcaaacatcatatgaataaatccccataaactgtgcaaagagtaatttcacaaactggtattaaagcctaacgaaaacaggttatttttaaattaaatgtgtgtgtaaacaaagttgaaattaaatactgactaggaacaagggtagagcagatttcttactgttgaaagcattaaatcagtttccactgtgttgcttgtaaccaactacacggtgatgactacagttcaagaattaatatattgtgatattaaatcagttataatgccaaactcaatgtctcaaaagaagctaaagatatgaatactagagaggttaatgctaagcaacattataaagttaacagcgagaaacatccagaactagtgcacaggtactagcagttattgaacaggaaacatcatgggaacagagtcatcagtcaacataattgtgagagatagtaggaaaagtcctagagtactggaacttggagcatttcctaaaattttcagatatatttggaaaaaaaaatcagttctacggaactgagggattaccatttttgctatatatatagctgaatttgttttcaccctaatagtatcacgtattttctaccacgtgttcagtaaagcaatgttgctatttgacattagttctccgccatcacaagtcacaagctgttcccgatcctgtaccctcataggctatcggcactgtccaaatcgaaacaagttgctgctcaatttcacccctcccatccaagctatgaattctctcttactgcagaaaccatggcaacagacccaatagtatgcacagagtcattcccaaatattgtcaatggggcgaagaagggatggggtatgccccggtttacgtgtatggcagcagcaccacggttgggtcgacaccatcaccccatgacaccaacaccccacacactcaagcagtgtcagatccctttcctaagcattccattacttcactagccccataaggccacaactgatcattccttctgaatttgttcccgcatgctgattttcttgagctaggaggcagcgctctccagcgacatgctcatccaaaaagatgcggtcacccaaaagctggccattgtgtcagcgccaccatccattcatccacaaatctctgccgtaagtgagcagcatatgggattaaacgatgagtggtgtgcctcagctgcagctgccgctgaccactgttaagcggtgtatggagccaacagagttcaatggtgatgaggacaagtgaatgaagagctgagcatgatttgaggggtgattcagggatttctagagaagtatttgtcccaaaaagtcttttaaaaaagccaaagcgcttgatggacatactaacatagactgcataaaaacttacggtatttttaggtggtattaaagtgcaccaagaaaggtaggtattaatgcaggtatcttgcagtgctgtggaaacattttttttttcaatatattcatgaagatttttgtcttgtcctgcttttagatttgttgtttgatttgtgtctgttctttaaaccttttttttgtcgttttcatctgggagtgttcaggtttgatcatcgtacactacacattttagtgaatcaaatttggccaataaaccaaaccgaactaaactaaacatcactctaactagaaattttattaggaaatattcttctctacagcagttcatcaatcaaatgttcgattctagcatattctaagtatcaagaacacatctaagtcttgtccaacacgtagcataatctgtttagcattttgctttccttttatccgtacattaatatataactatgcaactaaattatacacataactccaagttaatgtaccattgtctaaagtaaaaattgaaatttttttaccagattatagtaagcagcctcttacctgtacaacctcctccgacaacgatacacaccgcggcgtgtgctggtcgcgtggcaggatcctgatgtgcgttttggtctcggccctcatctgctcaatgatcttgccacccttaccaaggaggcacccaacatggaggcgcggcacgatgaggcgcgtggtcaccttgcctcggtccctggcatccttggccctgggcccatactcgccatcctcatcgccgtcgtctggttccgtctccaggatccgccggtgcaccatgaggagcgcctcctgcgccggcgagaacgagggcggccgcccatccgcctcgcggcgcgcgccgtcggacgtctcgatgacgcggaccgcgtcgccagggtagggcaggtggatggtgacgaccgcgttggtgtcgtcccgcaccttggcgatgaagctgggcgggaagccgtagaccttggactgcgggcacaggatgcggaaggaggtggtcatgccgggccccccgccccccgccgccgcggaggaaggcggcgggggtgggggcgggggcggggcggcgtcgggtggcagctggaagccgccacggcggtcgccgccgccgccaccgggggggccgcggcggtggtagctgttgttagggttggggccgccgcggcggtcgaagcgtggcttggagcggggcggcggcgagtcctggtcgtagtggtagccgcgcttggaggagcgcgggcgatccattgccggattcgagggctccccaccctcgtcctcgaattcgttcgattttggtttgattgctcggttcggattagggtttagagcgacaagggggagggcgccatggatcggagagtgaggaggtgagcgtgtgtgctcactgctctaggtaggccaccaacaccttctcagactcaaaaagtgtgcggtacgtgtcaaaggagggatttgtagcagcccaattttgttctctcagattcatctcatttgtgttgatttttgtatgtgcagtagattattattataatagggtttataataataagtcataatttataaactattttacgtgtgtcttacgctataggtttaaccaaacattattacatttatggtaattaattgttagccacgtcttttataaaattggtagtgataaggttagtcgtcatcaattaagttatctttacttactagggtggtgtttggttagatcaaggtaacgctaatgttaatgggagtggttccgtccgtaatcgataccattgtaacagataagtactttgtttggtttgttgcggtaacacatccggagtcactcacgctgtttggatgcgcggctgcacgctagccgctaggtaatagattcagtgagctgctagttgaagctgagacggacacaagaagcaaatacaaagcaaatgcatgcaacgagcagagttttgacagatagttcataatatgcaaaacaccgtcacctcatgtttggatacaaattttgacagtgagaactcgagacaaaaagacatattctgcagaatttaatcagtgatatacttttaagagtaaagtccatcaccggtccctaaacttgtaccgctgtgtcatcctggtccctaaactcgcaaatcgaccgttcaggtcctcaaacttgtttaactatatcatcccggcctctaaacttgcagatcacttgtttaggtcctccaacttgtttacttgtgtcaccccggtccctaaacaagacagtctaaaaactttatatcaaaaaataatttataactttttcatgtgaattctaatgaagacaaactttatatcaaaattgtagccttcgacgcgacttacaactttgtagttgaaaagtttttgaattaaaactgtttaggtcccaaaatattgttgcatgtttatatattttgaaattttaattttaaaattacattttgggacaaaaaatgacttaaaataaaaaaaactcaactacaaagttgtagatcgcgtcgagggctacaagtttgatataaagtttgtctttattagagttcacatgaaaaatttatgaattatttttaaatataaagtctctagactgtcttatttgacccagatgatattcaaatctaagtttagggaccggggtgacacaactgaataagctggaggatctaaacgagtgatgtgcaagtttagggaccggggtgacacagttgaacaagtttgaggacctgaacggtcgatttgcgagtttagggaccgggatgacacaacggtacaagtttagggaccggtgatggactttactctactttcaaaatttaatcaacaaaggagtggatgaaaagttgatccatgctggaagtgataacttcagaagttcaatgaaccaaacaacaagaggatacattgtgatctgtctaaataaagtactgaggaaatatatggatgaaactaccagattaaacaataagctaggggcaatacttctatctgaaaacaggacagtactttgatcacagaatatgtagactgtcatggttcaagcaaataaagctgaagcactgaaactaaacatccttaggacataggtagtctctaatccccaaggcatacgcttatatggaattctaataattaaagaacagataatgaacatcttgtatatcctgcttgacagccagcacatcagtacatcaatttttctttgcctcatctgataacaaaaaatttcagaaattagtgaaagaaacattaggtgaaagaatatatatagtgctcagcatcataccaaattaagaatattcttgctcatacaagccatatatgatattcagaaataggtagcattttttaactttaggagtacaaaaactccctgttaggtgtatgcaagtaagcaagaccaagcacatactccagttagaagtgaatatgatattactatagcattgagatggacagctgggcccattgatgcattatactagtgcaaggcaaataatatgaatgcatatatgaaatgctaagtggtaaagagcaatatgcttacaattaatgatctcaaaataaatatgttgcctgttgcagttgcaacgctacaagagtgatcaagtgaattaccagcaagtatttttagcacgtactccctcctgagagactctgaaagagcgacaagcatactcatttgagccggcacttttacaaaagcagctgcaacattgacaacttcaataccagtcaatccaagcttttgacactcaagaatagcttcgttgtgaaatttttgtagttggtcctcctcagccattgcttctccgcgttttggtacttaagggaaggcgagccatagcactctacaaatacataaaacaaaagcattaaccctatgtccagaatatatcctgctagcatgcataatacatcaagctaccattcaaacaaaagacagtacaaatttatttttgttgctaaacataagtaattcaccagaacacaatatcaagcatccattcaaggagcatatttacatgtatgtgctgttttactagaacatatttaactactggaatatattctgtcaaacaggcaatacgcaaaacttttttccccaatctgatattgtgcaaaataatatatcacctggcagtaataaaaatcaaaattctcaaaatctagatagtaaaatgagttggtccaacttccctacactcaaaaaaaaaagaaccatgtactgatgttcaactttcatgcaatcgaggcaaatagattctacataacccatgtgaggcaaacagatatgaggcaggaacacatgtgatttacttgtataaactactacatgattttttagaagactattacaagatcatcactcaccagcatcacaagtatatcaccataaaataaggtggtttcagtagggggagggttctcactggcgaggtgatcgttcgacagcggcaacgacgaaagacgaatgtagttgatggcagcagaatctccgactagcctcctgctgcacgtccttgcccttcccgtcaagatccattttccatggagttcttcccgtcaagatccaatcgccaagaaggtggaactccggggaggtggcaacgcacgttggacggggcaggagggactctggaggcggaactcctggatgtggggagcaccgacgcgccggcttggccaagcggtggtggaggagcgcacgagacgggggagcagtggagcgtgcagtgggagggggcggcgctggcgacgggcgcggggcgagggggcgacgtcggcaacagacgcggggtgttggggcggcgccggcgacgcgtgcgctgcgagggagtagtggcggtggcgctcgatttggcggtgctaggtcacgctctcctctccatatcggtatcacattccgcccgtctaggagcgtaatcagatttgtattgggccggaattcgtttacgggctatccgattacggtccatctgaaacaaacgagtgtaacgagatctattcacggtgggaactgatacgggccaaaaacgacccaaccaaacagctcctaggtacttgtgtaaataccgaagattttgtcgctccttcaattttcatttatgtgttttttttgttttgatttaattttatgcaagtcttttacatggtcctctatttgattagaaatatttgacatttatgatcatcaatgttatatttaaaagtttataaaatctattaggttcaaaatactatgatagtactttcgaggaaaaatctaaagtacttttttttaaaaaactaagcattatagaaattatttacagtcggagttttcaaaaatttaatcaaattttatcataaacgtcaaattttatgatcaaagagaaaatcaagcaagtagcaggcattcaatagagcaaagcttacaaacaaaaggatattttttgtacatccttttgatttcaaactacagatggtagtggtgctgcacggaataggcttattattcactaaatatattgcctatttttccaacctcgcatagggtaattcatagcaaatcgtaatagtaagttgcactaggttatcttaattttatataagttccataaagggagtaaataggctattggtgatgggcattccattagcacatatttcttgggaaataaaagtacttgcgggtgaaaaaatcagttaaaaaaatgcatgtcagtcgtgataaaaagatcttttgtgtgattgatggaaagcacaaattgctaaggagtaggatactatgcgcaatgatgctacactattaaagtcggtagccaagggtctcttattccactataagtggcattgttccattagaattctagctaaaaaatctatatagtttaacgctagtcaataataaaggggagttggggatttgtcccatcaccttatttctcattatttatttatttttatatttatctttttcttaacaaatttactgttgtgtgtcttatgacagaaaccggagatgtaatccatttccattatctaaaaaaacaccaaatatatgtatatgtgaactagcaaaaaaaacatgtttaatataacacagagagaggaatcgcaacctatttttattaattttataacttaagttagtaggcatgttgaatttggttggttggttgcatatcgacatgatgatattgatgactagtgcatcaataatatagtaggtgatgaataaaggtggtaaaaaaaacatctaccgacttattcttataggtacgtgcaacacgcaagtagatatcgctggatatttgatgatgatataatattttgtatgtgctattctataaggacgagaaagactggtttggctcgagtagagttggatattaattcatttagccaattcatatattaacattaacagatttcaaggctctaaatgggttaaacaatgtctaacaattaaaagcttaggttaattagctacaactagcaagttgaacaattattgtttggttgtggctatgtataacttttccaatttagctcttaggatcaatttgtttgtgctatttggaatctactactttgtttactgtgatttgtgaacatgcctcctgatatgctaaacaacgcttttcttaaaaaaatatatatcaaaatttatttgaaaatcaaattaatgtattttaaaattgataataattaatacttaattaatcatgtattaattactggccgtgttttctatgtcacagttttgtttagccggacatcttagatcgaaccagaccttagtcttagctttgccacctagttccctaggttagttggttaagcggtcgctcctgactacgtctcggggtaaactacttctcaaccttacctccattcaaaagtcctaaaatatagtagtactcccttccctccgtttcatattataagactttctagcattacccatattcatatagatgttgtctagattcattaacatctatatgaatatgggtaatgctagaaagtcttataatatgaaatggagtctagattcattaatatctatattaatgtgggcaatgctagaaagtcttataatatgaaacggaggaagtaacttttaactctaaatctggatttgcacttgttcagattcataactaaaaatgttatattcttggatggaggtagtgctagagaagccaaaccaacaatttcggtttagattgaatgctttaaaccatgactcagaccaattacaaacgatttaggccctttttagtttaggggtgaaatttttggcgtattacatcggatatacggacacacatttgaattattaaacatagtctaataacaaaacaaatcatagattctacatgtaaactgcgagatgaaattattaaacctaattaatccgtcattagcaaatgtttactgtagcaccacattatcaaatcatgacgtagttaggcttaaaaaatttgtctcgcaatttacacgcaatttgtgtaattagttttttttgtctatatttaatactccatacatgcgtccaaatattcgatatgacatggtgaaatatttttgcgtgggaactaaacatgaccttacttccttgttccaaaacaacaaaagctataatgggttggagatacgaagtatcacgctataacaattttgaataaggatatgtcacatctagattgagttattttagtatagatggagtaattgctaatatcatgagatattattgaccgtgatgaatgttgaggataagaacaattcttccgatcaataatatttgatgttgagtaatattaaaatagtgataagtagaccaaatattcttaaggctcatttgaattgcaaaaatgaaaaaacggaggaataggaaaaacatatgattctaacatgaatgaaagtgtaaaacagagaattgtaaaataacgggaaaaacacaggaataaccgtttgattggaccatagaaaaaatacaggaaccagatgagagagatagattcgaaggaaattttccaagaggtttaagctctcgctaagttttctatgaaatctctgtaggattgtctatcccataggaattttaaagaattgaatataattcaatcatttgatttaaagacatttataaattttttttctataagattaaaattctctataatttttatgtttttctccaaatcaaaagaaggatattgctttgcctttcatagaatggaaaagtggaatcctgactagtggagtcgacagttgcgctgctgctgctgccgccgccgcctgctggccgatccgaagagcattaaaaaatacagcgggcggagatgctggtttctccctcctccgtgcgtgccctcgccttcctccatcgccgcttccctccccctccc

SEQ ID NO: 78576 - DNA, 27258 bp, Oryza sativa
aagacccctaagggcatggccaacgcagggtaccctaagtgctacctaggatgggccaacactcccaaaaagctaatttcccacagtgcaagggtctattcggctactttgtaccgctgctgcactgccacaaccggagaaacaatatacagtgcttgttggctgaaccacagtgaaaataatggcagccgaacagagcccaagttgcttcaggtggtagtctcatttttttttatttcagcccctggtgtttttcattttagccctcacaattttacaatttatatagaagttcaaattttacactaaacaccccaaaatccagaaattaatataaaatctctcctcctccctcttctccccaccgacaccccaatcccctccccacgcctctccagactccagctcgaactctcctcccgctgcctcttctctcctctcccctccccggtagcgtcggatcgacgcggcggcggttctctccagtccaccccttctccatcttcttccccggcgcggggcgatggcttgggtgaggcatctccccaacgcagttcctcgcccacaagctgacgaaactatgcggtcccgcccgagctggcgtgaatattcgccttgggacggatgagaccacactctagcgtggagcgttggctatggcctaataaataacttgcactgtatcgtttgaggagcttggtctaggtggcatccgaagcgcggcaaatgcggtggccgcactgaaatcgcccttagagcaaggataatagtagagccaacttcctactaatacatcttaaagcctacatgtataatcagtgttctaaaaatcggccctaggcgccgcctaggcgcccattaggcgctaggcgccgggtagccgccgcgattaggcattcaatggtgcattaggcggttaaattacttaggtagtgttttattgctattttagtgttatatagtctaatttctatgcaatatgcctactaatttcttgaatttaactatttgacccgacctaagcgcccgctaggcgccgcctaggcgaggctaggcgccaattaggcgctaggcgccccctatccgcccaactagcgcctagcgccttcttgaaccatgtgtataatagagattagctataaggttggctacaattttcttctcctctctctatctctcacttatatcgattatcctacgcctcggtcgcctggggaggggaggggaaaaatcggtcgctccctcccccccacgacatgcgcgcacgtgcaccctagccccacgatgtgtcccagtctacctgctacgtgtccctaccacatactccgttgcaacaaatcacacacatattttggaaaccctctattaagggatttcgtttcattttttgttccaccaaaaatgtttcacctagtgtactcacaatgtttcactatgtatagatgaaatgttgcagtgaactgaagcattcttttgcaacaaatcagccacatattttagaaaccctctattaagggatttcgtttcatttctgttccaccaaaaatgattcacctagtgtactcacaatgtttcactatgtatagatctaatattgcagtgagctgaaacattctttcgctatttgctaaaacattgtttttatataaggtgaaacaatgcccgatttaaacgattgaaatattttcgatctacttagtgaaacaattccgatatacttggtggaacatcgtgcaacatttaaaaataattcaataataagctaaatttttttcgtcagaatatatccatgtgtggtcttgttttaaagatttaattgcaacgaatttaatggtgtaattaaatcatgatttagataaataatttaagagaaaaaaatagtttaaagtggttttgcacgaatgcgtcatgctgacgttagcgcctgatttttcctcttccccagcgaacgctcgattctaagttggctcccacttatctatactaatataaaaaagtacgagttcatcaaacacccatcttttctgacccttagatcgattcatctaacagcttatatcaagatctgcccctcaattagcgattcccatgtcgtaaaccagcggttagcgaaaataaaaagaaaagaatccactaacgccgaaaaagaaaaaaaaaaaaagaaaagctatcctcctgcgcggagccgcctgccgccgccttttacgcgcccaccgctcgcctactgcgcgcccgccggcgccactccgctcgcgcgcggctgcactcaccgccgcctcctcccgcctgagccgatgcgcccaccgccgccgcctcctgcccaaaccgcctgcttccctgctcgcgccgcgacggagaggaaggagagtttgtgctgctggttctccattcaaggtggcttgggtgtgcgttctgatcgatttggcgttctgatcgatttggtgtgacgtgtttgtttcagcagggaaggactgcaaggagcaccccaacgtcaagcaggtatcttggtgacgtgtttgtgttcctctgctgcgttgcctgctacaatgtgtgttctgatttggttgatttggtggtgacaagttcaagtccatgcctgatgctgtgagttcctcacttcctgtgcccatgttccaaaccgttacatatgcatttctcacttgatgtcctattgtttgaaacttgctgccttttagaacctccttagttgtctcaatgcttttacttttattactgccatgttaatgatcttgtggctgagtccttctgttttcatggagtgcattgcattaaaaaagatcccgtagatttttcttcatttgttaattatattgccaaaacgtgccttgcacgcgcacgataacatagtcagcttagtagaaagactgcatttttttcaatatttgcaatctggtttattttgagacatggtttgggcttgattattatctcattcttttgctgtactgaaattggttttggatttaattgtggactatgtctgtgtcactacaacatcaggtattggttataattcagctagaggaaagtagagtactttgaagtgtttgaatggttttcacatgtatactctgctagctaccctttagtaagtatattcatgtaaaggggagtaatagatcattgcactaatgttcaaactctattgagattgtcccaggtgtcactttgttcactgaaaaaaaaagagaacatttataggttttttttgctgcttgggagaggatgctgccgaattgaattaagacagccttcagaatctggtatatctaatggtctgtaaaattttacacaagcaacaggagggaccatcaaggtgagtgattatcttatccattcactggcagcgtacattgtcttatatgatgagaatagagttgaaatgtatttgagttcttatttcagtgcttcgtggtcgtcatttgctatgtaaacaattactaaactaataaaacacttaaatgttgcctgtcaattagatttttttaatatgtattaagattagtacgcagcccacacttttgctttctgtggtaggccaagtccatatccttattaggattaggaggaaaactgatgctccatgtgcccaaaatgtgtgtgaactgtacaagttagataataatagatggttggttagctagatccaaaacttgagctttactatggcttggtgccctgttatacaagacgtatatggataatgttttcagtattctgctttgtttgctatcagtatttttagtgcagaaatgcctcaagccactgtataatttgtatatatagtgcaacttggcagttaacaatttcctctttcatgtgattaattttcctgttacaaatttgcttccatatattcgtatccagaatttacttagcctaaagatatcagaaggagaacatatttatggagtgccgatataaatcggtaacccaacattcatgagcaagtaattatcgtgttataaattttatgccacattccagagttttataaccttaaattttatcttattacacacaccggaatcagttttatgagtcacaattcatgccaattgattaggtagattttaagaattaaggatttaaaaaataatgctttaagatgatagaaagagaacatatgctaggtaacccagcattgatataaactgacaacatgctgctgctgagaatatgtgtaacaatgccaaaatctcacatcatattatgtgtaacagggaatgtttcacatgtgatggattttgtatagaaaaaggagattcattgtttgctgaaggtgtattgaaagttgcttgccgataaataaagaccccatggatagatgcaatgatgcattaagctcttgaaggaggattaacggaaaactatgtcgagtttttagtagccttgtttgggctaacgacactcggtttattgttctagatctctgacctaagaatcctgttttagttttttttagatctcttgctttgggtgttgtttgctctaggtgttctgttgtccgcagtttcaggtgctttgtagtgtagtttagtttgggggtgttctcaaggtgttgtacagtgaattggtttcggtgcttgccctttgttgcgttggtgttgtttatgttctctatatcgatgaaagatgttaaagcttttgcctttgtttcgaaaaagattgaaaccacatacaaataaatggttgtgtgaaatgtaacattcatggatgcaaaatttaccactaagttatcaaatccagaatcatggcatgtactaaaatgattaatattatttataaaatcataaaaatgcttcacctgtaagatggcatgttaaaattaacaattgtagataatacagagtatgttttgtacaatttatattggtatatacgtgcattacatgtgcaagattactagtacatttaatatatttatttaatgtatttgtattagcttgcaatagcctcaggcctcagcccttagtaaccgactcgaacccaaaccgactatcgttccttccggctgacttaacaggaaaaggtgcaagagaacttctattggccgttcgacacgcgaaaaccaacccaatggtggcggccaaggtgtcgacccctgccggcggcgcggtgcgcgacgggctccggcggctcacgcagctctcgctcgtctccaaggtctgctcggagctggaggcgcacctcggcgtcggcgaccgcgtcctcgcggagttcatcgtcgacctgggccgcgcatccccttccgtcgcagacttcgacgccaagctcaaggcccacggcgctgacctgccggactacctcgcgcgcaccctccacaccgtcatccacgccatccctacccacgccgacgacgcccccgcccccgccccccaaaaccctgcctcccgtggcaccggtgcaagggtttgcgggaaggacaaggcggaggagcgggtgagagatggggatccggggctgtaccaggtgtgccgcgggaaggtcaccggcctggcggacgccgggtgcttcgtccgcctcgacgacgcgcgcggccgcgaggggctcgtccatgtctccgagatgcccggccgccgaatcgccgtgaagcgtgggcaggaggtgttcgtcaagatcgtgtccgtgcaggggcgcaatctggggctgtcgatgcgggacgtcgaccaggacacggggaaggacctcctaccgttgcagcgtgctaggggggaggatgatgtgccgaggccgatggcgaatccgtggaccgatcgagccgccgccactaggagaaggacgggggtgtcaggaattgtgatccccgaggacaaccagactggcacggcatcgtcgcggcggccgattaggcggatgagctcgccggagaggtgggaaatgaagcagctgattgcttcaggggttctgaatgcgaaggattacccggcgttcgatgatgaggatagcgaggggatgaattaccaggaggaaggtgtggaggaggagcttgagattgagcttaatgaagatgagccagcattcttgcggggacagggtcggtccacaattgatgtgtccccagtgaggatttccacgaaccctgatgggtcgctgagtcgagcggcggttctgcagagtgcgcttatcaaggagtggcgtgatatcaggaacgaggatcaaagagcattggttgactccatcccaaaggatctgaatcggccatgggaggatcctgtgcctgaggtcggtgggcggtatctcgcacaagagctacgcggtgttggattatctgctgaaagcatgccagagtggaagaaagaggcttatgggaagactgtaacatttggtcagacttcaaggctttcaatcctggaacagaggcagagtcttccaatattcaggctgaagaatgagcttatcgaagctgttcgtgacaatcaagttctggttgttattggtgagaccggttcagggaaaacaacccaggttacacagtaccttgctgaggcaggctatattacgagggggaaaattgcatgtactcagcctcgcagggtcgctgcagagtcagttgccaagcgagtatcggaagagtttggttgccgattgggagaggaagttggttactcaatacgttttgatgatcacactggaccagatactgtcattaagtacatgacggatggcatgctccttcgtgaaattttgttggacactgacctctctagttactccgtggtcatgcttgatgaggcacatgagaggactatatatacagacattctctttgccttactcaagaagctaattaggcgtagaactgatctcaagttaatagtcacttccgccactcttgatgcagagaagttctctggatatttcttcgattgtaatatttttacaattcccggaagaacatatcctgtggagatactctattcaaaacagccagagagtgattacatgcatgctgcgctgctcacagtatcacagatccatctgactgaacctgaaggtgatatcctcttgttcttaactggccaggaagagattgatcatgcctgtcagtgtctctatgagaggatgaagtctctaggtaggaatgtaccagaattgctgatatatgcagtgtacagtgctcagccagctgaaatgcagtcaaagatctttgaacctactcctcctgggaagaggaaagtggtcgtggccactaacatagcggaagcatctattacaatagatgggatatattatgtaattgacccaggatttgcaaaactcaatgtgtataacccaaaacaagggctggattcactgatcatcacaccgatatctcaagcatcagctaaacagagggcagggcgtgctggacgtacaggcccaggaaagtgttatcgtctatacactgaaagtgcctatcgcaacgaaatgccccccacaactactccagaaattcagaggatcaacttgggggagacggtcctcaatatgaaggcaatgggaataaacgatctactgtcatttgacttcatggaccccccagctcctcaatcactcataactgcaatggaacaactgtacaaccttggtgccttagatgaggagggtctccttacaagagtagggagaaggatggcggagtttccacaagaaccaccactttcaaagatgctccttgctagtgtggacctcggatgcagtgatgaaatactgaccatcattgcgatgattcaaactgggaacatattctaccggccaagggaaaaacaagctcaagccgatcggaaaaggggcaactttttccaaccagaaggggatcacctcaccctgctcaccgtgtatcaggcgtggaaggcaaagcagttttcaggtccatggtgctatgagaattttgtccagctaacatccctgaggagagcacaggatgtcagaaaacagctccttgagattatggacaagtataagcttaacgttgtctctgcagggaatgatctcaccaaggtgaggaaagccatcactgctggcttcttcttccacgctgccaggaaggatccccagggaggatacaggaccattgctgatcatcagcaggtgtatatccaccctgccagcgctctcttccagcagcaaccagagtgggttatctatcatgaagtcgtcatgaccacaaaagagtacatgagggaggtgacagccattgacccaagatggcttgttgaactggcaccgaggttctacagatctgcagacccaacgaagatcagtaagcggaagcgccaagaaaggattgagcctctgtatgacagatacaacgagccaaactcatggcgcctcagcaagcgccgagggtaatttgtctgtatatagtttttacttccactatagctgctctttatgcaatgtaagctgagtacttgtatgtaagtgtaaatatactctgctgataagttccaatacatattgggatattaagcttgaccatcttgtttctcttttcatttaggaagcagatgctgaatgaggttgacaattttgactgtttctatattagttgatcctgaaacattactatctttcgcttatgtttcgtgaaacttgctctttatttcatctcgaaaatttacacattgaactgttctgttcggggttgtcgagcccagcaatcgttgaagccttttttcttcagcgtatatagtgatttcctatcaagcagggtttgtaattttgaaagtaggatttctaccgcaggtgggcgatagaactgaaattttggaaatttcagattttttttttcgtacgaaattttttgaaattttgactgattttgaatgtatctgaataaaatttgatcaaattcacaaaaaattacaaaaaaaccgaaagtttcggacaagatatgagcatttcggtgggggcgaaatttccgaaatttcgaaccgaaatttcaaaccctgctatcaagcgccgaaatttggctccgtagccagaaagggaataaatttttcacacaacgaaatgataggcggtattgattatggaggtcataaaaacagaacgatgaacttttatcgctgcagagcattataggaacttttatcgctgcagagcattataggataatttgtattcgatgttcttttcagcactacaaatccgcacaacctttgctgtttcagtctgttggtatcacagctgaaaacttaggcattctccagattaatttcctgccaaaagaaatgttttacaacctttgaatatgctgtttcagttttttgctaacatcacagctgaaaagatttctccatattaatttcccgccaaaaggaatgttttccatatttcagcagttgctagtgacctcaaaagagtgaaggaatacgctttaactatctaatcagctttcctattctgcaaaaaaatgaacccaggcttccaggcatgcaactatatgcagttcctattatgcctctgttttcgggttatagatcgtcccaggcgaagccgtcgtgccgtgagagcatcaagcaagacatccaatgaacactccacagcttcagcctgctttcccagctcaaaggcaccgagctcggaccgcatatccaattcccagaggaggccagaagctgctgctgcggtgcacgtacgatcccacgctggctgcggtctaatatgagagcaatgtcaacagaagtgagttgcaggcagccaaagaagaaaattgtttaaagcaataatgtaggaagaacttgtgtcacctcaccttagcttatgcatgactgaggcgctaagcgtagacagtgagatacaaggtatgtcttcctctccccatattgcagtccatctctcctgtataaaacgttaacattagggtttacttagctgaacaaactggatgtagttgtgttccgttttatctacttgttgcataagcattagagctttgaggaataaagagttcccaaatgctgagatgacaacaaattatcgctgtctaaagatattaggacaattggctgagacttaaatggaagtgaccgaaatcagagtcaagcatcagagtcaaaagaaacctgcctgataaaggtgctcatgttgtacaatcaagtagtccaccaatggacctgtttggggtggctactggctagtgcttcctcaatcctcagaagcttccttttggttgtctgcccttaggaacctttagaagccaagctagaaacccatccatttttggtctgagctagcttctttttgttcatttatagtgctcgcttgccttaaactttcttttgtagtaattcacttgatgtattaagtttggtgatgagttgatcgcacgagaatattgttttctttttgacaaaattaaaaagtgaaacatcaatggtgcagaatcactatcaaaacaacaatgaaatatcatttgatttcatctacaaattgcaaacacatctgcaaaagaaccattcatgttgagtggtttgatctgtgctcacagacccaataattcttcctttatttgataaagggatcatggccatttttttttctaccagcacaatttaccaaatcaatcaaaaaatctctgcaagtcatcgcataagaaaatatctacttctaataccacccatttgcatcagtttctggtttggagaaaatacagtttggaacccagccaaaaaggcccttgccattgaagacaattaaaatttctcctttggaaaaaagcaaattagatcattaatctcaatctttcttttgtggccaagatgatacaagcccaaacctgttctatactgtgaatgggatctggaatttgtcttgagatttcgagtaatggtgcagggtgctggactttgtgatcttatcaagaatacttttcaaatctaagtgggaaaaagtacgaattacccccctgaactatcgtgacagtacgaattatccccccgaaccacaaaaccggacattttacaccctaaactttctaaaccggataaattacccccctaatacaaactggagtggttttacatctatgtggcgtccacgtggcaatccgatcagaaaaaaataataaaaataattaatgggcccacgtgtcatctcttcacactgtctctatctctctcagatgctcaatacgaggcgagtggagtgcgtgtcctactcatccacgtaaccacatgctccaattccatctcaaggatcaagcaatcccggacgccgccgatggcctcgcgctcgcggtggtagtcgctggcggcgagcgcgctgatccagtgctttgcggggagctcctactgcttcgccgtctactcctcggcactcaaggcctcccaattctacggccagtccgccctcaacaaggtcgccttcttcaaggacgtcggcgccaacgccggcgccacctcgtctgggcagccggcggcggtggcggaccaggcagccataggtggaggcggcaggcagccggcagcggaggcggacagcggccacactccacctcgacgccgtcgacgccgttctgcgtcaccacggcgaggaagctcgtgtcctggtgcgcagggagccccagcctcccgccgacctccaccccactgccaggcgccacgtactccgacagccgaagcatgaacgccatcgccgctgcctgcgcctccccggcctccgccgacgttgcaccgccacctccagcgcctccaccgtcgcaccatccgccgcaccgcagcctccaccgctgtcagcttctccgtgtacgcgagcaccgcctcctccgggaacacggtggccggccacatccaggcggcgaaggcgcggacggcgtcgggggagagcgggtcagcgatggccaggctctcgtagggcaggccggggatgttgccgacgtagcccatgacgagctccacggagacgtgcgccgcggcgccgacgcggccctttctacgactcccgcaaccatctccccactgtcaggagccgcggcggcgagccgatgcgcgagtggtcgtgaggaggcagtcgcatgaacgggaccatgccggcgcctagtcggccttcgcctccgtcgtcggccgccattgcctacctgcggagccgcctgcctgagcgtgcacacgggagagagaggggtatgacaggtgggaccaaggaaggcatttttatttttatttgctgactggattgccacgtagacgccacgtgtgcaaactcaagtgaaaaccgctcaaaactgtgttgaggggggtaattcgtccggtattaaaagttgggggtgagtaatgtctggtttttgggttcaggggggtaattcgattgaccgcgatagttcagggggtaattcgtactttttccaatgataaaacagagttagcgaaaactcaagcaatgatatttcttaggaattactaattatcctaaaactttcaagaatattaatatgtattaggtatgtgatatactttgttatcattttattcaaatatgggtatactgtctacagattatctggatatattattccaatataggtatgttgtctaggcatttttaggataaaaattaagagtaattggttttttctaattgccaatgaggttttttattttcaaatatttcttatctttatattataatgtactcttactgataatacatgtaattggacttggctactagtatgcatcacattacaacacgtcgaggaaataacaaccttcacatttgcttgaataaaaagttagtcctctctaatcgtattgtaatcaatcatcaaaatcattaggggcctagatgcacttccaatctctccatttttgctgattgatgacaatacgattagatcacaagagagaatgaatataatagatgattttggtgcaaaggtttagtgaaagctccccctcaaagtgtgcattaaagcaagtgaagagctccccgtaaatctttgcatccacattgaatctcacaagacaacaaatatatcacattttactcatcacatacatcacttcatatgcataataaccattacatctcatcacaagcacaatataaaggaaatgagacattgcatcacattaatcataaagcataataatatccattacattccaaacatccataattaaacaataaggtcttacaataacattaaactaactcaagaaccacacatagtcttatacaaagaaaaaccaactatgatcgaccataataaaaggatagatattctccctttttggcatcgaagcaccaaaaagagaggacgaagagagaaactcagacaaacggcgcctgggaggatcctcaagaggaggatagcgaaagccatggccaaaattgaagaaatcgtaatccggaggcatcccagcaaaaggatcctcgatctcttcctacccatgctcatcgggctcggcctcaaagcccgaaggggagggagagacatccacgtgaaaatgctcattgagctgcgcctacatgttcttgacgcgccgagccgtcttcttgacctcgttccacgctctgcggttctttttggcctccgcagagcaaaggccaaagagactcagcaaaatgcggaataagggagactgctcacaacgagccacaagagagggacgctcacgaggtagtaggaggctgagaggatgtggaggggatgtcctgaggcacagaacaacgcttgggtaagcgcagggagagagatgtatgtggctcctcacatacaaactgaatctgagagacgtgctcaatcatccgcatcaggtgaggagcatatggaagccccctcctgtactgaagagatgccatgaccgcatcttgaggcggactctgactcccaaggatggtgatgcaaacaacatcaaccattactcccgctccgtactcctcaggttcaatcctccctgtcgtcccttttcatgtatttcaatttgtttgggaggaaatccgcatggcatctcttcagtacaggagggggcttccatatgctcctcacctgatgcggatgattgagcacgtctctcagattcagtttgtatgtgaggagccacatacatctctctccatgcgcgcagggccggtcctgagttttcagggccccagtgcgaaactaaatgttggggcccttaacatactactacaaaacaaacaattaagcgctaatgcccgcgacgccatgcgtcgagatgacctacatatgtttatgttttgatatcgagagattagacagcagtaattaaattaataattgggctacggagatggtgtattggtgtgctgattactaaccttccgaggggaaggcaggcgatggaggcttaggagatgccgagcagcagcgacgcagtagattgcgtcgtcgctgagcagctggcagcagcaaccagggagattgcgtcggtgccgagcagctggtgatggccatggagtgaattacgttggcaccggccgccggcgacacgcgatgcagttttgatttttggcttttcgccaattcgccatcgcccggtcgccgatcgctgagcgcgtgcgcgtgaagagtagaggaggggatgtgggcggcggctatcacgcgcgtttctgttttcttttcaccgcggggcgcttcgctttccggcttccgcgcatgcatgcgctcaagaaacaaacaccaggcgagcccggacgggagcgcgggtcggggacgtcgatcggggcccctgcaatctgggggcccagatcggcggcaccgctcgccccccgccagggccggccctgcatgcgcagctgcccactgctccgcccgctcacgagctgcctccctcgtcagctcatcatcggtgttgtcggaggcggagacagagctattggtgctactgtcgcgcaaagccttgagctctgccgccgccgcacgcgctgcatctgccgctgccgctgcttccacttctacccttgccgccgccaattccgccgccaccagccttgatgctctcgctaccatcgcagaagtctctgccgccgctcgctcgtgttcccctaccgcggcgagctcggcctcctgccggagccgcgcgctcgaggcgaccgagcgctgagactgtcctacggacatggcacgctactgggaggctgctacgtggggaagaggctgcctctgatgagctgctgcttgtcagcacaggggaaaagggatgagcaggaacagtcggtgttcctgctgccggctgaggacagaggggagctcaagaaggggatgagcaagagatgtctaggctacaggatagaatggctctgataccacttgttagtagcaaaatctttactctcattgagaggatggcgctaggagagttggggcaattttctgtttattttctcatgaatgccataccatctcgggggagggtgggatacatatttatagctggtagctggctggctgcagctagtctagagcatcctagagctagtctagatgctgtcctagaaagtgaaaaaggaagatgctgtcctagagcatctaaaacagaaagtgaaaacgaagattatgcctagagcatcctaaaagctgaaaaagtaaaaagatgcaaagactaatcagccacaagacttattccatcaaaccataaggttgaccttagagatggtcagagtcaagatgtgctataaggatcaacagcgtactccctccgtttcaaattatttgtcgtttcaaggtttgtcctaagtcaaacatgtctatctttgaccattaatttttagaaaattgtgtagtttaacatgtgaattatatattatagaagtatttctcatggtgaatctaaaaatataaatcttataatgttaaactatactccctccattccataatataaggcagaaccacttttcttagatgttccataatataaggcatgcatgcaagcatgcaattaactatgacatatctctattaaattactacttttttaaaatattccactctctatgttatctaatcctatcggatgcatgcattatatttattaggatgatctaaactataagatgataataattattttttggtctttgggttaatggtggttgtgccttatattttggaatggagggagtatgagtttatagaaattgatggtcaaagattaaaatgtttgacttagtacaaatatagaacaagtaatttgaaacagagggagtaccatatttgttttcaattctgcttcgctttcatcagccttattatgagtttgccaaagggcagcctcatattcaatatactctcctcccttgaagattgtcttatgttgatgcaagagtaaggatagatgtcttattcttcagtgttgacatagaatggctgtagaccctcttctctcttgtagttagccttatttattccaattcctaatctataccataaatcaaagcccttttagcgcaaggttctctcctccgaatacaattctcactaataggagtaactatatgccaatgtgccaataattgtagaagactttattattatcctaaataggcggcaataggcccatcaagaaaaagtctgactaataaatagtaatatagctagttgccacacatagacttgaggtaagggcttactcatcctagtcttctctttagtacactacttagttataagttataggatcagaatgagattttctttgaacgccgttatggggagtgagaaagcaagctagacacgaaaactcaggatagacaaaggaaaactcgggatagatgcgctgcttttctagctttggttggaaatagaaaagtaagttatagggcccatgcggcattccctcaaatagcagtttttttttgtctgaagaaaagttgctattaataacagtcttccctctttcataaggctctaaggctgagttcgggagcgagggttgggaaccttcactcccaacacgcaaaacggagcgacgatcagtgcatgatttattaagtattagctaaaataaacttgaaaaatggattaatatgattttttaaagcaactttcctgtagaattttttttttcaaaatacgcaccgtttagtagtttgggaagcgtgtgcgcggaaaacgagagagttgagttgggaaaggttggggaagaacacagcctaacttgtgtatggaatcagggagctacagttgtttcccgccccttctgttcggatcagatactattctctacggaaattgaaagaattctttgataagataaaaaaaattaattcaccatggtaatatctcataaccctgttatgttcaagtgtactataataagaatttcaataaaaaagattgaagcccacataattgtgtgtcagtgtcactctatgtacttggcagtattatgactccctactacagtgaaaaaacagtatattccaaaagtgatcttgatctggagaatgaagatggtgaacaattatattctatctacaaaagatctctttccaggtttcctttctgttttgtttcccttcaatcttcatgcttcaattatttgttattaagttaccaagttttccactctttctttaattatgattcctgatgactatggatggaataatttcatgggaagaattaattccaaaagaggaagtgaagtcggggcaaatgaggaaaacgtcctacagcttcgtcattgggcttctcttagagggcagacactttgtagaacaggtagtttgatcataccatctgccttatcttatcaaataaggatgatttggctgactccctgttatatttgttttctttttccgtgaatcatgatgtagcatcaagcgttccttgacatggttttttaatctagtaagcctcttcagattccaggtggagcattatttttagttccttcaaaaatagtcctgaatctggaagactttacctagctaatagtggactgagttttcaattatgaagcaagcatggatgagggggaatagtgcaattcaagaagctatgggatctcagtcaattgtgcagctagatcttttgatgaccttagccaagactgaactagcaagaggtttcagaagcaccctgggggatttcataatcatgacgcttcagctctgttcagtgttcttcactttctaccttgggaccaagtcacattattttcgacacacaattctccatggtggtgcaaaatatagagcaactggcagatgtttttttgttcgccatgtaaggttgactgagaaatacagaatgtacttcagaagccactttgtgaaaggacttgagctgatgttgctgctagtagtctatcagttttaaggtgatgttgctacggattcatctgcctatatacttctgacatcatcaatatagctcttggttatcacttggctcttcaatccatcaggatttgattggcagaaaatggtagatgactggaatgactggaccaagtggattagcagtcgaagtggcattggggttcctgctaacaaagcttaggaatcctgatgggaggagaagcagaaacatttacagtctacaggtctactgggctgtttctgggagatcatactatctctcagattcttcatgctccaatactgtatgtctgtatcatgtatcactgaacaaatgcacctagacacatatgttgctactttccagacacacaaaaatcagaattacttacttaactaggtaatgagcccacccaactacctatatggaaatcggaattatctataatttaattacgcaatgagctcactggagctttcagttgttttagtaaactatctagtctgaatcatggtatcaagataacatgaacaaataatgtttagatgtaaacagaaatccagactaaagagggagtgcattacgttgaatgtgaaactcactgaactaaccttgagccttctgtataatgcagcagaattactccatgtaccatcaagcaaaacaaagttaaaaggttcatctttcacatcctacattgcaaaagatatttcattatttcatccatacttatttacatgatgttttagagtgtgcagcgaacctatttggatgtgccatgtgcagatgacattgtgtagatgtctcataaaggtaatctttgagaacttataactagaaaaaggaatggtcaaatgggtgtgggtaattgatatcttattgatgtcttaaaatgagaagtaagaaagcatggaggaagtaccatgttacttctacaagaaaatacttgttctaactgcattagcatgggaaaccagttaccccaaacaccatcagtacttatcatgttggataaaaggaggtgattggaaaaacagatcctccaaagaaggcagcattgtttatgctatagaaactttactaaagataggtgtgttggataagtctttgtggtccttggtcgtgattcttctttttgcttttgggtagtttcacctttttcaggacagcatctaccctttagcatatttttcagttgctaggacagctgcggttagtaggacagcagcagttagtatctcctttatgcctcctttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacatctggtatcagagccacactttcctataggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgggcagagcggtgggcagcagcccacctccacggcggtggcggcggcccaagggaccgcgcgcccgccgacgggaacccagacgggcgcgggcgtgccggcggcagcccggagcccacacgtggccctcacagacagcgcggctctcccctgaccggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcaggcactggatgccctcatcgctgcagtcccgcccgagatgcagttctcgctttcccagaagcggactgccaaggaggcctgggacgccatcactacggcacgcatcgacagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgatcgaatctctgctggacctctccacaatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagagggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagcaggcacgagacgacgcctgccgcaactgtggcaagcttggccattgggccaaagactatcgacagccacgacgcggccaggcccacgtcgcacaggtggaagaggaagagccggctctgctcctggctcacgcaagcatcgagctacctccagcggcaccggccgcagcggctttcctccaccttgatgagccgaaggtactcgtctccctctgcaacggctccagcaacgacaaggctgatgagtggtacctcgacaccggcgccacccatcacatgaccagccgacgggagttcttcaccgagttcgactccggcgtccgaggctccgtcaagttcggggacgcctccggcgtggagatcaagggtgttggctccgtcaccttcaccgccaagtccggtgagcacaggctgctcaccggaatctactacatccccgcattgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtttgcgtggtgacgaagcagcggcggctcccctttccccagcagacgagcttccgagccaaggagtggctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgttgtcgagcggcgcaaccagacggttgtggggatggctcgggccctcctcaagcagagggggatgccggccatcttctggggggaggcggtggtgacggcagcctacatcctcaaccgctcgcctaccaaggccctcgatggcaggacaccgtacgaggcttggcatgggcgcaagccggcggtctcccatctgcgggtcttcggctgcctcgcgttcgccaaggagcttggccacatcggcaagctcgacgacaggagcaccccaggggtgttcatcggctacgcggagggctcgaaggcctaccgtatcctcgaccccggagacacagcgtgtgcgcactgcacgcgacgttgtgttcgacgaagggcgagggtgggtatgggacaaggcggtggacgatggttcgactccgacgtacgacgacttcaccgtcgagtacatccacttcgagggagctgggggagtaggcagctcttcttcaccgagcgtgtctaccccagccctcgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccagtggagttcgctactccgctctcccacgacagggagcgcatcgacgcgtaccacgacggcgagcagctacggtaccgtacgatggaggatcttctcggcgaccaaccggtgccaggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgagcgatcacccttaagtgggtgttcaagctgaagagggatgaagccggagccatcgtcaagcacaaggctcgcttggtggcacgcggtttcgtgcagcaggaggggatcgactacgatgatgccttcgctcccgtggcacggatggagtccgtgcgactccttcttgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatggcttcgagcaaagcccgcacgaggcggccatctactggcggggcaatggaggaaatgccttgctggtgggtgtctacgtcgacgacttggtgatcaccggcaccaaggatgcggaggtcgcggcgttcaagtgaggagatgaaggccaccttccagatgagtgatctggggcctctctccttctacctggggatcgaagtgcaccaggacgactccgggatcacgcttcgacagaccgcctacgccaagcgcgtcgttgagctgcctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcaatcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcaagtgcctcgttagctggcagtcagtcaagcagcaggtggtggccctgtccagttgcgaggccgagtacatggcggcctccgccgcttcgacccaggcgctctagcttgctcgactgcttagtgttctcctcggcagagacactggaacggtggagctcagggtggatagcaagtccgctctggccctggcaaagaaccccgtttttcacgaacggagcaagcacatccgggtgaggtaccacttcatccaaagctacttggaggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgttggaaaagtctttgtggtccttggttgtgattcttctttttgcttttgggtagtttcacctttttcaggacagcatctaccctttagcatatttttcagttgctaggacagctgcggttagtaggacagcagcagttagcatctcctttatgcctcttttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacagggtgtgcaacagtgcaacttattaatacacagcttaaagaacagaataaatacctcctccggatgatcacaactcaagttcaaaccatcaaatttaagatctttgacagacatgggggttgtactcttattcggatatagaaatgaaacctttccctttcctggcaaaaaccatatcagaatggaaatatacagtatttaaacatgaagtgcacagatacatatatccttgctaaatatagcagggagagtagagatattagacgacaaattaatgaaataatcttccatgggccacaagaaaattaattcaaatcttatttctattactagttcatacatttttacttctggtttggatttgtttctgtgaaacactaccctagttgttcaatgcgccaacaggttcaaaacagcagccacgaagacaacttccaatatgcaacagtatattcatttatgcaatgattaaaatagaaggatagaatgcaaacagaaaaggaacatcgataatgcaaatattttcagtactagcaatgcattgatgaaataacaaagaaaagatcccctggtcattagattgtcagtaaatgtggacatttttaagctccttctaaattaaaaatgccactcaatatgtgaagagggttgggacaggaatacacttatctagacactagcacagagaattccaaacgagcaaatataatcttttactaagcatttgcatttctaaagaaaggtatgttgcagtgtaatcactagcataatttgtgtagttcgcactaattccctgccccttccaagaagaatacttaacagcagttgagagtctaaaggccagttatgtttccagatcataaacaagagcttaaactttaaacacatcgggagagattgtgtgcgccaaagaagcttaagagaaaaaaaacgttgaacaagcatgctaagtgaagctaatgtaaactactatacagaaaatgggagctcctgaaagcattagtatacttttttaatgtaactgatttcatatgtttaacagatgaaagttggcattgacttttgtaacaacctgaacgctggaaagcatcccacataatgtcttcgtgctcttggatgccaaagagacacaagggtgcagcttggatgccaaatacttgccatagtaactttccggtattgttttggcgcaaaaagtcctgcaacaatagagtattagagatactggcatacccagaagaaagaacagaacaagaaattcaacataaacccctttgaagagaccttcggatgcatatatagccagaatctaattccctgccatagattgcaagaaccaagcttcgcacacatacaatcttccattggcagccaacactgtagttttaagaggtaggcagatcaggcaaactgtgggaaatgaagaagagcaaagaaagggcacataaatgttagtagcaaaaataagcttcagttgaataaaccattaaggcctgattgctgcattgtgtatgatcgctgcaaaaagaagtgattgacaagatgtgcatatactagctgacactgtcacatcaccttctggcacagatatcctctactccctagcaagcggcaagcaatctgccgcgcggagaagtactgcagcttcttgtccgagtcggcgagcgtctggtagacagccctgtgcttcttgtcctccatgtctttgaaatcaccctatgagtaaccagttcaagaaacaagcaaaccatgagccgatatcagtttcaattcctgcaatgctgtatcacctcgggaatctgcaagcagcatccaggacgtggaaggggattgagatgaagccaacaagccgtttaccttaatcttggagccgacgccgccgaagcgcatcttctggccagcctcggcctccatctcgagaagctcgccgacgacggcggccaccgcggccgggagcggcgaggaggtgccccaccgcctccactcctccgcggtgacctcgccggggccggtgacgggcgggagggcctcctcctcagcctcttcggccgccggctccgcggagaaggccatggcaaagcgcgggggagcacggtgggtggggggctggaggaggtgggggcgaggggg

SEQ ID NO: 78577 - DNA, 601 bp, Oryza sativa
  unsure (1)..(601): unsure at all n locations
ggagatgangggatgancagcggctacataacncaccacatgtgtatatctatttaattggttgtgcgttgggagtcatttattatacggtgatcaagttttttttaattaatactgtgatcaagttttttcatgacaaatagatggaacctagttctttcccgatagggatggatatcaaatcgccattagtaggtgcaatctcgcaagcacaattgtctaccattgattgccccattggaacaattccaatagtgcgcaacaacaatttggccaacatgatggtacaacgtattggcacactggctaatgatgatttaccaatgctggtaggttttttaataaaattttgaaattatatagtaataaaaggttggttatgatattatagactattgtatggtattgcctcatgaatagttgttgcatatttacgaagtatgatcattttcgactcaatctttgagtgctaacatcaaaattctcaacgagacataatataagatgaaatatgtgcaatgttcccatcttatgagcaattattattaaaaaatagaaattcagagatcaaatgcattttaagaaataagtaacttatttt

SEQ ID NO: 78578 - DNA, 615 bp, Oryza sativa
ttattaagttgtacaaatgatgaaatgtggtccccattatttcgtgttcaaaacggctggttaacactaagggtagcgtgtgttccatagaaactattatcgtcccagtatttgatacctgcatactacaagtgaaagaataatattgaaggtaagtcaaatagctttgcatgccacattagaatagaaaagaatttaatgaagataaactatttttatatacaatctataattgacaataagataactaaaaaaatgttaaagggtatacctcttcttgtgaaccaccattaggcatatgtgcttctgagctattgtgacgcagtatcggaattgttccggttgggcacttgatgtcggggaaatttgattctgagatattggatgacagaatagattgtatatcaagatctaatggataagagcttggttccatctgcgtaacaacaaaaatgaatcctaatcaaagatcgaaaacaaataccaaaaaatacacttatctttatattggacggtaaagggaataaatacgggaatccctcagttgatggctttcccaatatttcatattaaagtatcatgatgatatcttatataatctactaatggatccta

SEQ ID NO: 78579 - DNA, 10040 bp, Oryza sativa
aaagtaggcaatttgataggatgtcttatgttgtatgtaatagatagagtggttacacaagttaactatttcggattatccggcaaatggcctaacagataatccgataaaaaaatgttggataatccgcacccgtcggattttagaggtactacatccgcatcaaactttatccacatccgctagatttctataaacccatactatatatatcctcattttggatggattccaagcggaccggattggatatatattatccgattcgctttcaccccctaatgctttattgccaaagttttaatttggaccacccctatattactttagactaggtaatatgccattgttgtaatttgagccacaccaaaccactttgttcagcgctataacgacctcgaacacgttgactctagcacactgatgaacgctcccatgcatgcacatgtgttgatggttcttaaatcataatatcgaaccgtcaatgcctacatataatgaaatgaaatatgatatccaacttagtagtagggattattactaatcattttcactagtgttggtaaaatatgtgtatgccggtattttctgaagaaaacacacccgtcatgcgataaaatacacctctggacaatcaggacgcgattgcgcagattggatggctcacatgtcaaacaaaaccacctagaattgtgccgaaccaaggtacaacatgttgggagcccaccaggcagccccctgccaaaggagtggtcaggaggcggcccagaagttcggtcgaacaccaaggttggccgaatcgacatcggcgcctctcgccatctgcttccacgtatacgctcctgatggcaccccaatgacggttacatcgggttccacgacagttactgccattacaaccatcatatggccctataaaaggagcacaagtcactctcaacacacacacacaaatacaactatttggagtacactcttcttcctatctagacttagttacttcttcttactagaaaataggtagagagtgaggggaaactgtagaggagtgcccgaaagtttggcactctctccgactttgcagctttctaggaggaattctggagaagtacaggagctgtcggtacactctactccgggttcggagaaacttcttctataaagttaatatttgggatcctttcttatgtaatttaattatttagtccaaatgagatagatttccatctttgcgggtttattgtttagtattcgtactaagtgttctagtactaggactttagggcctgttcactttgatgccaaaaaaaaccttaccaaaatttggcattgccaaaattttggcatagacttaccaaaattttggcaggatttcttatatagttaccaaaatttggcagcaaactaaatgtagccacttttttggtaactttaccaaaatttggtaaggttgaaaatggcatcaaagtgaacaagcccttatataaacaaggaaattcctgcgcaagtattagagtagtaattagtaacttaggcatggtgtctagattagagattacctttgtttgttgtgtatcctacgaatttgtcagaggtagacaacaggtggtgatagccctgaatctcgtcctagcaatcctccacgttcggatacatcatagagctatagccggaaccacactggcagatccgcaagggtcaatgcctgaagcaacatataggaaattacctttaacttagcttagataaataaaacacataaaagtcctctctaaactagctagcctaccaatagttgttgttcttggatatagtctagattacacatccctgagttcgatatccttttggggtcacccgaaggtgaaggtcgtaagaaataccaacaacatacaatacttttgatgaaagagcagtgagacatggcttaaagaaaacagagttgggacaaatcaaatggcaacaaatgtaaagttggcaccaaattgagaaggtaagccataggatagtccaaattaaatgaagctttagcgataaaagttggcccaaacaaccattcactcaatcactaataccctggcccacctcattatctcacagagcttctatgagcccatactacagatcgatagcccgcttcttctctcttcccctccaactcaacacaaacctaatgtggcaacgcttatagcatgtttataccatcttattatacttacttgctctaatggtggcaacgtcgaactaggttgctggtgaatatggtgagaatctcaaggtagaaaaaaatacattatgcgaatcgtatggctatatggggagcaattttgattctacgtggggaacttctagtagctgcatcttaaatagttaagatacacacctagattctatgaagttgtaaatatagaagccagaaaatgaattggaagtttgaaactaggaaactcactttctggatcctcggaagttggctaccaaccaattgtttctcggaattgtagcttctccaaacttgtaaatgtatacaaagattccagatggtttattaagcttggtcagggtttttccaaagaaaaacaagctcctatcactgttggggaagtggttttcagtcccggtttgcaacccctttagtcccgagttgcaaaccgggaccccaaatccaggactaaagatgggtatctttagtcccggttaaaataaccgagactaaagatccatctttagtccctccattggtgttaccaaccaggaaagtttttttttctttttttcattgtttttagctgcttgcatattgtttttttttcatagtttttcttcaacgtgacagatcgaatgcaacaacatcaaaattatttttccaacaccacaggtcgaatagaacaacatcaaaattaacatcacaaatcaaatacaacaacaaaatcatccacaaaatctacgacaaacatctaaaaaatctacaacaaaatcatccacatttttttctttattctcttctctccttgctcttgcttctcatcctcctcgccggcggcaatgggagagaggaggagggggttcggcggctcggcgagccgtgcgccgccgcctcgggcgccagccacccaccgcccactcctgccgcccgccgtcgccatcatctctgccgacggagaggggaaggggaggaggggaagcaagcaaagcaagccgggaggaggagtggaggaagagctacgaaggaataaggaagaggaggaggcgtgcgaaggagtcaaagagataagatgaggcaggaaggcgtgcggcttggcgtgattttttttttatgttttgtcccggttggtataactaaccaggactaaagataatggagacctgacacgctacatcttatagcctgacgtcttttttaaccaggatcctatttgaaccaggattaatgtggtttctacatgacccacgaaagatcagttttccagtagtatataagcaagtgcaactttatattagaagtaactttatactaacgggatatcaaagaaatcttccttgcttaatattagttgtaccgatcacttctccacactactacacaagcgatttttgcgtgcagctaatttgatttttgcgtgcgggtgggcggcccgcacgcagcttcgggtctaggaaaatcacaattttcgcgtgcgggtgcctcacccgcatgagaaaataaaaaattgaaacaaaaaaaagaaaaagaaaaccctaactctaatccgccgccgccgctatcgatccgccacccgctaccgtcaccggtgccagatccgtagtcgctggccgaagacgccgggaagggagccgagggagagggaggggaggagaataaactcacccgacgccggccggccgccgctgatgccaccacacctccagatccgcctccgtcccaccgccgccgaatccgcaaggggaggtaggggaggggccgcgcgtcgtcgtggtcacttgccgccgccactgtcgccgcccttctccccgcccgcagccgagggagaacgagggggagggaggggccgccgccgccggatccgctgctcacatgtcgcgcgccgtcgccgctgtcgccgcctgtctccccgcccgcagccaagggagagggaggggtcgctgctgccgcacccatgccgcgcgcctccggatccacgcgccgccgtggtcgcccaccgccgccgctgtcgccgcccttctccccgcccacaaccgagggagagcgagggagagggagggaggggccgccgctggctagccgggagaggagaggagtgggaggagagtggagtgggagagagccagagagggagagagtgaggtgagagagaaggcagtgggtggaggggcgcgcgcgcgaggatatcagcggattggctattttcgtgtgcgggtctattaggtgacccgcacacgaaaatgattttcctatgcgggcgatggactgcgccggtttctctatttttctgtgcagtttcacttacggaccgcacgaaaacaaaatgagggggcgtccaggaaaatcaatgatgtagtaatgccagtacatataagggcatgatcgactgcatagaccaatgtagttggtccatgaaggccagtggaccatatatgaccatgtaacccatgtttgagacatttgccagctgccaagagcccaagactgcttgtggccacgtacgtggcttgtgtaaaactctcgatggtatctctataatgctattgttaaacctgtatttctcagatatcgccataaaatatgagtgatactaatcctataagatatatcctcgatgatacaaagtgtgaactcttaaggctgcatgtatggtacaaccataaaatttaatgaaaaccatgatattacaatatgtttggcagagctctctagatctatccatggtatatttgatgtttatatgttaaattatagtggtttaaaattttaaatttcatctaaaataaaaataattgatttattcaaatgttatatatgtaatcatagatccagatagatggatttgtggagctaggaatactcagctccattaaatcttggatatgaaggtgtgccaaagaaggcctatatctcaattatgtctactacgtgagtgtggttgaggtcgcgtaaacatgtgagacctagtaagcgattggaccggggctcatcggtgattgtttaacttgccgaagaaaaagatgaatctgatctccatcgtcacagctcgaatcaattggtggctttctccgggcttccggatccttttagggtgcgatcgtttcagcttttcatgattagattctccttattttcagttagcatgttttttaaactgctaaacggtatatttcgtgcaaaaactttctataaaaatattgttaaaaaatccaacaaatttattcattaaaaaaattatatattaatacttaattaattatatgttaattgtatttttcgttttacgtgcagctaacagtccaccggcaccgctgaaacgatcgcacccaagcggctctcttgcagtcaaactcgcgcgagagggaaatccaaggcccgcgcgcacaccccctgggctagtgggctggaaccaaggagagctctcggcccggtgtgtgatctgggccggcctgcctatgcccaccacttgccactggttaattaaccggaaaaagtacaccgaagatccctcaacttgtccaaccgagttgcaaaatcgtccttaaaccgtaaaaccggatacaatgtatccctcaacttacaaaaccagtgcaaactaggtccctcggtggttttgacttcggttttgtcctatgtgacagctgactcagtgtggaacccacgtgggctctacacatcagcctcttcttcccctcctctcttcacctctcttcctctctcctctcctctccacggtgcgacgggctcgaccggcgagggaggagctatacgtcggcggcacaaagcttgaccggcgtcgcaaagagaggggtcggagccatgctagccatgggaggactgaggaacacgatggctgccatagagactcgccgccgccccgtccatatcctcttcgttctgccacctctgcctcagcctaagtcgagttgtcgagttcccccagcttccaaacccttcgctctatcgccgctgtgtgaagggatgcagccgtcgtcactgctcttcccctccactcccctccctctctgccttgagttcgacgtggagcgccgtttccatccaagtcgccacctaggtgccacaagcccgacacggagcgtcgcatccatcagcatgttgtcatcatcgtcgtcgtcattgccgccacatccatccatctctctctcgccaccatcatccgcccgcacccatctcgctctccgaaatcacactatacatgtcgttggtgagggcagcgtcacctcaccacccgtgggcctccttcactcctgccgctcctacctctctccgctggcagtcgccgtcgccggtgagctcacaggagctcggggcgtctggcggtggtggcttgctgtggcggcgttggcatggggagggccatgaagcggcgcaactcgcggttcttccgctggctggagttgtagctggcgtggggagtccccttctcccccgtcgccaccgccagacctcctcctctgccgcctcgccccgctgacctcctccccatccggcggcctgccacgctcagcttcttcctcgccggtcgccgcccatggagaggggaggagagagaggaagagaggtggagagggagaagggaagaagaggccgacgcgtgcagggccggtcctgagttttcagggcccggtgtgaaactaaacgtaggagtttttaacattactactatataataataatcaataggacattgtttatgttacctaaaaaatttcttctaacgaagtcattgataagggtaccaatatcaatttcatccaaaaattcctcgatgacatggcctaataattgaaaaaaacaatattattatagtggcttaactcataaaaattacactataaaattacaaatctaaatttaaaatcttaccaattggttgatcgcaagcgtttaaaagcaggggctgcggcgtgttcacacttcagaaataattcacgctgcatatacattcgacgaaggagagatgaggacgattcgatatttcgatggatcaaacagaagccatcattcaatcaaacaaggcaacaagttagctaacttgataatacacagaatgagtgatgagtgactagttgactacctgcttgttagttgttctgttcgcagggctccctgcctccctggggattacgtcaagcgccgtaccacgaatctagccgacgactcgctctggcctgttaatacatcgccttacgccgtacatgcccagccactggcgccaccgcgacgccgcgacggccgacgggcgttaggcacagcaggtggcgccgcggcggcacgacgggagcagcagcagagcgggctgctggtgcggcaactggcggcctggcgcgacgggtgacggctgagggctgagggcatgtacaatggttgtcaataatggtctcttagcattactaattaggaatacttgttaacatggtagaaagagaaagagtagagacaaaacatcgttgttatgcttaacaacgactattaatcactataatatggaccccgcaaaaaaaatcactataatatggaaatatggttgcatgaggataaagaaatggaaagaatattaacaaaaggaatattttttgagttaatgattagagcctttgtcgtctcaactattggaaagacacgtctctaaataatcttttattgtttaagagatcatactcgtctctatcaatgaacattccctgagaggtgcgacactgtgacgagtgcggcggcaatcacgcattcacgcgtttctttctttctcttctgtttctgatcgcgattcacgcgtttgccgcttcgccttccgcatggatgctttgccttctgttcttgggccaggcctcacgcctgggtacaggagaggtgggaggggggctgggggccatgagattttgggggcccagagcggctgcaccgctcgcccccctctaggtctggccctggacgcgtgggtcttacgctgacacagccgccatgtcggacaaaaccgaggtaaaacccaccgaatgacctcaaatgaatggtttttgtaagttgagggatatcatatatctggttttgcggttgggagacgattttgtaacttgatgacaagttgagggaccttcgatgtacattttcctaattaacctagtccgcgtcgcatgcttgaccctttgagctggcatgtccggtagagactgacggcatggtcagatttatattattttaaaccatatcattatttgttaaaattgataatcatatgactacatttagtttgttgtcaaatattggtaaatctatgtaattttagtaacattatattgagcctattctatcacaatttgacaatgttgttaatttgctaaaattttgatattgccaaattttaaaaatatttattttggcattaatctgaagagaccctgagaccgacgtagagctttgcatattattgagggagagatttggcttctgccgctttttaattccttgcaactagtggtttcttgggagtatatctagaggaattttcgtgcaattgttgggagacgccaagaagcttggctaggcgaaggtgaacgttgttgatggctcgtacgttccgtcatgaaacgggcgaagctgcaggctggtattggaggagctgtcatttgtgctttcttcttgacgagcagtccagtgtggagcaatagcagaggccctcacatcgcgtgcatgttgggagggctcggcgccagccagcgtccgaatggactagagaaatgcctgtgtgtttattgcatcaaactgctcgatagtgcttcatttgcttgctacaacacaggaaaaccgatccaggtggtgcggtgctatagcagaaaaccaaatatcattgccaaattggaagagggtgtgataaagtttgctcgtgagttggctaattttgttagctacaaagatttaggttgtgtacagtgtgagagatttcagcctatatggtatttgacagaaaacacattataaatcatgtaaattctagaacgttggattgttttaagattcgtgcaattatacctctaaccctcacggcctcacccgtcctctctcctctcgtcattcctagcaccccgccatttgcgagtcgtgagctagcatgtgtctacgcgatgctttcaccgcccggtctcgctggctagatggaaggagtcaacggcaccggtgaggcccctcgcctgcttcttccccgtccctttttctcttccacaagccggtggcaggatcccgtcgtcttctccatcttcagtggttgcacgccagcggatctacctcctaaccacaagcttcgattcgcctccactgccaatgttggtcgaccgctctcctgcatcccagtggctctgactgttggaattaatgaatgggccttagcccactcgaagattaattctttggaaaatcacaaaaagcccacctcatgggatggcatgcatgtggagtttagtaccaccttgcttattctaggagagggggacctccttaaaagggaggatgccctcctagccacttgaaacatgtgtggtggagagaagaggggaaacacacgtgcgcgctcgctcgcctggcctggcagggcagggcagggcaggcggcgcgcgtgcacgacgtacgcgtcgaatggtccgaaaaattggctcctcacccttgcgcagatgcagcctccttttgcagttttgtttgctgcaaattcggattcgtttttgttttggaaacgttccgaaaaatccggtgcgtgcaaacggcgtggagtccgataagttacgcgcgacttatccggttcggttacgcgcagtagagggccggcagg

SEQ ID NO: 78580 - DNA, 6347 bp, Oryza sativa
atgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagcgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtaaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatccgaggtactggacatgcatgttggtacaattatggagtctcgtgatgctaccttctttgagagctttttcccaatgaaggatacacatagtggttcgaaccaaccctctgaaataattcccagttcaatcacaccaccagaacaaattgaacatacacatgaacttgtctctgaggaggatgtcagtgaagctcctcgaaggagtaagagacaaaggacggctaagtcttttggtgatgattttactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttggagtcaatgaggcgaataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaataggattacactcttgcagtcccattatgtggagaagatcttgaatcgctttggctacattgatagtaagccttctccaacaccttatgatcttagcttgttgcttcgcaagaacaagagaattgctatgaatcaactggaatactcccaaatcattggctcgttgatgtacctggctagtgcaactaggcctgatatctcctttgctgagaacaagttgagccgatttacctctaatccgggagatgatcactggcgtgcgcttgagcgagtaatgcgctatctgaaaggtactgtggaattggggcttcactatactgggtatcctgcggtactggaaggtatagtgattctaactggatctctgatgtggatgagatcaaagccactagtggatatgttttcacactgggtggtggtgctgtttcatggagggcttgcaaacagacaattttgacgaggtcaaccatggaagcagagctaacggcactggatactgctactgttgaggcagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacctagtctatgtgatcggagatcccgtgaattagatcctgggaagaacaaaccattaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagatcaattctttggaaaatcacaaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttacctcctactctgtactgcgccgtcgctcgtagactactccatcccgctcgccggcgtgcaccagcgatcgggagagcaggtctccggaacctctgcctttgacgtcctgcactgggagaaggcggcaataaggtttttgggaagtgcttcgtgcgactgctccctgttcgttcgcgacgactcgccttcctcttcgctcgcatgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacactgagatcgcctcccgcctatgcccacaatccaccgccaggaggctgtctcccaaaccatccctctaagtcccccctcccacccctacccctcgagccaccgccagtcgctatcgagcttgaggagaactgatcgccgaagttgaaagagaaaaagctaagtggccgaagcacgaatataatcataacgtgaatcctaaggttagaaacttacaaaagattttgatctcaatttctattaatagccatttagcggttccgtttttatgatcgagaacagttgtaatcattgccaactcaatttctcttccaggcaacattcaatgaccggatttggttcctgtgcagtccttactatgactgcaacttaggcagttataccataactgtaggatgcaaatccaaaggcccaaatttgataggacactgttcattcaaataatccaacaaaaaatattatatcaaggctattgtagcatttaatttagaccttccattgaaaaatcgaatggataaaatcttgtgcagttcctaacgtgcagttatagttgggactacacctgatcccaatcctcaatgaccactagtcaagactcaagagagcaccagcagctcaccactactcctactacaacccgtacgatcataaccagtca

SEQ ID NO: 78581 - DNA, 2028 bp, Oryza sativa
aaccggtccttaattgtcatgagcacgaccatcaaaaccatgtgctcacaacccaccattatcaagttttaattggcaaattaattaattaactaatcacgattaaccatcatgagctatcattaagtcatcattaaataatagtgaatcataagttatcccaattatatgagctagtgtctctaagcatggctaagcatcctattcactttagctaaaaccatataatgttctagctaatccaattattaaccaagtgacaaggaatagataatcaacatcaaagggctataacaaaggcaattggttattcccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcaaaatcggactttccgggaacgtcggaatctaagtataaaagagcaaaatcaccaaaacagcacataaacaatcatgaatagtacatgtggatatttttaacatgtagatctcaattttagaaaaatttagagacttgaaccaactaaatccgagctaagatgaattagttatgaatttttaaagattaaatcggattaaatcatttatatagattttaattgaattatgacgcaatatagaattatttttgaaaaggaaaaaggaattattgcgtcagcaggctcgggctcacggtggaccgggtgcacggcgacagtctacggaacggacggccgagatcaaatcgatctaccgccggtccatagctgacgtcgacgatgacgtcggcgatgacgtcaccaccggcggcggctcggccacgcatgctcgccggcgaacgacggtgcggcggcgcaaacggagggcatctacacatagcgggcgacgcggcgaactcaccgatgacacagacgacggcggacggtcaacggacggcaacggcggcaaggtttaaccaggtttgtagtagccaccagggtccacctgctccaactactgagccgactgctatcttagccgatgcattgctcaacatctggtatagatagccgaggagaattttgcccaaggggaattgtttctttgtttctagagcttcagccagaaattgccagttggttgtggggccgcaacttgatccacagaaaagaaatttttctagacacattaatagaaaggccacgtgttctcgcggggtgaccgaaccctggcccatgtatgctgccacatagcctgaccaaccccctatgcttttggttttgaagtcatattggttctttgtgttcaaacccatagggttggccgatgaggtggcatccagaccggtgatcatactgatatctatgagggttggagtcatcggcccttaattgaacagaaaggcattagtagtgtttgaccagaagtaagaagcggctgccattaggggttcatctttggctgagtttgctatagtaaggtcaagtgcttggccgattccaatttcatcccagtgaaccctcttgctggctgatacacgtttgaaccatgtggtccagctcttttctagtggaactttctctagagatggccaagacttgaaagtattcttctagtgacctagatctgggttggttaatctaaaggggattctattggtttcaccaacaatgaactcggtggggtcaggattaccgattgggccgagaaagtagtggttttcatgcgtcagactgggaattgcgacttggtgagaaagatgctacaaattcgaagcgaccaaaagagggaaagcaatatgagataagagaagatcgatctgctgctaaagaaggggatttagccgatgagaacttacctcggcgtattcggctgatggtgcaccagatgggctggcggaagacgacattggtgcgggcggagatctcgtcggggaggaagtcgcctaggaatcacctttgcgccggaggaatcgccagagaagagagagaaaagg

SEQ ID NO: 78582 - DNA, 3721 bp, Oryza sativa
  unsure (1)..(3721): unsure at all n locations
agccctatgtaattttagaacacacacgttcaatacaatctcggcgcatcgccacccttttgctttagttttgtttcgacgaattcttgctttcgggttgagctgcatcaattttgatcttcaacaagaggtaaaattcgttatgacggattacgttcttaggattagtgcttccatcttcatgacactctaatcttgtttatataattcgtcgagttatcatatatcttacataatctctagcaatatcgccacctaatttactatcgaccaatatctgtttgcagaaagcagccgattaggttagatctcgacgttgatctagattatataagatatctaccattctatgaaacttctagcggcttgattgtctagatatcgctcttcttttcatacttaatactgcattagttgagtttgatctattaagtcgtgcttagaatatcgatctctagcctgccttctagttgccgattagaatagcattggagtttcagccgatcgtatatgatttaactatatttgttttatatgctttactgatatgttaaatctgcactttatatcaagatattgttgtatctaagtatgttaggcttttgtttgatatattatacttgctttaatatcctgatataaagtagtatcggagtattagccgatacacgctagatctatctgatcggctacgctacaaacatatatagtcttgttattgatatatatttcgatctaagtgatttataatgtctcggcatggtgaccgatctatcccaatcacttgatttaagtatatatcgatataaggagtatatatcgttaatatcttcagccgatcgagtagatttagttcttctttacttattcatgactgccgatcgatacacggatgacatcggcccaaagataaatgatatgtcatcggcatctagccgatcggctatcatttatagatttaaccacggtttctttgcttctatttcttgttgattacaagatcaaatcaactggcacgctaatacacccgaagacgagctttggacctgcactagagttaagcagatctcccaggccacgtgttttctgtcaacagaaaggtcaaaaggtgatcgataaaagagatcggcaaagatgttttctagcaggaacagaagtaggttgaatggtgattgataaaggataaccaaaaacatgctctacatcacacaaggaagactcctgacagtaatcgccctgcaacagtcaccttgtcattgagaaaaaaatgtgagtaagcaagataacctaggtaaaagtgtttctatgaaggcaaggagtgaaatcttcaactcggtatcagatgctacacggagtgaaaagtgcaggcaccggttaccaggtaatgccatgtcttgagagatgatccaatgggaaggaactcatcaaggtcgaaggtgtaaaggaatacgttgaatgctaaatgatgacaacatgaagagaatagtgggaagtaaactgaatgtaaagaaagtgaatccgagttgtctgttcgtgggagctattcccagttatgaaccaagtgatatgttcgaagatagtctacagaggtcagattaaaatcacatctaacaacgaagcttcagatttggcaggataacgatcagacaataacaagtccagcagtaaagccatttaggaagacgtcaaagcatgtcaagtgggataagttggttctgttgagaaacataattcaaaggcaaagttatcgacccttgcatcgaatagcacaagtagctagcacccagagtccaggaaagctaatatgaggcagttggtggcaagttagaagtaaatgacaagcatggtattctcatgatgacaagcatggtattctagtaatgacaagctgatatcgacgcataacgtgaagtgggtaacttgcatgagattgacacccaaggtatgaactatgagaagttctggaactgaagccccatcttcaagtgccgcaacctagtcgaagtcagctagaggtgtaaccagggacaagtcaagtgaagagaagattccatctgcaacaggagatcaagccaaacagttccgagtggggaagttttgctggacaagtttgttatacaagacgcaacagaagaagtcaggcaagaagagaagaccgcccaacctatcttcttgctagcctcctcgaatctcggggacgagattcctgtaaggggggtggatttgtcacgtcctgataaattcatcccgaaataaaaatcattctctaaaaggaataatagaattaattaaaatgcgaaaagaaattggcaaacactaaaatacgtacaagaaaaattcgaatgtggcccggagaatttttgttaaattctccttggtctaaaaagagctctcaaattttacttgaattttcagaacaccggaaataattattaagcaacaacaacaattaacaaagtttattaaaaagaaaaactaaaaataatcctccttcctcctttgggccaagtctgacccaaagtctctcctccctccctctcttttccttccgtccctccttcccggccggcccactgngnnctntcctcctcccgcctgggcctgccccggcccaagccgagcggctgcctccctccagcgcccctcacgcgcgccgcacgcgcgctgaccgcgcgcctaaccggtgggtcccacccacccggtcgtctccttcctcccgcacggcctcctctctcacccgtgaaccctagcgccgattcctcctccaagtccaccccattcaagccggctctttccaaattaattgcggggttttaatccccattggttcctctttgatttcccccgttttcccccttgatttgtgcccccaatcgccgggaacggacgtgccaaacccggccgctttccatggccgccggccgccattcccgcctccgtttcgacctcccccgtggccgactccctcccctcatctataaaatggaaccccctcggtccgttctccagttttagccccctcccgcgctctcccgtggccgccccgcctctccccgccttctccttctctctctccggtgccggccgacctccagccgcacctcccgccacgaccgtgcgccgtccggttgcgccgtcgccaccctcggcctcgcaggtgcatcctcttccccggcgtcgcctccgtttcacggggaaaccatgggagacgcgtcctcaccggtaaacagtggcgttgctaccactgcaccacctccggcagccccttccgtcgtgcccgagcaccgaccgacgtcgccgcctcctccgtcgacgtcgcagcgtcgtcctcttctctggctgctcctctgtttcgcccagaaaaccgctgcaagtcgccgccaacccctccaccctcctcgccgaagtcccttcggccgccccttcctcctcgcccgtgcaacagtcggccgcacctccaccaccttcagcatcacagcggcaaggtcgtcctcggcctcgcctcccctccatccgaaccccgccggtctttgtcgtcgtcctctcgtcgttcccggttgcgctcgtcgtcggccctcccttcgtcaagccgtgctcgttcgtcgtctgcgtccgtcaagtaagccgctgcagccccgtcgtcgtcttcgtcctcggctccgcgtcgtcaagccttgtgccggcctcgtctcgtcttcgtccaaggatcgccgccgaagta

SEQ ID NO: 78583 - DNA, 10282 bp, Oryza sativa
acgcttaggaggtactatggccagtaattggattatcgccctaagaccaaaaaacatgttctatgcttttagattcacgttgttcatcaaaaaggcaggggggcatgtgtttacacccaaatttggcacctaggattaaaataggaaaagactgccaagatttggaagtctaccggtttcctccgagtgggctggtctgaccgtcgtgtgttgggcggtcaaaccgccggttgagggccagtcagaccgacggtgtgtggccggtctaaccggcagggtccgagtccgattgcgtttcgtcgggtttcgaggtttccttgcctgggaaggcatgtttcgggtttcctttggtttctatcccgagttggacgtggaggagagcctgtagaaggcaagaccaacccctatataagggacatggccggttccactgtaaaaaaaaatcaatctacaatcaatcaatcgaatcgtttttcatattgcttttagttttctcttagtttgtccatctttgtcgatttgcaccgtaaatcgtccgccgccgctgcgagagtgcaacacctcttcgtaggtttgtcctgaaaaccttccgttttgcccacgagacgggtagttatctagaaatcggcttcgctagcctgtttagttatcaaaacccatcttggtctagtttcttctagattgaggtggttggcgactctaggatcatcgcaaggcgttaggtgttgcgatcgtggttgtcaacttgtcacaaaaagttgccaacactatgttgatgacattgtcgtgaaaatttgtaaggcattcgaccatgtgtcagacttgcaagagactctcgacaacctccgcgcggccggcatgaagttaaacccagaaaagtgtgtgttcggtgttcgcgcgggtaagttattgggattccttgtgtccgaaacggggatcgaagcgaaccccgaaaaaatcgatgacattcagcaaatgaagccaccatcgaacgtacgacaagtacaaaagctcgcggggcgaattgcggcactcaatcgattcttatcaaaggcggctgaaaggggtttgccattcttcaagacccttcaaggggcaggaaagttcagctggacgcctgagtgccaatcagctttcgataagcttaagcgatatctgcaaagcccactagccttggtcagcccaacaaggggaagcgaactgtggctttatctagcagctttgcccatcgcagttggcgctgctctagtgcaagagaccgaagctggtcagaaaaaagtgtacttcgtgtccgaagctctctaaggggcgaaagtcagatacattgcgatcgaaaagcttgcttatgctctagtaatggcttcaagaaagctcaaacactacttccaagcccacaaaagcatagtaccctcgcagtaccctttgggcgaaatgcttcaaggaaaagaaatcacaaggcggctaagcaaatgggctgccgaactataacctttcgacctacactttgtcgctcgcaccgcaatcaagtcccaaatcctcgctgattgcgtggccgaatggacaccagcgtccgccccaaagcccgaaccagtcgaacaaccatgggtcacgcattccgatgggtcgtggtctcacaagggggcgggtgttgccatgatcctaacctcgccaggaggagtgccgatacattacgctgcaagattgtagtttagtacaaccaataacacagccgaatacgaagcagtattaatgggcctgagaaaggcgaaagcactaggcgttcggcgtctgataatcagaacggactcaaagcttgtcgccagccaggttgacaaatgtaacatcccggcctagggcttaataggattaatagaatactcatatcaacaagttgcaacttctttttcggaagccaatctccaaagaactccagggttaagcgtgcttggcctggagcaatttgggatgggtgaccgaccgggaaattcttcccgggtgcacacgagtgaggacaaagtgtgcagaaaagacatgtgttggtctgtgagggcagtctatgaggcgcgtgtgtcgcagttgtgcaggcatggtacgcatgtctggtgtagaccggaagtggttacacagcatggcacatgcgctggcactggacacatggacgtggccaagagaggacgttcctggctatcagatgtaagtgggcccggcctaggggaaggcgggacgttacaaaatggtatcagagccgactctcgcggtttcatgggcgcgtgtgtcgcagttgcgcaggcatggtgcgcatggctggtgtagaccggaagtggttacacagcatggcacatgcgctggcactggacacatggacgtagccaagagaggacgttcctggcctggggttgatcgacgggggcgtcgatctctcttaagggggtgagggtgtaacatcccggtctagggcttaataggattaatagaatactcatattaacaagttgcaacttcttttccggaagccaatctccaaacaactccagggttaagcgtgcttggcttggagcaatttgggatgggtgaccgaccgggaaattcttcccgggtgcacacgagtgagaacaaagtgtgcagaaaagacatgtgttggtctgtgagagcagtctatgacctatgaaagctatcagatgtaagtaggcccggcctgggggaaggcgggacgttacaacaaatccttcgaggcgaaggaagaggggataaggaaatatctagaatactcatattaacaagttgcaacttcttttccggaagccaatctccaaacaactccagggttaagcgtgcttggcttggagcaatttgggatgggtgaccgaccgggaaattcttcccgggtgcacacgagtgagaacaaagtgtgcagaaaagacatctgttggtctgtgagggcagtctatgacctatgaaagctatcagatgtaagtaagcccggcctgggggaaggcgggacgttacaacaaatccttcgaggcgaaggaagaggggataaggaaatatctagaagctgttcggtctatggagaaaagcttcgctggcataacggtcgaacacctaccccgaggccagaacaaagaagccgatgcgttggcaaagtcagccgcttgtttggggccgcattcgctaggggtcttctttgaagtcctgtatacaccaagtgtgtcaatagatagcctagagatcatggcaatcgaccaagtcaaattgggcgaagcctcgaaggaagaggggataaggaaatatctagaagctgttcggtctatggagaaaagcttcgctagcataacggtcgaacacctaccccgaggccagaacaaagaagccgatgcgttggcaaagtcagccgcttgtttggggccgcattcgctaggggtcttctttgaagtcctgtatacaccaagtgtgtcaatagatagcctagagatcatggcaatcgaccaagtcaaattgggcgaagaccaggacgactggcgaacgccattcgtcaagcatcttaatgggggatggctgccagacaacgaagcaaaggcgaaacaattacagctcagagctgcaaggtacaagttagtctccggacaattgtacctaattggggtactgcagcccatgcttcgctatgtctctttctccaaaggtaaggaaatggtaaaggaaatacaccaggggatgtgtggagcacaccaggcggcaaggaccgtcgcatcaaaagttttttgccaagacatatactggccaaccgtacttaaagtatgcgttaagcagattaagaagtgtgaaagctgtcagcggcacggccgaaaccaaacagcaccacagtatgagctacaaccaatcgcaccaatctggccattcgcaagatggggtttagacatcatcgacccattcacggtggcgcgaaatggttacaggttcgccatcgtagccatcgaatacttctctcgctggatcgaggccaaacccctcggcacaataaccgcagctgcggttcagaagttcgtacggaagaacatcatttgctggttcagggtgccaaaatagttcatcgctgacaatggcaagtagttcgattccgagaaattcagagaaatgtgcgaagggttaaacctggagatcaggttcgcatcggtggcgcacccacaatcaaacggggcggccgaacgcgcaaatggtaaaattctcgaggctcttaaaaagagacttgagggagcgacgaaggggaaatggccagacgaaatgttgtctgttctctgggcccttcggaccacccccacaaggccagccaagttcagccctttcatgcttctctatggtgacgaagcaatgacgccagccgaactaggggctaattcgccaagggtgatgttctctggaggcaaagatgggcgtgaagtgtcgctcgaactcctggaaggggtaagagtcgaagcgctagaacatatgcgcaaatatgcagcaagcactttggcgacctacaacagaaaggttttaccgacagagattttgcctagtcatcttgtgctaaggaagaaggcgaaacctgtggcggtctgaaaactagaatccaaatgggaaggaccaaatctgatcaagcatagttctcgagcgggctcctttcggctggcgaccttggagggtgaagagttcgaccactcctggaacgctgcctctcttaagcgtttctatgtgtaaaatgggtggcgcttgattcgccaattgtaaaaatgtacatattatgtaagccgttcggcacaaaaacaacaaaaaaggggggaaaatcgaaaaagaaaaaaaatactggacgtagggctattatccacctcggaggcccgaacctgtataaaaatgccagtttcctttcgccttatttattatttctgtggatgatgttctcgtggaaaaaccccaaggcaaacgcttgatcagtgaaaatgccagggggacgaaacgaatcggtcgaagcatagctcaccgaacgttgaaaccgtgacagctcgattttgacaaaaaataaccaagctccgttgaattcagcttacgcacagacttaaacgcttctagttgtgtttgccacgagccgaaaacggaagaggagagctgagaaatgaacgttcttttctgctaaaccacgcaaagaggccgacacgtttccacctaacggaagcacgaaagtgactatgcgaacattagcacaaagaaatgttaaaacatacataaacctcaatgggcgaaaacacatattctcatattaataaacacaacattcacaataaaattacatcttcgcccgcgcactcgtgtccgtctacgctacaagccagcgaacaaggttcgtcgtcactactaatattgtacacaacccttaagagggatggaggccaagcacaaacttaactataacggtgacgggcgatcgcctcttggcgactcgaccttttaaaatttcgccaaaagttagtgctatctttgcgatgtgcgacatggtagcggtcataatcttccaaggttcgacccggatgtgcacgcatccaccctgaaacctttataaccaccacgaacttctcgtttttatttcgccaattcccaaaggggggctgaacgcacgactttcggctaaaaccttgccaacaaggcataaagtatagcaaaaaaatgaagacgctaacgaaatcgattacccatcacagcgaaagcgcataattggcgaaatagtaacttttcattaataaacataaggccagaacggctacatgatggtgacggccattagccgaacatgcaaaatatttacatataaacaagctacgactctaagtccagaaagcgaaaaacgcgagggcgaaaggcctcacacctcagggtggtcttggctttcgttgcctttgccctcctgctcagccgctatctccaacggccctagctcttcagaagtattggtggcagcggcgccttcggctttctccatcttctccagttgctcacgaagccgggtcttcgcgccagacctcccaccactctccaagaagccctttaggaaggcctttggagccgccgaagcagactgggagctttcgggtcagtccttcttcacagttcgaggaaaatcctcgacatggtcacaaccatgttcatggagcaagctgagcacgaaccccacggcaactcgcgcacaacagtcgccgtacgcgccagccacttcgacgactgagccggccgcatcttgcgtccactcagtaaagtcaaaagcggacctgtcatcacccggagcgccctccgcacgtgctgcaaggtcagtgagggccagccgaagggtgtagcaagcatgtctggcggactccgtcgctggcaccaaagcttcagcagcggcttccaccgagccaagccgggcttcaagggatttgatcttttcttcggccgctgcaagctgcccttcctgttcagcatccctctgattcgccttctccaagttggcacggagagatttattttctcccaccagggatttattctccgcgttcgccttctttagggcatccgagctgtcaccatcagctgcctacctctactgtcccgcagcatatatgcccaaataatgatacttaaaaatctaatcaccacgcttacattattaaatattactgtatatcctctagaatgacatagagcaatcattcacattaacattaaacccccaacattgcacctctttggtaagctagtcacacaactatatcgagacaaatataaaataaagccggtactctaatgaagtaaagtaccgaagatatataaagaagaatattctattaattcgataagtcttacaaaagaagggaggaaagctgctagatacccgaaatatcctgaagatttgaggactaagaaaactattctattctactccactagcactagagtactaaactaaacttgagagagagatcaagtgcttctttcttgagtgtgggaaagagtggagaaggtgacccctttatatagccttgtaatgatgattatgatagttggaaaggtcgaaaacaccctccaactgtcatttggagtgaatcctggatgtccacgccaaaccacaggatgaacggccatgatgggggttcggccgaaccctggcctagcccaaacagcccaatttttggcaggcgtcctctccaatggttcctcaatccagtggtaaggtgttttgggaccttttagttcatttctttggatttataggcccattcacccataagtctacacttgacggactccgattgattcttcatttgttttccgtctactctccttctctttatgtagcaatctctgaaatcaaatagaatccaagtacaagtggaaatagattattctaaaacaaatatgcattgcaagtatagctagttcttctttattttagttacattgaccatcgaaattggtctataatgaccgtcaacaacaactagaggatatcctagtggtagtcggctgcgtgtccaaatagatagtagcaatgccgtgtagggctgcagatgccaaacatgctaagaagatgttctcggaaatcatcttcccccgctttggtaccccaagaatggtcataagtgatgggggatcacacttcatcgataaaaccttccaagacctcttgcgtgagatgggcaccaaacagaatgttgccacaccctaccatcctgaaacaagtggacaagcagaaacattgaacaaacagatcaagaacattctgtaaaacacgatccacaaaatgggaacatgatggaaggacaagttactcgacgctctatgggcataccgaacagcccataagacaccaattggaatgtccctgtattagatagtctacgggaagtcatgctgactccctatagaacttgaacaccagacatactgggcaatccagaactggaatatggattttgagggagccgaagagtggagaaagatacagatattagagttggaagaatggagggataaagcatatcacaactccaagatttacaaggaaagaacaaaacgctggcacgataagcggatcaagatcaagaaattcaagacaggagataaggtactgatgtttaattccagagttaagctattcgggcatgggaagttacgaagcaaatgggaagggccgtttgacattatcaacacctcgtcacacggagcaatcacatttcgtaacaactcaggtaacatcttcaaggtaaacggccaacgtttaaagattttccttgagccgaatgaaaatttagatgaagaagtggatgtgattaaattaattgattttgaaccataatgatctcatctaaaagttgcttaattctataaaattgtgagttttcctatttgaattagcttaagttagacatgtgaaaattttggaggccgaccgagcccaccagtggttcggccgaaccatggcggcacccgatcgcccccatatttgaaagttatatctccccgcttaattgcccgttagaaacttggtcgttcatgcgattcgggcgttagatcaatctgagctacttaaattcctctccttcctctccagctcctccacatttaatccatttcttccctcaacttaactccactcattccaaactccaatccacgaccaaaatcacccaatggctaggaaatccttgatcccctacggtgccactcgttcaaacaagtttgatcttaatggtgagccctgttcggcaaaccaattggtgccagtgaacgatatggcgctggaggaggcaaacgcaatcttcatggaccccttggagactatcccagctgactcagcaagcaagaggccgatcggtgttgccgccagttcggccgaacccagcctcgatcagcccccctattcggccgcttgtcccctctcgcctcaccgcaacgcgctgaccgaagtacagggtgtttcccctgtacagaggcctacatcaggcgaattggggccattaaagatggcgcgatggctttttcaagagtaggagaaggctgcatctcccgccgatgaatgctatgttggtaatcttgagaccaaggcaagggatgtggtattccaccagtaccaagcccccatcccactccggtgacaacgcaaaagaggttccgcgtttttggtgtgcgaacccccggtggtggctatgggaaggggctacaccggtccttaacaactcatgagaaggaagaggtggtagagtcggttgattcctcaccttacaaggttaggcgtcaattgtctccacctcccattaggagggaggccgggaaatttgaggggagtgactctccccaaccctccatatcgaaacttgcaaagaagatcaagaaactccgcaaagagaacaaggagcttcgaacccacgatgcggaatgtagggaagaaattgctaatcttgggcacgaatttgatgtgcttaggctccgttcggtagtacaagttcccaactcctcgtttttcgcgcgcacgcttttcaaactgctaaacggtgcgttttttgcaaaaaagtttctatacgaaagttgcttaaaaaaattatattaattcatttttaaaaaaaaatagctaaaacttaattaatcacgtgctaaaacgctgcttcgttttacgtgccggggccgaacagagccttagtcgtggattatgtgctaagattaagcgtgcattcaaggagatggggaaagaagaccgttattatgccaattagaggccttcccctctcattttaataagttaggtgctttagttttatttcatttcatttatttcattccaatgtaatcagcacctatatcattttgattgaataaagcggttcgttggtagttaatccaacggaagcttttttatttccatattgtgtttaataaagtctaggttcaaaataagtgtgggggagatacttcggactcctgacgtgcaaactctaaaaacacatcatatttctgaatgtctgacgatttctgaacttcactgaaaattgcagagtatttggacgtcagaggggtttggtcgaacccaaactggccccaaataccccccaattttgtctagtgagaatggtttgcacgtccacttcctcattctttcccatttttatcagtatatgagcagatgttgactgaaaaatcaactcaaagctaaaagtgaaaatgataatctctcaactaattaaatttccctgtcacattttattcttgactatgcttgtca

SEQ ID NO: 78584 - DNA, 5065 bp, Oryza sativa
aaatttatgcataaaaatattatatataaaaaatatttgaattcaaattcaaatttgaatcggatatataaacttttgacttataaactttgggcacatataaactttatgtatagaaatactatatataaaaatatttgaattcaaattctaatttgaatcagatatataaacgtttgacttataaactttgggtctataaactttaggtgtataaactttagatatataaactttagatgtgtaaacttgaggtatacaaactttaggtgtataaatttactaaaatagaaaagtaatgcggtgccataaaaaggaaacaatgtaaggaaggggcttaggaaaaagaaaaagaaaaaaagaagcgctaacttggctccatgaaagtcggtaatagtaataaaaaaagataaaaacagctttaaaaattaggagcaatttctaacagaaaaaggtaagaaaaaaaaagaggacctgatcgcgtgggtacacagacggcgatcgtccgctcgttagcaatttcggtttattctctaagaggtattttgaggagataagaagaaatgaaatatggagaatgagacacaaggacgaagctatagcttcatgtgttctaatatatggtaagatgtttatgcttggccaaactttttttaagttcgatgaaatttatagaaaaatatagcaatatattttcaacacaaaacaaatatactatccatgtattcaaatactcaattgtggatcaaactaagttgcttctaaccataaaaaaataaaactaacttggttcagatttccataaatttggtcagatttatagaagttagattcagaacaaaatcaaaacaacttacaatattgaacggagtagaagtgatcagatcagtatgacacacacttctatgttttagtattgtttactaaaatttccagatagccgcatcaaataccacacaggatgaaaccaccctggttgaatacccacctagcattggcgcattgcacatagtattattttacatgagagtccatgaacatatttgttatccttaagagtggtggctcctaagggagcctctcattattataaaaaagattttaagataagcaaggtaacttcagatggcaagtcgttgataaacttgacacatggttggcctctcttgcggcgatggaagtaggcagtcaaacgccacggagagacacctattcacgtcgtctgcttcatcatctgcaggtactggaagacgtttatccaagatttcatcaagaaaatcatcatatttagaagtagtaatagaactttggatatctccaggatgtttgcccatcagcacctcaagcaccacaacaccgaagctatatacgtcacatttctccgtgactaaggaggtgtaggacaattctacaaccaacatggaaacatatataaaagtcaggaatatatgtttgtgcaaagcaatattatattgttaacaagttttagtatatatggaatattgtactgtactgtatacacataccaggtgctatatagccataggtcccagctaatgcactccaatttgatgaatccggttttagaattcttgcaatgccaaaatccgagacatatgctctataatcaacatccagtaagatgtttccgctcgtaatgtcacgatgaattatgggaggctgacaatcatgaagataagtaattgcttgagctacatctcttatgagggttgtccttctcatccaatagaactcgatggctacttcttcattatttaagatagaagctaggtttcctctctctatgtattgacaaacgagaaacctgtaccttggatgacaacagaatccatacaacttcactatgctacgatgtcggatttttgccaacatttcaatctcaatctgaaatctctcttcatcgtgtacagtatcttcatcatctggatggagtttcttcaccgcaaacacttgcttatcttcaagttctgctttgtatacacgaccatatgctccctctccaatgcaatgcttctcatcaaaattgtcggttgcgctaattatatcatcaaatgccattttaccatcaaaactccatacagagaaaatatcattttttttcaccacattattattttcttgggagagtttttttcggcaaactgaaagaagaaaaacagttgccacaatagaaataatagctaagaatacaggagcactgacttcaactatcaactttagtctggtttttctgtggtaaggaggcaaataacaatgtgataggccagcaagttctccacaaagacctttgttgtggacaaaccattttgccgatgcattgtggagcggtctaggaataggaccttcgaggacattgtatgacacatcaaacactgatagactttgcatacttgcaattgagccagggatagcaccactaaattgattgtgtgacaagtttacatacatgagcatctcgagcatgccaagttcggatggtattggtccactaagattgttctggctaagatcaagcatgctttgtagagaaagaaaatggcccaatgtacttggtatactcccattcaagctgttgttgctcattttcaaagactgcagcttaaaacaattaccaaggtcatctggtatagctccactcagctgattgcttgagaaatcaagaatctcaaggcttttaagttggccaatttgatttgggaccttcccagaaagttgattgtttcttaaatctatcaaatttagattgactaacttgccaatttcaggtggtatctccccagtcaacctattagtggacagactgagctttacaagattttttagattcccaagctcagaaggtataccgccttttatcatattgtctgcaaaactaagtgctgtcaaattctgacatgatcacaaatttggtgaaagccggccaaccaatttgtttgacgctaaacgtaaccgccatagatgggggtacactcctaatgcatcagttatgtctccatccattttgttgtagctaatgccgagggatcgcagggaaatgcaatccctcaaagtctttggcatcgaaccattcaaattgttatgagaaagatgtaaaatctctagctttttaccccgacacaaatcaggcaacgggccaaccaagtagttcttgtctaattcgatgtcaattaaattagtgaggttgaagagtgctggaggcaattgacctgatagctggttgctgaacagtagaatttcgctcacgctctccaattttcccaaactcggagggattggaccagacaattggttttcataggatgcaaatgatatcaaacttgccagattcccaaactcttctgggattggtgcagagagattattgctatttattaatatatagttgagggaagacatgttccctatagttgatggcactggtccagttatgaaatttactgagaggtcgagctgttggagattcacaagatttccaatctcctgagggattgacccagttatgtgattaccccaaagagaaaagtagactgacgaagtaagatttccaacacttgagggaattgagccggtcaaatggttctcggacaagtccaactcaaccaaacttgacagcatcccaaacacttgagggatagtaccagtatgttggttcagatatatgtacaagatcttgagcattgtaagatttcccaaggtggatgtaattgagccgttcaagttgttttgctgcagatctagatattgaagcgtttgtatttcacctagctcgtcaggtataggtccagatagatgattaccgacgaggaacaaagaggtgagttttgtgaggtttccaaatagagaaagtatcggcccaacaagaagattgaggctcaaatctataaacgagatgtcatgaagcttcccaagctgccatgggatgttaccggacagcttattgccaaggagagaaagataagtaagctttgtaaggttacccaacgcaggagggatttccccagtcagattattgtacgacagatcaattgaggaaatcctcccaaggtcaccaatggatggaggtatatttccggtaagctgattgctggacaggttgagactggaaagcattaacagagaacttatgccaggagggatcgtacccgacagatggccattgtcgctgaggtcgaggctggccagataagggaaggacctgaagctcagggtgtccagccctcccacaagatgggcacccgggagggcgatccccgtgatggcatttcttgccgtggttcttccatgtcgtcgctggcgccatggaacgtcgccgcaggtgatgccagtccagttgcacgggtggatatcgtgcctccatgttcccagctggtgttgtgagaagcccttcaaggtggacttccagtggagaagggccgccacttgagctcgcagcgatgtgccacgccgcggcagtggcgccgccgatctggccccatggcctagcgtgagagcgaagaggagcagtagaagcattagctttaggtgcttcgacactagtatgtgcagagtgaggtttctagcgctggcctgggagttgatcaggagggatgatatgtcaccttgcccttttctgattcgtttttaggcctggtttagttggggaaagtttttgggtttggttgttacgtacttacataggatatacggacagacatttaaagtattaaacgtagtccaataacaaaaactaattatagattctgccagaaaactacgagtcaaatttattaagcctaattaatccatcattagcaaatgtttactgtagcaccacattgtcaaatcatggcgcaattagacttaaaaaattcgtctcgcaatttacacataatttgtgtaattattttttttctacatttaatacttaatgcacgtatcaaacattcgatgtgacaacgtgaaaattttagttttgggaactttgcgggacaggatcacacggaagctagctggccaagtccatgccgtgtggaaaatgggagaaggatagcaacggaaacgatgc

SEQ ID NO: 78585 - DNA, 5146 bp, Oryza sativa
ctatctctccctctcctctctttgttatttgtaattgtttgtgtgattttttcatgtgagatgtgttcttgttgatatgagatgtgttgatgtgtgttcttgtgagatgtgttcttgtgagatgattcatttgcgccggcgacgggagcgagcggcggatccgtagccggcgaccgcgagggcgacggcggcgggcctcggctaggcggcggcggactagggttagggttagggtttcttttttccttttttttttctttttttttctccgtgcgggcgcccgcacacaaaaatcggttttcgcgtgcgagtgcgccaccgcacgcgaaaatcacgattttcccagacgactggtgtgtgcgggtggtggcccacccgcacgcaaaaattggatagcccgtctggaaaaatcggtgctttagtagtgacggtagtacgtgaaccagtgacggtacctgtgtacgtacggtacctgtgtacgtacgtggttcatgtacacgtgacggagaggagagggagagattaaattctgtttttaatctaaatcaaatctaatggtctaaattaatggaccccaccaaattaaataaaaatcaatggctagatatttctaatctattagaacgccacgtggtaatttaggagcgtttataggaatgccacatagcgttatgagagcgtttatagggtgtttcatggacttttagtatataatagaagatattagcatactccctctggttctatattaattgacgttttggataaggttgaggttaaactttataactttgaccatcaataactttaaaaatatttagtttaaagaaactagaaaaatgtatatagatttgtctttcaaaacactataataaaagtaaacatgcatttatttattgtatatattataatagaaaaataaggtcaaaggtatatcttgtagagcgtgtcattgtccaaagcgtcaattaaaatgaaaccggagggattatatttctacaaacttgatcaaactttaaaaaaactttgattaagaaaaaaatcaaataatttataatatgaaacgaatagagtagtagtgagataagcttttaaatagtatagtgaaatgttagatccttttgttgggttgttctaagataatataaggggaaaaaaagaaaacaacgtggcttgcattatcaacaatgttggtggcggcatgcttactaggcgaacatacgataattctaaatttgcaatggttccaattaacctccacccgaattaacaatgaatatggttccgatgggaaaatgttacccagcaaacgtaggggttggccagcaagcgaacgcttattggaagttggtttggaatttcggatatccttggcctggagggttggaagtaatgccaatgctatatggtaggaaaatgacatggtatcggcagattatctgcacaagatcatgaagggaaaaaagaaaggaatttgctgcttgattggcgcgcggaaggtaaagtgaggcttctactactagatgtgaattaatgcatgggaaaggtagctactacacacaagttggagtatatacgagtatcatattaaaaatgaagtccaaggttgcctgcctaatcttcagtatctagcgctggctgagttcagccccgagagtgacaggatcctacacttggacatactccaatcgcagcatctgtgagcgagcaggactagtagtactcctagacgttaggcgagatctgtcgcaggcgtggaagctacgatccacacagccaggcagatagtcgaccgtacgtgcgcgcgtcctccacaaggtcgttatatcggccgtggagccccccgcgcgcgcgcccacaaggagagacgacgcggcacggtagtagggtcacccacgccacgattggtgccaagggagcaaaggctcactagtgcacatgcggcgggcgcgcgcagaaaccatatacgactactcgcctcgtcgcttagctttcgctaacaacggctacctttccggttcggctggcgtccacctcgcgcgtggaattggcgtcgtcacgttcacgtggctgcatctgcatctgcatctgcgtgcgctccagatcaatcacactacggcccagtttagttccaaaatttttctttaaatttttaacttttcaatcacattaaaatttttctacatatacaaacttttaacttttttatcacatcgtttcaatttcaaccaaaattttaattttgatatgaaagaattaaaaggagttccggcccccggtcgctcgtcactgcgcccgtcgcgcaacaggaagagggcaaggggacggggagggtccgggccccgggccgcccgcggcagcggtcctcgtacatggagtactgtcctcctgtataaacaaagaactaggctagctactttattcctttgtctaactcactctggttactaattgtttggctgtttgctactaccttcgttctattttaagtgtagccgtctgtcttatttagacaaattatactttttttttaaaaagtcacacgtaatattttataataacgaacaaagtaataatcataattttgttaaaaataaaacaaacgatcaaatattggacaaaaacagaattattagggcatgtacaatggtttttattaacggtctctctttattgtcatgcaaacatatttggtgatatggaagagagagaaagaagaaaagagaaagatggttgctacgcatgacaatagcatagagtcgactcttagcatttattaggaaattttttattgcattgagtctaataaaggaaagatgactagtaagaaagtatttggtacattaatgatcagagaccgtattgtcttaactattgtatcgtgatagcctctaattaacatagagaccatatcggtctctacctttgtacttgcccttacaactacttagggaatgtttggttaatgggttataggatctatcttgattttcggtggtacaacacagggtctaccttttcgattccgaagtaaaaaccgctcctcaccagtttaccaaaatcagaccgaaaaccggcaaaaactatcgaatttcagtcaataccatacggaaaccggctaataccgattggtttttacaaaacgagacctagcgattttatgaaaaccgaccagttttcgtgaaattccatcggtttttctagaatgtttactcgagtttactgttttaactttaaatttcttgaaaacgatttggattttcctttgaaatctgattaggtcccgcatcctcaaacctcgatgtctcgtggttctaacgggtgcttgactgcttggagcctatacaggtaagtagagatcaggcaaaagtactactgctggtagctgatagtactactactgagtacattatttctgttccttgagcttaattgccatacaatgccgttgcaaaagtgcaaacccgcccattaatttattatttttagataatgcatgcccattaattagtatagcaccgtacgtacttgatctagccgatatgtggtgtcgatgatcatgattacagccacggctgcacgctttgcttgctaattaattttagggtattcgctcgttggtaccaactcgtccagtacttttgcgagatagagataaagtgtacgtcgatctgttgctagagtcgtcgcggccgcgcccctgcgcgcggaggcagtgtagagtgtggacacatgtagatcgatcgcccttgggccttgacatttctcactgtacgaatcagcgtgcagcagtgcaagctagctgcggagtggtcttggggttgagtcacatgccagttaggccaatctatcccaacatgtaagcagcattttttaacttctcttggctactaaaagtatgactgtcgccgtgtttagttctaaaatctttcttccaacttttaacttttccatcacatcgttctaatttcaataaaatttttaattttagtgtgaactaaacacagcctatataggtcttgtttagttcccacataaaaaatttacaccctatcacatcgaacgtttgaacacttatatgaagtattaaatataggctaaaaaataactaattatacagattgtgtgtaaattgcaagacgaatcttttaagcccaattgttctatgatttgacaatatggtgctacagtaaatatttgctaatgacggattaattaggcttaataaatttgtctcacagtttacatgcggattctgtaatttgttttgttattagattacgtttaatacttcaaatgtgtgtccgtatatccgatgtgacacggtaaaaattttcatccctggatgtaaacacaaccatacatattgttagggcccctttaaatcgcatgattgagaaaacgtaggaataggaaaaatataggattttgatatgaatgtaagtgtaaaacagaggattgcaaaacgtagaaaaaacacaggaatggatgtttgattgaactgcaggaaaaacacaggaattggatgagagaggtagacttaacggatccgttaccaagaggttgaagctcttgctaaatttcctacaaaatctctataggattgtccattccacaggaatttcaaaggattaaataggattcaatcttttgtatcaaaaggcttcataggaaatttttctataggattgaaatcctccaaaattcctatatttttcttctaaatcaaaggggcccttactacaaaacatctctacaaacattatgtttctccttttttccccccttctgcagggactataaagggctttcttaagaagatcgcacatgcaaactaactaattaagttaatcctgactaatataatggactgtttcccataaatcagaaaaaccttttcctaaattagactacaataatttgtttcatgattgctagcaggaatgaattggttttcttttaatttggtagagtttcaaagatttcattcctgaataaataaatgtttttgttaaacataaaacaatttagtaagttactaaaagggagtgtctagatttctaagcacgtgaagttttccaaaaaaaaaaccaatcacttttcttatccctttgacattaatacaatgattttcgtcactccatta

SEQ ID NO: 78586 - DNA, 660 bp, Oryza sativa
ttcgcatgtcttaaaataaaattttgccgcagatattctgaagtgcaaccaacgacaaaagaagcttaagcacccaaactgttatgctcagctgttatttacagcagttggcatgtagtcgattatgagtgtcttctccattgcaagcaagatttcctttgcaaattcaagatgtgctgggtgttcaatgtactccttgactccttctgtgctttcaaaagtgcactcgaatacgtgtgtgaatccatggtgcatgttctctatgctcacgtcagttcccctgcaaattaaaccgcacatttagaaactgatggtttgagaaatagatcatcaatgtagctaaatttgcaccagggaaaatgaattcacaaatgtcacacatttgggatatcggaactttaggagaaaatctactctatgccaccgagattgcattggttcaacaattcaccattgacattttcattttataaatcactgagtttatcaatgtttttttttaaaaaaaatgcccaaaatgcccttagagacatatgacaattgatttatcacattaaaaataagtaattacaaaatattatgtatagcctcgtttcacaacatagaagttttaaaatttttgcattgctattttttttataaaatattttatatgttaca

SEQ ID NO: 78587 - DNA, 663 bp, Oryza sativa
ttgatgcccaacggttatgcttttgcctcgactcgccttggctcagctcggcgcatgcacgtgtggcagtccaaccaccatctgaaccaatcaacagatgttctcaattagcaatctatttaagttgaggtctttctcgttggtttccaagatggtattaatctcttaacattaattatggatctttggggttgctagaattaatttgggcctagcccatttaattctaacatgatctgcacctatgattgcgggagaatttactatttaccatcctcccaaaatacacatgctcaaatgtcactttcaaattttcattctcatttgccatccgggctcacttgtctgcctcctccgtcacccagccccatatctcatttgtacgaatggggaaagaggctgacatgtgggctcgggtgttaaatgagaacaaaaattttgacatgtttgctttcagtcttccggccagtgtgattagcagtggataaaaagacaagagtgttcctctggccaggagaagacacatgtttgggctcgcaatgcatggtggcttgggaacaggtatgtcggccgaaggacagggggtttggggaataaaaaaaaatctcaaaatgcaaaatgaattactaatcaagaggatttttcatctgtagcagactgaat

SEQ ID NO: 78588 - DNA, 671 bp, Oryza sativa
ctattgcgtcaatccaaatcaccctctaaactacaaaaccagacatttaacaccctcaaatcttcaaacaagacgaataaaccccctctgtcaggtagaaggttcacatgcaagtaaggtaaatgaccaaaactacataaagaagaatatgtcattaatgtataaagtcttacaggagagggaagagctactagaaccatacccgaattctccaaaagacttgaagaactaaagagactattctaattctaactctactagcactagaacaaagtacgtaaactaagagaactttttcacttgaatccttcttggtgtgtgttgaaatggaggaggagatggccttttatagctgctcaacgatggttcgagcgtcaataccggccacagccgtcattgggaggtcagttgtaaccgccttcagcttgggcctgggccagcagagccaggacggggttggatgacccctagcaggtcctcctagcccaatgcttcctcctggactttgtttaatggatcctccgcctagcggcatgtggttgggcccatccatccatatgtctgccacaagtcgtgctttgattggttaaacgatgaatttccatcatttctcctcaatttataaagtaatctcctgtatatacaaataatttgccaagtacaagtggaat

SEQ ID NO: 78589 - DNA, 1700 bp, Oryza sativa
tgtccttgattctttgctttaattgggagagcaaatgcattcaagattgggatgggaatggtaaagagttttgattgtttcgttttatgggttttttgtagtgtgaaatcgatttgatgagagatgtgtaacatcctgtaaatattgacacaggtagccgatatctgtaacatcatatagtggcagtggattttctgaaatccacatagattgatttgttctttggcacttctcgctccaggcaggttgcaggcagaactagtttttctttcttgtgtagcaggctatcttgtagaactaggtaggctgataattttaggaacaaagtgactaacagtttttattttgacaaaaataaaaagcagaaatcttttttttgctacaataattgcatttaatcgataatatagatagttgatgtctattaattaatgatttgggtaggtctagatcctcacttgaccatgatgacattgacgaagtgcatgtttgaggaaatggctttttgtaacatttggtttcttttacagaacagaagtgtgctccaggtgcaggtatgttttagaactgggaagcataaactgcaagcaagcaagcccactatacaatgatcagtaaccactccggcaaaactgtttagagcaaatctgaaacctgtatagagcaaagcagttgccagttactccctccgggctgataatacttgtcgttttagacaagggtgaggtcaaactttagaatctttgattgtgaatcaaatttgaaatatttatctttcaaatatagtgactacacgtatagattagtcttaaaaagtactttaataaaagcatttatttgttaacatttttatacatattataataaaaaataatggtcaaagttgttttttgaagaccgtatccttgtctaaaatgacaagtattatcaacccggaggaagaactagtcaggttgactccttgggaagcagagcagtagaaaacttttttactcttatcacttggcttggaagcatcatctccatttgcttggagttcgctaatcacgtgcaatgatggcaaagcaaagtcatcaaacatagtccatcgctgcctcggggctcctcaactccttgtcctgcgtatcgtccgacttgtttggcttggaagaacgcatgtgccagaggagatatacagagatatctgtcatcttcacggacataaaagttgcaaaacggatcgaacattacacataatgccatcctgttgtttctgtgattactatcagaacatatttcaatctgtgcaatatcacagattcacaaagttgcattagatatgttaggctgatgctgtcgaaaacaacgattgccatttttgactttgaccactaatttttactacatccgtcccaaaaacttgaccatgcaattgacaataccattgcccattaacttgaccactaattactgaggcttgagtaaatttcagataattaaattatcgctgtcggtcactcaagtaaaataaattctaggacttttgactctgccactgatcctgacagcgatcgaaatgttgctttctgcaatgttgttggagcttgaggatcgcataattaaacagcccatccatttggaaggtgtgatttgtaacatcacgggggaacaggttaggacacgttaattagctacgtggtgcgtgacagcgtgagtgagtg

SEQ ID NO: 78590 - DNA, 6630 bp, Oryza sativa
tatcctggctctgccactgagctcacctctaggaagctcggacccaccttcgtcgggtctgcagcacaggccaacgccatctcctgcgaagctagagcattctcttcctcagccaccaccaccattgtctcaccaacaaagctccccatgaccggaaggattggccatagcagggaggagctccatggagaggaaataggggtgacgttggctagcgatgacgtcgtgctcaacatcccggccatcaccgttgcccgccgtcaatgtttgtcgtcgatgtagttggacatcgccaactaccatgcccaccaacctccgccgcttgcctctcctactgacatgtcattggccacgctggactttcccgatgtcgtgccatcagccatgtctgtctctcccgcctccggtgaccgtgccaccccgttgttgttgccctggccatctccagccatgttggcctcctgcgtccgctcgaccccgggccaggcctgacatggaggcgccatatctggccgtgtggacgctacatccggtcatggtagcataggatctgcggcttccctcaccatgacgcgctaccaccttgtcggggtgcgttgtcaccttgctacgcgttgcgcctcctcctccacgttagagtcgatgtgttgtcgggattaggccccgccaccaccatcctggtcgcatggttgctcggcggcaagacggagggagggggaagggcgggctggcagtggtggctagggttttgcccctgagctgcccacgcagggacgggcaccctcctccttgttagtatttacttcgtgtccccaggtcaagcgtgcaattatgttttaaaatctctaagattgataaactaaggccttgtttagttcccaaaaacgtcacatcgaatctttggacacatgcataaaatattaaatatagataaaatgaaaaactaattgcacagtttgcatggaaatcgcgagacgaatcttttgagcctaattagtccaggattagccataagtgctacagtaacccatatgtgcttaacacggattaattaggcttaataaattcatttcgcggtttccaggtgagttatcaaattagatttttcattagtgtccgaaaacctcttccgacatccagtcaaacgtatgatgtgatacccaaaaattttcttttcgcgaactaaacaaggcctaagtctcatatgcaaatgatggaagctactgaattgggaaaggattgcggcaaaacattgtaaaaagtaaatacattaaagagactatgctccacaatgtgaaacctggacggtgtgaatgtgtgtgcaccaatattgtttcttgggacctgtagatgcacttataactatcataatgttctcatagcaactctggactcccctggcctaggaaggaaggtttcttctctttcttattctacaaacctgtttgtgtaacaaaatatggtttccattgggaaacatgaggcccctgatcataggatattttccatttcttttacacagtgcaaaaacaatctcatgggtcacgaacatattaaagatccacaggaagccaattgtcctagtggcgacataagtcatatccatgatgccatgctgttttgttacactacattaacaagatctcactattagaaaaatcatttttcccgacgtggaggtcctttttttcgcaggcggacatgatccttggaaccaaatgaccgtctacgaaaatataaattggggtgaagttcgctgaccacttaagtggcgcattttcgcaggcggactacttaagcggcgcctgcgaaaatctattttcgcagacgaaccttatatggtccgcctgcaaaaatcgtacctatcaaaaaaaaattaagtacttatcttctcctccacccctccccaccactcatttccctctcaactctctctcgctccctcaacacttctcccaccgggccatccccctccgctctcctcccctccctccctccccgccggagggggagcgaccgcggcagcacggacggcgtggacgtggtgatagcggcagcatggacggcgacgtcggcttctcccgacgcgctctcccccagatccggccggagggaggccgggggagggctccgatggtgaggcgcgtggccggcggggtgtggggtggtgacaacaacgcgcggggcggcggcggcggctcccggcacggctcccatcccctcccctcccctcccagtccggccggagggaggccaggggagggcggcgatggcgaggcgcgtggccggcgggatggcgggcggcggtggctcccgacacagctcccctcccctcccctcccagatctgaccagagggaggccgggggatggcagcggcggcgaggcgcatggctggcagggcgcgggacggaggcggcggctcccggcgcggtttccctccccttccctcctagatccggccggaggtaggccgggggaaggtggcggcggcgaggcgtgtggccagccacgacgcggggcggcgacgatgacggctcccggcgcggctcccctcccctcccagatccggccataggaggccgggggacggcggcggtggcgaggtgcgtggccggcggggcacgttttattttttgttcgtccataggattttcgcaggcgggccattgcaccgtctgcgaaagtcattggtatacaggtggtccccccctccgcctggaaaaactatttttggccgcatgcaaaaatgtttttttaagtagtgtctaacaagtctctaaatatatagtggatagctaaccacctgcactgtgcaataaacagcggtgcacttactagctgaaaagactatggatggcgcaatacgatatatgatatacgttcagtattttacaactcgccgtgctcctgaaccagcggccctgtatgagattattagcgagctaactgaacccgaagcaggcatgcaattcgtcgagcgcacctgccgcgcgtcacagaggcgacagacacgggacacccgcagagccaccgaacggagggggcgcaaccgctgaagcggcaagcaggtgaacgaggagaagcacgcggacgcgggtgggaattggaaggcaaggatacgaaccagttgaaggccttcatggaagggacgaggtttacgaggccgccgaagccacggatgaggtggtccagtcgctccggcgtcacctcctccttgaaccgcgccagcacaatgtgcttcagcacgccactcctccctgccgccggggtctccgctgccatcgccctgtggcttcttgctgcagtctcgctagcttctctgcgcgctctccctcttccctctgttctcgactcgactcgatcttctgcttgccatggtttagaacttagaagtagaagcagtgggtggctacaacctagaaagtggttgggccgttggggttggtgtgtagtagtattgtgtatccccacaaaatgggcaccttggtaagagcaagtttatggtctagtcactgatacaaaattatcatattatctatagctaatatacggctccatcatttcgcttattcgtagaacactgttacacaaaccctttgtagccccggtttacaactcctttagtccactgctgcacaaaccctttgtagccctagtttacaacccctttagtcccgggtagcaaatcggagctacgaatccgggactaaagatatatatttttttttgttatttgcatgtgcctcctccttcctccttttttttttttgctttttctcttcctggcgcgctcctctactttttttcttttattcgtttttttctctctcatctgccatttttccttctattttatagaaaaattaaaaatacatcgatgaattcaaggctacaacccatgatctcatggttcagaacaaactctcctaaccaattcacccatatgacgctatttgatttgagttcattatttgctttctctatatagctgttcaaattttgtaaacacaaactcgttatgttaatgtaggaatcatatcttggtactatgattcggtagtaacattatcgcagaagtgcagtaacacgatacgttactgcgaaatgtataggtataggtcgttgctgcgaaatttataggttgttattgcactctttacagtaacatcatgataaaattgcagtaacagagaacatatagtagtaacggtactactacagtaccaccgcttgtgcatagctaaatttttaaatctcaatcttgtgcaaaatacaagtgcaaaaaagtacttctctttgtctattcaaagatacatagcagcaagcttagtacaagtaaacttttagaattctaatctttaaacaataatatctctcacatcgcatattatttttagaaccgttttcaccataatgattagatccgtcatgattattttataacgttgttactgtggaaagtagtcgtgttactgcacattgaccgtcgtgttactacgctgttccagcaagacaagaactaaaaaaaaaagtaaatctcaatctttagagagcaatatctctcacgttatatagtatttttttaatccgtccacaccatgatgttcgtaaaaaagtacttaataaaactagatacatcatgaccatttttcgatgttgttactgtgagaaagttatcctgttactacacgatgaccgttatattactgcggaattcctgtgagacgtgaacaacaaagtggtgggtaggggagggagtcaatgggcgggtttgaccggtgttgatgttcgttagtgatcagtttcgaccgtcaatattaccaaaatagaggagaactagttatgcttgcaatgtgtatccattttagaataataatattccactagtatttggttcactaaccttttgtagagaataaccataaagtggaggagaatcgacatcgaatcagacgataaatcaatcggacgatgtcgagaatcagacttatgcatgaatgggcaaagaactcagaattgacacgatgaattgggccaaaattcacaagtctgcacaaaggagcaacagaggaggccacctaccgagtttgggccaggagggcatcggatagagggtattagctagtatgtcatataactaggatgtatgtataccatgtatatagattctctttctattttctatccacttagcttatatactttcatatgagaatgagtattcccttgcttgtgtgtcactctaccctttgatttatcttaacccctgcttggactatgattattataagtaacatataaattattagtcaggttctctctattatgatctttccatgggattaaataaatacgatacccttggaatactctcgggtgaaatgctacaatggtatatccatgcgcttgcggatgaactctgtaaccataatataccaggagtatttctgcgccattgctgggaattatatttctagtaatgtcgttaagaaataccaacaaccgacgagaggtggctttgaccagcctttgactgaggtgggaggggggatttgggccctaggaagggtggggaaggtggaattggcccatgggagggggaggagtgtagaatagatttgctatatatatatttagcaagattgagatttaaaaatttagcaatgcacaagcagtggtactgtagtagtaccgttactaccatatgttctctgttattagaatttcaccatgatgttactgcattactgcacttctgcgataatgttactaccgaaatatagtaacaaggtatgattccaacagtaacataactgattttgtttcacacaatttgagcagtcatacaaagcatacaaataatgttctctattcatataatatcatatggtgaattggttaggagagcttgcctgtcacgcccggaatttctatccaaaattccaaacgcttacatgtgtgtaaaccctcgtccaggaatcagccgaggcacacaataacaaattgataatagagtataattattactctaattaataagcgaatataatgtcattacagaggtagatagttcctctcaaacaataaagatctaagcagcggaaaataagataaacggcgcagacgactccatcccacaagcagctcgaccagggctatgcctaatcatccacaccttcggcatcactgtagaactcctcctctgatgaatgattgaaaggtgagtatatgacatactcagcaagccacgcagcaaatatgcaagtgcaagggataacaaaggatggcataacatagtctcatttgcataaatagcatttaataaatatttcagaatttaataaaacagtaaggtattaattaaacaatattaatccaacgctatacaacatacccgttgcataggcccaaccattctgaacaaccattcccggctgcacagttctatctccaaaccaggaatataccattccaaactaggagctaaacaaattattaccaattacagcatcatttattatggtgagaggtgtgaaactaatcacgaaagacattgttaggccgcccataaccgcgggcacggctattcgaatagttttactctggccagaggtggaccactgtaccc

SEQ ID NO: 78591 - DNA, 575 bp, Oryza sativa
tagacgtgcttagtggcaaatatggcatgtctcttgaacacctccaaatgtgtatccatgtttgctctatcttaattgctttgcataccccaagctaatgattggtacatagcacaaaatgtcgtaggtgctccagaagagttggatactattgaaaagtcgtattggtgcacgtttttatgagaaaggcttatgaatcgcatcccctggcttgtcttatcgaaaggctcagggggtttcatcttttatcttatggacagatttattccatctgattattgtgtcctatgaactaccttcatcccaatataagtgcagttgtatggatgaacaaaaataatgctgcccgtagcttatttactaacatacattagctaagtacaatgcttaatttcatatttgtcaagatgactgctttccaaacttacactagtgcgaaaaataattggccctaccatatggtctcgcacccacatttgaaaactgacccgagtcgttccccttccccacttatagcccttgtaagtgcatacaacaatatcactcatcaaggcctattaccatgagttgatgtc

SEQ ID NO: 78592 - DNA, 13607 bp, Oryza sativa
caaccacatgagacaatggtacagtactacagttgttcaccttgctagcagacatcaatttgaacacaagcatatgctacattttggctctggttaggtctatgaaaatttatgaccacaagccttgtttgggtgcatttagacatgaaatttggggttctctagagctatgaccataaatgtgcagttttttttctcgaaaatgcaagagaactgcgtttcatttcattaaggggaagaaaacaaagcgaagataaatgtgtggttttaagcgatgtattaataagaaatcatggaagtatgcatgaggtgatgactgcaagaaatcagagtcaggttttatcatttgtgtttagaagtaatatccttgacaagtttatggtgtccagccaaaattttcctagggaagatccagtttgttcgcacttgtttccttctccttaagtcattgtatgtatagtgaataataagataagtctttataagtacatcaacatagcatactgacattcttatttgatgatctacagtgaggataagaggattaggaaaacatgtcaaaaaatctgctccctagccagatggcaaaaaaacatattctacaatgttttttttttaagagcaagggttttcaagattctatatttgaatcaggtatataacacataaaaaaaagcatctattctacaaggaagaaagatgtcatttatgccttgaattggacctttttaaaaaggcaaaaaatcagacaggatttctggtttttctctactttcttaaacctagtctgcaatatttcatttttttttgaggcagaaaacacttctcaacaaattgcacgcaagtgtgtgtgtgtgtgtgtatgtatatgtgtatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatgtataaccgcagttaaatgccaatgtggttatcataactcataaagccatcagccatgctagaaaacagatgagaggatatttgtttacaagagccatcacaagatgacacttagattgagactggagactttcttttcaatgaatctctgcatctaacatccggtttgtggtgcctttccaaatagatccggagggttaataggtatatagttacgcatttatatacaactcactatcaacatatatctggattcaagtatacctcaacaagcttttccacctttgtaaaatgccgaccaaacgaactgtagcgagtaccataaatgaaaggtgatatatatactctgagcttactctggaaggacaaacaatcaaaagttggtaaaaattagtcaaataccattacattgcaaggtataagggaaaattttccacccaactaaacatcataactccaaagtaattacatattggagaaaattagtgctcattcatgcaaacacatagtgaaaaacatataagattgcaacttttcacagaaaaaaaatgtactcaagtcaagaatagtagatgttttggacatgatttcagacaccatttggaagcagcgaaatggacccatttttgataatgttccccctctgtcctctcttggatggcattctttaagaatgacttatcccttctttttcgtttaggtatagatgagagatcaactctttcctcctggttgagtcgtttgtaatttactttattttattataatatatttactgtgggtgcttcccctacagtgttttccctaaaaaatcagataccaatgctggggtggtattatttacccctgttaactccaaacagagcatacccacattagtgcaggtactgtaactccgatgcacattctcttccaaccttcctactattgccatacaatacacttttttttaatgaaaactagtattacactattactagtagttgctgaatcctgtcctccagccagcctgtaggtcacctggtcactgctgttgcctccatgactgtgtctagagggagtgagggactcattgtaccaaggctgtcactgcctctttgtgactgttatgcactgagtcactcataagggttgcaagcgtcccacccctactagacaacccaagtgccggacataccctcccaatggccaagcctaaacaccaggattaccttcagcacccacattggtctggcttgggagctacccaatttgagcttaggaacagatattttgtatgtaatgcgtggtgagctcagccaccaaatcaagagctcagcaaattagtgatagatcgccccaagttgcttctgtggtcttcttttgctttaaacaatgaaggtagtgttaggagatagcctagttgtagtagtatgtgcgcattcaaagaacaacttttatggcaaccgcaagataattaaaatcaattaagggcataaggggcaacactagactaagtccccccccccctcgcagggaaaaggacaggtatacttggatttttccaaataaatccaaatgacagctattcctgaccagacccatcggaagcagatagtgctaaaacctccataatatagctataagttagtggaggagcacaaatttgcactccaaagcccaaatggtataagacatcattcaagtaaaagagattacttagtaatgccagtattaatggaaaacacaagtaccagttaaaacataagaagagtaccatacatatttcacactagatgttaggaatggcactattaatggaaaacacacaagtaccagttgaaacataaaaaatatgtataatacatatttcacactagaaagcaaatacgcatcacatctagatccaggagagggcctgtgcagtaaaaatctcaaagcaggaataatatataaagattctataaaataatgcaatgaaaacatagattaatatatgtctagtatttacatacatgccatcttgtaagctgcttcaagacttcaggttcacagactgctttagcatcattaacattgcctccattttccagcatttttaaagctgcccctacagcctacaaatgccatcattaagaaaacagagtccaaataataaatagtgtgaactgggtatcaattcatgttagaactaatgacctgaacagaacgctcaagcttgccagtcgcaataatcctgtcaacctgcctgcccgagtatgcatgagttgaaggcatcaagcactttcttgaaatatcctttaatgtcaaataagaggcttctctttccaccaaggccattaccctataagacaaaaaaaatctgtttcagctccatgaggattcttaaatataaacactacatactgtctcataatcatttactctgcacatgacaagatagaacaaaacaatttaaaaagaacagaatatgaaagaaaactgtagcaatataaatataaatgactaaaaaactaaaaatgcctaggtacaaatagttgtgacctcgatccccagtaattatgtagaagcgactcacctcttctctgtttcgctatccactctaggaaatgaactttggggtatcttcgtagaagtagatgatgaaggcatagttaccaacagttttccctgctcttttgcaggttttgtaatgcctgtagaagcatccttgagcagacatggatcaggctgtggtgtatctttcaagaacctggcttttttcttatcgggtttgacaacaaattgctcagatgaactcctagcactaatctttctggctcgatcactttcttgaatgcaaaccatatctggcagttttcgaagttctgttgaaagttgatcaggaactgactcactaaaaggcctttttttcttaaccactttggttgacttctttagaagtcttgcaggtttttctatgtttggagtacgagggaactttatatggtctctgatcggtgtgtcaatgtcagtatctatctcatggtccctgtaacagtttgcaaaaaatcattgatatgaacaatgttgacaaagcaagtagcaagactgtggataagtcacatacaagcaatagatcaaaattcttttcgaaagttcccaagcacgtgtaatagcatcctcattttcactatcttcaaaggaaatttctctgaaagaatttcaatttccatgagataaatagaagatattataaatgaaatggaacttgaaaagacaaaccacttgtttcataacagcacctaggcaaacactttctgtgatacgactttgggcagcgtctgcaaacagcaaactgtaattcctcttgagttctgtcctccaaacctttgcaatgaaaacaccaatggctggggcatgtaaatgaatgtccatttgctatcttcatttccagttctgaggcttcatttttgtttttagaatgaagttgtcgcgcaacacattttgggtggtaaaagtgcccacacgtggcattattacaaagaaacacctaaaagaaagatgacaaaattaacaaaacataactagaacaaagccctgaaaaagcatcccacacttagaatttatgatacggacttccaaactgctgaactatatagcgttacttcctcttgagtgaatctaaaataatcaggtgttaccatggcggcattaaattggcccgactgataattgctacatcgttacacaacttctgtcattagggcccatatagaagcagtcaacaaatccagggccagcggtactgtacatgaatagtgcccacgtgatactgttcaagcaagttgtgtacattagatcgatttgttagctatttccatcagtaccatcacctcagcaccatagcgcgaggcactacaacgctacatgaggtggctgaggcatgattagtggaaaatattggataagcaagagaaaagggaaaattgaataaaggcccactaaaacttccgctagagattcaaaagctgcagcaatctgctagatctgatagtagtggcgtggaatctgcgacagcaggccagctgtggcaaggaagaaggtgactgcacacttaaatcaacaacccgctgctttctgtcccctttttccttggagctctaacccttccttctcctgtaagacaaggcaccaacaccttacttcctctgtgtgttttgctgctgtagcgacaccttaaccatgataaagttccttaagggtcaagtcatcccagctatataaggatgaggtcgtatctcaattcattattcaaaaaaataaacaagtctttgcatctccctcttctccacagccattgtgatgcggctgccctcatggcaccatcgcacccgctgcatggacagctcaaacaggcctatggggcccttatcccaaacatgccattagaactttggagcttacaagtagaatgctatagcactatgccactatggccatattcaacaataaaattcactgtatcataaaaaaaagaataataaagaaacagtttttttatctaattagaagtgagcaatgacagtataccttagcagctggtccatctgaaggttctaaagctccacatataaaacactgatgttgcttatgctcacaatttttgcacaagaaagttttcattgcctaaaaatcagtagaataagataactcaataaaataaaaaaggtgtagatttagagctctctttatcactcaaaatgttcaagggctacctgaacttctgcctcagtgtacccaagtgtatcacaataggaatcttcaccagtaccgatttttgcatggaaggacctcatacatggaccatcacagctacagtaggataatatgtaaggattaagaattggtattataggcctgacaaaactactccacagtatttacagggaatttcatatggcaatgatgaaaccagaagcaaaatatcaatgaaagcaaagtatgcaatgttgttttaagcaaagtaaaaatcagtaagaggaactaaagaaaaacaaaattgtaccattgtactatcatttttgttgaacaatggataacaccatagcagacagggttcagtcatgatcacatattccatgtagactaattatgtgagcgctaaaacagttagaaatcaactaatttaagtgcagactgaatggacaatctttctaacattgcatggggcagaatcactagatggttcattacttcatttggtaaacaactagtgtttcctgataaaaacaaaatggtctgaacaatttgctagaagaacatgcagaggaaagttccaataacatttgaaattatcatctacaggcaaaatatgttattaataaaagtaagaaaatgatggagcagctgtacaaaaatgctcaaattcttgaatgtagcagccttgattggatctgttttgggggaacccaaaacctacttaaattcatttgcattcttagtttcttgtagattgttttttttggaaaaagtccaaatacccacctaaaatttggatggaaatccatctagcaccctgaactttaaaaccggacatccaaccccctaaactttgaaataccgttcatattaccccctaaggtggttttagatggtggttttgcatattttggaagattaaacgaacaactttgaataactaatataacatatgtgcatatcgtcagttgcaagccattaaatttatatttatacagtgataccatactatattatgttggtacttgtttgtaagtgagagctaacaaggggtaaagagaaagatttaggtgatcttaatatacaagcaaaatcttcaagctcccttcaccaacccgctcaccctatagaggaagcaaaaccagattgctcggccagccacagcagcctccttcctcacctgacctgacatgacaagccacctttaccacacaaaaatatgccccctcggcccaccgggcagcgatcccccggtgaccctgtccccacccacgtgaccccaagctccaagctcccttcaccaacccactctccctatagagcaagcaaaaccagattgctcgcctagccacaaccagcctccttcctcaccttatgtgcgagccacctttaccacacaaaacacgccccctcggtccaccgggcagcgactccatccccacccacgtgactgccccagtgacatacattaatgtgtgtgtgtccaatcaataaatcgtgttcaaaaatagacatggtattgagcgttgacatgtaatttcgtgtgtttagagtggaaaggttaacaaagttttgttttggatagctttatcagtgtcccatttctaaaccttcgaatgaaccatgccattatacatatggtaaacatgaattcatggtcaagctcttacgttattgatgtacattgccttgcatcgtagaataaatatattaccaggaaagatgttttttattacttttcttggatggttttaaaaactaaagagtgaacgtgcttgatatatgagttgagagtcagattttaaacatataagatagttgataggagcatagacttattccttccgttttaagtatatgattagttggcaccctgtgccttgctgcaggatttgttagttttatcgtcaaagaaaatcaatgttttaaatgattaggtgcaactctgtgcatataaaaaataggtgataatgtggcttcataccctatgttattacgatacaatttatgctttacttttcaaagctttattgtgtattgttatttccatgtgtaatgtggatgtagtaccaattagattgtttggacctctctgcttcatctcaagtttgttctgaacatgggtttagtatgctatctaattgttcctaataaacaaagctcgcatctaagccaataatttatgttgtattcaggaaaaaagatatgtttgcgttatctttgaggactttgggaggaaaaaacatggtgttaagtgtagaatggataacactgtcgtaggtgactgtgaggtgaatggataactaatcaatgattgagttagatgaataaggctgtgttcgttctgttgagttgggaactcattccctccgtacggaaaacggagcaacatattttcttatgtttaattaagtatttactttttttgaaaaatggattaatatgattttttgaagcaactttcatatagaaactttttgcaaaaaacgcaccgtttagcagtttgaaaagtgtgcgcatgaaacacgagagatgagttgggaaaaccgggggaagaacacaacctaagtaccttgttgatccaacagttgtatctttgtaccaatgcgatctaatggcttaaaattagtgatgacatggcttcttgcgtgtcttgctttataggagtaagtgctacttagtgggtaccaattatatggtaagatacgatatgtccagtgtgtatgtcatgcgatcaaactcatccaacttatatacaaattagataaaaaacactctgcaaaccaccttgaggatttatataaacggcattgtaaagtttaggggggttgaatgtctagtttcaatgttcagggtattagacggaccttcatccaaagtttagggggggggtagactttttcctctttttttcaaaaaaaaaaaaaccctatgtagagggacttttaatttcccttgaataatttaaatacctaagggcctgcatggacaggagtgattcagattttaatcaaactatttaaccaggaattagtgataccatcacctgagtagctactttatagaatccaatttctcaaaatctaatcccaaagaccaagaagtcaggcatgatctcattgtacatgagacacaggcttcaataggcgaggacatgttgttgttggacagctagaaaattcagacattgctaagcagttaaacctgatagctgacaaagtctttagaaaatgggagcaaaactttcgccaggtaatatggaccttcctgagcttgacatcgcaaataattcctatttctaaaagcaagtatctgtgccaataatgaactctccccgtgtatgttcaactgactaattagactagaagtcgcgtacattctgaagcaatgggaaaggattttggatgatatatcatctgtataaatatcaaacttaccataacagatctcctccattgtcacatatgctacagattgaatcaaataaatcttcctcctcttcttcatcagattcaatattgttatccacgtcagccatctcctctatgtcctcatcatcagcaatgaatggaactttgatttccactttatctgaaccaacctagacgtaattataataagggtaataattaatatcatagatcagtttttcaaaattttctagagaaggcacagtcccaacgtacctcactaaactttttcctagaagtttcttgagtgaagccttgcaaaatctgtaaaaaaaaacatgataagatgtcaccgtaaacagcaatcaagcacattgaagagttgttacaatcaccagagttaaattacactatactggtgttattatccatatcaataatcagatggtgcgtacctctgatttagccaaggtcgagtctttctcagcaaaatgcttaattagtaaacggtgatttcttaagtcatcctctgagggtctaacctcaaatttgctgcaaaatgaaaatgtttcaacaaatctgagtttttgtcatcaggcgaagaatggacagatagtgaatgaaggagtactcgaaaattttacgaagatgactccacaggttcttttcaggctcctcaggcttctttttgaggaagtgaagcatctgcacggtgatcagtattgtccgaatcttctcctcatagctgttcttgggttttgtaaggctaatccagctgccttctgctgaaagaacagaaatctccggctgcttgccttgaaggcctagcttccaagcgatcactttcctgtatactttgatgccaggatcagcagttccccacaagaagacatccttcttgcattcaggaacctcatcggtgtctttgaactgaaatggcaagactgataaacagacaggcacctcccgtgcatcaagaaggtagtaattatccaccgcattcaactgaggctcatcgtcatcatcgtcgaacatcatcctggataccggattcttcgccattgattctcaccggatgagttggacctagcgtggggcatgtgggttcagttgaaccccaatttttttctgggaacaattgaactgtttattagtactagggttaaggcaaattagggggaaaagcagcttccagatcttaggggagaagctagggctaacgcaaattcgagaagtagcatgggtgggtaacggatggatgctcaccagcgacagcgagctaggatgcggcggaagcagcagcgacggcggcgccgctcctcgtcgcgggatggagatcgacgcaggcgggcggtgggcgaaatccgaggaaacggccggccaccgaggggacggggagattgacaggctcttgtcttgcacgggcgcaccgccgcagcccgcaaggagtcgtggcttttcctctttttttccttttttttcttaaggaatcagaggagtcgggagtcgggactcgggagaggagagacgagtaagggctatgagattagtacatgataattgtgaagcgagtatgggctatgggattagtacatgataattatgcacgtgcaatgcacgttgtggtcaatatttaaactaaaccaaacatattgcacctaaagatttttttattgatatatattaagagcaggtacaatagcagtctataagctagcaataaatataatttaaagagataaaggaagagagagaagagcagcggtctacatatctgtagtcagctgtagcacggactacaagatataatatgtgtatgacaggtgggaccatgtattaatagtatagtaagtaattattgtatgaattagctattacaaaggctatagatgatttgaagctagtagtaggctatactattaaacttgctctaaattattttaaggctactatgtttgcgcataacatagtgcttactattgctttagaaaatgaaaagataagaaagatctatagcttcttttctatactttatactctatcattgacccaaccaactaattttattttcaaacctaaaagttcaaataacaaaactaaaagagggcaagatgcatatcatatggaaagatggcaaatgccacaagaccaaacctgtgcaccaaaatttgatcatattggtcatgtgtagttgccaactgatatatatgtgattgtcataaggacaccagtttctcttacataccaatttacacataatctcataagacttgaatcctggatactccaattaattaactttgcataaataattttgtaactccataggatctaacaataaagaaataaaaagccattgttctttgcataaataatccaaatgttcattgttctcataagctccaggtcctgccattctgccccaaaggatttgattacaccaacttgaacttttaaccatgttcaatgctgtctacttcgaacaatagagctgcttctccataatatctgattcgagatgtcaacttgcctctcacatgaaagtatagaaccaaggttataggaataatatataatttctgaaataacgacaaacctgaaaaattttgtagtccacctgttgcttcattccgttggcctttaccaaatttagaagttagacacaactgagctcagaaggttcaaactacactcttttcccttacttgaccacaacaccaacatcaaagattcctggcgtaagatcagattagagaagaggcaattgcttaagaaaattctattatttaacaacaatatcttctacatcactattttttatttttgtggagcatggtataaagaagaaatggaaaccattattcatatttgtctatacatatcatgacactacttagtgtgttcaactgaatattcactaaataaatttgtaatcgtgttgtttatgtgttgtgagctgagtcaagtagagtagcatacatatattcataagaaaattcgctgcatgagattggcactggatcaataaaagaacatgttgaactattgatcgatgcaatagtttgacacacatagaccaccacatggcccctcatgggtgaaaaacataatatagaacaattggattatgcctgacaattacggggtcatgttctttcttgacctgggaagaaagatttcagctcttgcagtttaatcttgcatcatgtgcagatgtaaaagaaattaacagctacatctataatttcttttagaatttatcatgttaatttagaacgaaagtgaaacagtacctcatagttaagtaatgtcaccatgtgcaagcttcattttcaaatcttcctctgaagtatatcttcaagcagcataattttgctgagaaatcaacctgagataacagcttggttgagcatatttcgttggacattatcctataatagagaacttttacggtgtttgcattccaaaaagggtaaagatccaacgctcctcaatcacaggtactatgttaaaggtatttaagtattgatataggtatttaggtactaagggtaaaaatataattttgctagtagagtgaaaagggtagaattgtcctccaaattataataggtaccgcataggtacgctctacacggtatcagcgtatcttacacagtatcagcgtatcttttacgtggtttcttgaagatttacgttgtattcgagttaagccaccgtagtgttctttgatgttctcttttgcgtagatttctctagatttacattgtattgttataatacattagtagcctaattatgtgaattttttctacatttacattttgttccaacgaacacatgaaaactcataccttaattctgttaaaaattatagtttgtttctagcaagatatttatattgtgtttcagaaacatgaccagttaaaatatcacccaaggttagcatcaatttaaattatacatttcatcaatttatgatacttgcttccaattgaacatgctatgtcaagttaaccaacaacatacgaacacaagtagtctgactcatggtgagcatgctcacaaacaccaatatcatatccgctagataaatatgttatacaaacttcatcaacaacagcctttttacaacaaaaggtcataggttcaacaacaggctaactctaatattagttcaacgcatagcattctgtaccattagcctatttacattccaacattcgcacatatacaaccaaaaggatgcttctgggacatggcggttaaaaaggtgcttagcagccattcatagcccttaacagtttcctctgcaattatgccacaaccaaacacaacagtgctccggtgctgattcaatcccacaaaaggaataaatggcagtttatacctgttggtcatgtatgtactgtcaaatacaacaacatcac

SEQ ID NO: 78593 - DNA, 10654 bp, Oryza sativa
tgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagctcaccagccgttcaatggaccactgaacaaacatgtttacaaaaatcattatcttaagctgaaacaggtaatagtactgtactaatcttctgcagaaattgcagtagatcagtgccttaatgaacatcaggagcagcgtgagagccgtacggtacagatgcccaaaggacggggaccgtatgcacggccacctatcctgtcccaaaatcgagttcaaagtacgggagagaattttgtatgggtggtcccatccggccagatcaaggtgggtcccggtgctcagcggcacaaaagagtgccgcgtgggcccagcagcgagctcttcgaatattttgtgctgggctgggctcaaagctccaaaagatacagtagattggatcttgaggacggatgccaaggtggccggtgtggcggcgccgtggccgccaggctggctggacgcctccggctccgggccgacgaagcttcctcgcggcttcgagactcgctgtgcgtcacctgccatatgctctacctgatggaatctggatgtgtgggcggtgttatggcaaaccacagcaaatcagcctcactgccgatggcgttttttttttattaagataatgaattgtttagttaagaaacaaagttaagtacatcaagtctttacacctatcaaaatgcaagtacctaaaagaaagaaggaaaagaaaaggtcatacgatatcttagacataacatgctctctatgacctatttcccagtactacaaatctggacgggtggctattatattcataatactatggacagtcctccgtttatattccgaccactagaatatgtcacattatattctagatttgttatttatgagactgatggagtaacaataacgcaacattagggcacccacaatggttatctataggctctctacaagagatctatgtcagcatattttcctacttggaaggtattaaatgaagagagagagcaaagctatctactaacgtagagatagtctatagagaaaaacgaggcaatgcatgagagagctatagataccaatgtagacatactattaaggtattttactattaatcgagtctattgctgagatgtacatgtttttatagagaacaccttactttatcattgcgggtgctcttatgtattctttgaaaagcattcaataaaaagtagtactccctcttatcccaatttgatcattacataaggtatttaagatcttctcaaaatgaccatcatctaacaagtaaatctttttttgcgccaaaagtaaatgagcatcattgaatgcactgcatgcaaccaaccatgagtaatttatattggtccaactatatgcaatatttaaaacttgatgctccacgaaacacgaagcgacgtagcaccttaactgatgagaattaattacagaatgatgaatgttttattgttcttggtatatgtgctctttacttaggtgatgattgaaatgggatggaaggagtatttccttgttgaaggcttttcaaagaataataacatttattacgtcatttcaactttgaatctcagcagtagaagaattgattgatcgtttgatggcacttgatctagtataggagtaaataagtaaattgcactgataatatatgacacatatatacacaaaattgtaagccgctcatcctagtacacaaacatgtgtggtgtgtgtgaatcaggactaaaattataaaccatagctaatctttctgacttagagatttatgacgccagcatacacacgagaatgacaccatgtagatatgtatagaatctagaaataatgcatgctgactgtatataaaaagatgtataaaaagaagggagttatagtgataaaaacagaggtaaggtaaactataagggtaattttcaattataacatttctcatgccctcacgcgtgatatcctaattagagttcaacttaacaagtttagctatagtgctttatttgaccttggttcgtatgcggtgcatactagctagttcatctatctaaacgagcgtttcgcaagttcgtgtattgtcaatacaaattactcgttcatgcgtggtgcttttggtacatattttcatttttaagttagagttagtcttttcgtcccacaaaaaaccaatctagcattggatgagatgttttctagtacaatgaatttggacaagagtatatccagatacgttgtactaggaaacgtttaatccaatactagtttaaattttttttggacggagggagtatataactatattagccaccgtacacactagtgaggcttaacaaaattgcatcagttttaagctatcctagatcaaatcccatcaaacgatttgctcaaataattaaccctcgcctaatccaagcaaacaaaccagccggagtgacaaatcactacctgcctctttttggggcagcaacatgcaaaaatcaccgcgagacgtctcggaggcgcagtactctagagtctagatcgccgtcgatttgctgacgctctactctgcgcacgtctctaccaccgttgtgcgtacagcagcagtagtgctgtacaggggcctccgccctccagaaaaaaaaaaaccgcactcacttggtacggtactgtccgtgtgccactcgtacagccgcagccgacccccgacaaccgcaacggcatgcgccccctgcacctgcaaccgcccgtcgtcgcaggctggctcgctcgctcgcagcgtccggcacgaggccgcgcgtgagacctcccgggggcgcacggccaccttttcccacccggagcccggtgcggctgcgcccaaaagcgctcgcacgccacagttccccttgcccgcttgcccccctcgcgcgcgcacctgtgcctccccaagtggccgccgcccgcgcgcacagactagtagcgaaccagctagtactagtctctagccgcgagcgtgacgtgggttgcacgctcgtgtcacgcacgcgtttgatacgcccgtgctgcttgcgatttgcgggcggctgatgggtgggcgggggcggtgcgggcgtacaatggcgtgcgcgtcaacgataattctgcgtggattttcgagggattctcggcggtttggcggccggggagggacgtgcccaggttggcactcggcacttggcagaattggcagcaggcaagctttcccggtacagtactggtgtgtcgccccgcaggcaggcagcttcgtggcccaacctttttgacgacgttactattggacccgtctgcctttttagcctgttctctgtggcttgacgtgacatggagacatatgatgcctgctttcaacctggattaagttagaccgtgtttagatgggactaaaacttttaagtttctatcacattagatgttttgacattaattatcgggactggctatatcttatgtgacagattttttagcctcctatcatgcatatttcttatcctttagataaacatctaacggatgacattaatatacacaaacaaaatacaaaaaacaaacaaacggaccacatgaacaatctgaagctcacgtgggctcaagtagatttcagacttacatcgtaaataccctaaaactacatatgtaattatagtgtaagtacgatgtaattagtacgcgtgggatcatacaatatcggatattctgtgaggaacctcacgttaaataacggtaaaaagagtaacagaagggtcttatggtgtgaacacgttaatgatcagacattggagtccaattccatgcagccataggacatacaaaaccgaatcttagcgtcaaatcgaacggatagaaaagtgacagatttttgggaaaaaaactgtcgacaaagatatagcaattccgttaattataaatattaaacataaactattaataaaatctatttataatcttgaactaattcgcgcgacgaatctattgagcttaattaatccatgattagcttatatgatgctatagtaaacattctctaattatggattaattaggcttaaaaattttgactcgcaaattagctttcatttatgtaattagttttgtaagtagtctatatttaatactctaaattagtatctaaatacagagactaaagttaagtccctggatccaaacaccaccttaaacattggagtatggatttgctgcctcctcttcatttactctcatcatctaaattatctaaggctgtgtttagttcagcgcaaagtttggattttggttgaaattggagatgatgtgattgaaaagttgtgtgtgtatgacaggttgatgtgatggaaaaggactgaagtttggatccaaactttggatcagaacacagcctaaattaggcctggtttagttcccaactttttcttcaaactttcaacttttccatcacatcaaaactttcctacatacacaaacttccaacttttctatcatatcattctaatttcaatcaaatttccaattttggcgtgaactaaacacacccttagttcgtttttcatatcttcatttatcaaattttaatataattagttctctcttccaatgcatttatcatatttcttcataaacgaccgatacaatgattacttaaaagtaaactttttttagattaataagagaagcttaaaataaacttattttggaacgggtggaataataaattcctcttttaagtaacaatatgggtttgctgcctcctcttgatagagattcctctatcttttctggaaccaattaatcttgcttggggaaaaagatgttaggaatgatgaagacgaaatagcaacgttttgcgcacgtttttaaacggatcaacaggaattccaaactggtttgccaacatgccgtccgtcaaggttcatcatcatcaaggtggaacgtcaataaagttcatgtggcaacattctttcttctcgcgagtaagctgggaggaatgttctgcccgagaatcatatcgtaacagcctaagagctgatcagctcaagtttgttttctccctgatatagttttgtgtgtaccgcgagagtttcctagcagcttcctgcacgaaatgaggggtgttatctgacccactaatcaagcacttggttgccgtcttggcctctgaatctcggggtaaaaatagtgagagataccaaaggcatctcagaaagggggagaagagacagatggacagtggagcaggggtactaaacaaaaagggtttaccgaagcctgcaagtccaacggaacatgatgcaccgtgcccctttttgtcttgcctctgctagatatggttgaggacaaaaatgtcttggtttcaacacgatggcaaattggcaatgctacgtgcactcacaagcaagggcgtgggcaacctcaacgttgcaactttgcagaggaaggttatttcaaagggagatttattttgctctttttggttgattccaaatttccaatcgactgattttatgcagcagaacagcacaacattttagttttctagaagtagtacacctccaacgcaaatcaagaataatgatataagtaactccagtacatatcaaacggcgctagtttgcacttacagtcaatcatgacatcagataaatatgtaatgcagatgaaaaaaagaaataaaaataatcaatgccgtctttgcaaaataatgcaaaggtagtaattacttaatgttgatcaacttaccataatttctctaaagttgctcaatgtttatttttaactagatagtaacttgattattgccttaacgaatactgcttgcttcttgggtggagcgttaaaaacgtaaatgcatatcgattgaccaaaacatccttttttaagagcaagtttaataatatcacccgctgttagctgaaatttctttccatgacatctgtaaccaacatacatactaatatatacaatagggtcagctctgtatttatcctccttttactgtagcaaatgatatttaattgcgctgcgccaagcatctcctctcccgcgcaaaacggacgcacttttttcttggagtacacgtatcggcgggcgactatttagtcgccggctcgtactctctctcatctgcgctcccggccaagtcatcaacagaatttacgtggcttgcttatcgctagcttttctacccctattgaacctgctctaagtagcttctgacagttatatcttctctaagaatcttcaatacttccaaatagtaagtttttttcacctagtttctaggaattcggaagctatagaactatgtctgagaaaaaaaaagaagctatataattcagaaaatggaaaaaccccctagcttttctggatttcaccaactgctttcagaatctccatctcctctaaacatggcctaaatttatctataaatagctatatactcattgcgtatactactaacatgttaacgtgacactttgctagaaaacttccgcaagtttttttcccctaaaatttcagatttgtaaccatcgaatcgtctcgagatttgtgcatgaagaaaaaaaattgctagaaagaaattttcacacttgtcacgcataggattctagcactaactaactaaatcatagttgaatgcaaatttatataagttacatcataattatagtatagttacattgcaattatgaatgtaattacgctttaattatattatagttacatctgaaagttttggactcagaaaaacttgcggcagttttttttagatactacccttatcggagacattgtacgtggtgggtcgactggtcgtgtgcccattgcataatgcaatgctactcacttgagcgcaccatgcaccaaaatagaagcaacaccctcgaaaatagctctatatatacactgcccgtgccaccctcatcatagcttcactcagccacggtctcctcctcctccttccatctgatccacctgtacgtacgcagctcagccgccggccggcgagaaggagaagaagctagccagccagccatggggaacagcctgcgctgctgcctggcctgcatgctcccctgcggcgccctcgacgtcgtccgcgtcgtgcacctcagcggccgcgtcgacgagttcaccagctgcccgctcaccgcggccgacgtcctcgccgcgcaccccaaccacgcgctcaccgccgcctggtcgccgggcggcgccggcgccggcggcgcgccctgcaggaagatcgtcatcgtgtccccggactccgagctcaagcgcggccgcatctacttcctcatcccctccgcgtgctccgcgcccgccgccgacaagatgatgacccgccggaagaagaagaagcgctgccacggcaacggcaatggcaagggcggctccgccgccgcggcgagcaccgcggagcaggacaactacctgatggagctgctgtccgagaagcgggggacgagccaccgccggcggcgcagcggcgcccgcgccggtgtgtggcggccgcagctggagagcatagcggaggagccatcagactagctaggcagctagctagtgaaccaccttttgaccattttttttccttctttttttttctcttcgtttcttctcctctcgatcttccgctgtgaatatgaacggtggatgatgaggacccttccaattttggggtctctctcgtgcgttcgatcccctgacgagctgtaaaaatcttcagggttcgaacgctgtgtgtgtgtctcggaagtcgagggaaaatttggagaaaaaaaaaagtaagatccaagatgtacaaacagaattttagatggagtgcagtgcattgatttgtttatttccaagttgctgctgtaaattgttctgctcatttttgtttgctggtattgtgactctgagcgatgaattataccaaattcaaaccatttgccatgcaaaatttacgagggtttactgttcagaaacgactttaattagtttttttttctttacttgatccaggtaacagttggcgtcggacagctggaatgcataatccgatgaagattctgcggctgagacggtgtacgttcactgcaccggattaatttgccggtcaagtcatagataccgccagtagtgtaacagagtgctccaggcgcgcgacgtgtcgacgacggcagcgccggatccgaaatcggcgaccaccttgtctcccggctgcccgaccgggtttgtgcccggccagttgtcaagaatcgcctgctcggtgttaacttgcgcaaactcactacgtcaagacgtcaacaactcagctctaactctggagatgaagcctaaccaaacagttttactttattaaaaatgggagcagaacttagtagagtgctcttcaaaataaactagaaataaattagagatgtggagctgggtttaggctgctactgaactccacttcagactgaactcctagagctaaatttaggaattggagctctaccaagcagggcataacgctaaaaagtcaaatagtaaataaaaggcgccatgtatccaagtcttaaaaacattttctacttaaaatctaaaataaggctctcctaacatatatatttttagaaataaatggtcatggtctcgtgagtggcacaagagcataatttttaatagcatgtcaagttattatcattcaaccatattttttttttactcgggacaatagtgaggatagtttggataaaaggttcatatccaaaaatgatactatgatagggcttactaattaacataataagaaaggtttgaaagtaaagaagttattttggatggttatgattgcttcaaacgtctttctctagaggcgccatcggcaaaccctcactcacctatgtgatctattaacattgacttactaagatatatcggcctagctaccacatctatggtacatagtaaacatacatgttttctcttcttactactcttcatcatcattacgcctctcttatcttcaatgtctacgccattttcttagcactagcacctcccacgccaactagcttatagctttcctgcccatatcacattcatagttgatctcccccccccctcccccagtcccccctttccctttagagcatatgggatttacatcacaagaggtgaattagaatcaatttatgaacctatgatttgatataatttagcatttccttatatttggagattggctcgtattcttcttattcttctatatccccccctcccttgcccaaattccccaccttttatcttctcccctcacacacttgtttggagctcgaagaacactaccaaatattggtttattaagattgaagaagatcctattatatgtaccaatcagttctgatactatattgagttatactatatgacaacaatttatcaaaaatttaagagtgaataaccaacatggtccttgaacttgtgcttaaggatcaatttagtccctggcatttagtattgtccaaacaagtccctaaagtttattgtgtgatttaatatagttcttggaccctctaaaaatgtcatgtgtacatgccacatcatctatgcatgcaaattcaatatttaaatgcccattctacccttacactttcataggaaataaggaaaaactattgagaaaaaacaaaaaaaaaagttttggccattggcattttcctttgttttattgcttattcttgtttttccctttgtttttcttttctttttttaataaaaaatgtaaggttaaaatggacatttaaatgttaactttactacatgcacaaatgacatggcattttaattgggcccaatgacttatattaaaccacatgataatcttcagggacttatttggacattataaaacattaaggactaattcgacctctgagcaaaagttaaaggactgaactggctattcacccaagatttaaattgacgagaaagagccaacaattcaccattcattgtacttcaacaaattaacgcctgacaattcatacatagcaaagccatagaacgaaatgttaaatctaccacaatggggacatatgaataatttaatacaatatatccaaattgtgtttacagtttacatttgcatactacaacaaatttttcatttgaaaaaaaaaagttaagcagctaaaaactgatcttaattattttctcgttctccctatacgccctctgtgcaattgcaacgcgttaaaacgaaggtcaccctgctttctgcagacatcagctgcatggcccgggcctccgaaacaaatgaaacaaagtcacaaaccttaccggagctaagctaactcactccacatacacatgtacacaacatccatggatcatgcatgctgatcaaattgacggcccgattagatgatcaaaacagcagcggctgctcaaagaacgacatgatgccgtcgtctctcggctcatccttggctctcgacgcgtagtacaccgcgtcgttcggctgctgctgctgctggct

SEQ ID NO: 78594 - DNA, 5173 bp, Oryza sativa
agagcacagatgcatgtcagcccacacgtacacgcgtcgaacacctacgtgacagatcgatatatgtttacgcacgcatgcaacgtaccttgggtttgggttgcccttgaccaccttctgcccgtacttgcgccaccggtagccgtcgtcgaggatgtcgatgtcgctcatcgtctgcacaaccaccctcggctcacgcaccgtccggttgccggccaccagcgagacgccctcgccgtcgccgccgtctctcctccacctcttggaatcaggctcgtcgtcgtcgagatcctcgccgccgccgacgctagaggcgacccgcagcgacgagctgacgccgttgaccgcctcgtcgtccccgaacgacgccgacgagttctcgggcgtcgccaccggcgtgccggagagcgcgtcggcggaggagtatgcgtcgctggcggcgccgccatgcagcgcgtagccggagccgccgcggccgcggccgttctgcggcggcttggggtggctgtgcgcgcccttgtagacgatctcggtgacctggccgtccggcgactgctccaccttcttcttggtcgggcagccagggaaggtgcacttgtagtagctgcgcgggttctcgctccccttcatctgcttctgcccgtacttgcgccagttgtagccgtcgtccgacgaccgccggctctgctgacggaagccgccggccgccgccggcgccgccacctggctgtagctgccgttcccggccacgtcacccgccgccgccgacgaggtgaattccgctggcctagtgtcagcgtccatggtcggttcttggtagctccatggctgctgctgctcgccattgtacgggtcccctccctacaatattgcaaacacaacaatatcaatgatacatgcatcttttttttggagtgcatcacatgcagggtaattattttttccaagggagttttgactaattgatctagtttagaactgtagcaagcttgactaatggtatgtgcttaggttttcatggagaacgtgaaaatgaagtttgcttttgcaaatctagcctgagtgtcccttatcattaaaaaaacatgttgattaagatatcttggccgcgagatattaatgcatttcatcatatatgtatgctttggcataaaagtcaaaagagaacctccaatccacaagaaattcgtaataatgcaaggacgtcgttgatccggataagcttatcattacttttttttagtaaaaaagtttgtgataaatcactcactaccatgcgactactggcccacatgtcagtccctgttcgtaatttcttagctctgcactaataatttaaaagttgagcttgatgttcgtcttaccaatggagccattagcatggagtcctgcatgaaggagttggacgtcgtcgcggtggctccggccatcgtcgtcgccggcgccgtggacgccgtcggcaggaacgtgaagtccgagtactgttgctgctcgtccttgacccctccttgcacctggctctccggcgctatcgccgccgtcgccgtcgccgtcgtaatccagctgaacaatgcgcccgtcgtcgtcggcgatgggaataactgaaacaaacacgatggagctcaataatcagccacacatgccggtgcaatttggcaaaggaaatgggatgctcgatcggctacggcggccgtgcttgcttacactgggcgtgaggaggatcggcgagtcgagaaacccggaggacgagacgccgccgaagtaggacgacggcgacgacggcgggagagaagacggcggcgtcatgaggttcaacgacgagccggcgccgccactgagcaggctggagaaggacgacctgctcgccgccaaggagagggagacgggcctcgagttcaccagcgggaggctccccggcgcggcggtcatcggagacggaggagaagaagaagaagaagaaagctagcgattcgatcgagcagagtaggatgccaggatcgatcgggtgtgcgtgtgggtgtggctactgcttcttccaacgacgacgcctccggtgatcattatatagacctttgaacgtttgaccgttgactggtcaaagctccctcgaggtttgactggcgggctgcgaccccgcatgctgctgtggactattcgcacccaccaatgggagagcgctgagcaggtgacgtggactatggtggggcccggtgcgggagaaggcgggtacggtttctggtcgcgggggttcggagcgtgcggagtgacggtcgcgaatcgtttgtctgactagttccgggcgtaccgtatacccgtatactattacaggcaaaaaaccaaaaaaagaaacacaatgttctcgtttcatttgattaattaaatgcaaattctgttgcggtacatctagacttcgtgggtttaactacaaaacacaacatagagtaatttttaggagaatatactctgagttatttaccaatggacattgcatacattaatttagtgtttctaggatacaagataggacctgctcttataacattggtgtgccccaaattgctccttggtattctttatggtaacaactaaacgataattgtacatctagtaaataatcatatttttagagtattttttttcttaaaatttacttcgtgtggtgtcttacatatagaaccacgaagtagcgtagcaaaatttgctataattaaattactagtggtttttttaatgaattggggacctgccttctgaagtattaaaccatgtcagatggttgggtagcttatttagtagagtatagttatttgggttttgtatcgctttttacctgtttaatttcttgcccctgtttatatttaatcagcttgactgtttctactgttgtattttgcatttcaggtgtctgctcggactgtatgtcagtgacagttgtagtcccaagacattgttctacgtggatttctttttgttgttaagtgcagcatggtgccatggtggtgaactggtgatcatcaaattagcagattgaccgcttcttagattataaattatcgaagatgagatagtactacctcaattttcaaaagggtaatgttttggacatcgacataccttccattgcatatgttttatcattactttctcaaactatatatttattataaaaatataaaaaaataactatatgcaagagtttttattgacaaaactactaatataatttccatattttaaatagtgatatttttatccattaataatttaatattttgagatttgactgtaaccattgcaggacgtcatgcatccttttgagagaacggagatagtacatttctttttttttttagagaatggtattttttacccggcctctacatctaactagatatatatggccatttaaattaggaacctagccccacaaacaatccaatttgaaattcactttctatggaggcttgaactcaggatcttggggtacatttaaattagaaatttagccccgcaaacaacccaatatgaaatctactcctatgaagatttgaactcagaaccttggggtactactcaggtcactgcaaccactatgctacagagaaatagtaaaagaagagctcaaacagtttacacataggaattgtgattctcatataggtttttatcaggggcaaaattaattcgcttaagtttatcaggttatgaaactttgcagtttgttttcgttcttcaaaaagaaattgcagattgaacttgtacagacatatttcaggtctatatatccacagagaagctaataaggttatgagcaaatcaccatatatagaagtacacttgtgtgaagtatagagacgaggtgagacttgtataacaagcaacgtgtgcatccatacgattggcgtgttgtacatgcatggtcgatctcgagtagcgtgtgtacgtgtaccttttggatgcagaagtcacttggtcacgtggagaaatggaaagtttttccttgttctatagacaggcctcctcgaatatcttacccgtgccaaacatgtgcgttcactctaatgaggattatagcgtgtatacgcactagcgcactgtttagtccatatagtccctacgaattgaaggaactactaggaggatatcatcacttttttaaaccacaaaatcttgtactacttctgttctgaaatataaatagcaacttgtattcaacttttattatttagacgtaacctcatttagatacagagccagaaactattatattttgggacggatcgatgtaataaattttattgtacatccattgataagtggtgaagagttttaaccataggtaatcattcaaccatcccatgaaataagtgaattcattaagatctcgatagttttaaattataggatgcaggttatgtgcggattatttatgccacacttctaaaagtataatatctcaaaacaaaatatccataatccatccaattgtacatttcaaacactcctaatttatgaaacctagccataatatgttatgtgtttcgaataccaataaaaagaagtaagtcgatcattcaatggtatcttatatctaaaaaatgccaaataaaacacatcccaagcagaaatatcacaggtatcgctacgacctgggccattgcaagaatatttgtcactaaatatacttataatttggacttgagaaaacgttaataaaaaattacaaagtttgatttgttttttcaaaatattatatgcactataatttctttttacgaagggagtacctcttgctggctttaagatcactctattccttgaggggcatctcaattgttctagatttacagataacatccaagatttacaggggtattttttaaataagttgtaagggtcagctgcccacaacttgtaactgagttgccccccgctggattgaagcctgaaggcgcaagcatacgtggcctaagttaactccagttactagtagtggtaatgtcctttatttctaaagatggtgctacttgctagctacagaagcaagcatttaaacagtgcatgacactagctaatttggggggaaaaacagtgcatgacaattgactggtcagcgtggaaaagtcattgcctcgtagtgcaaaagctgcgagtactggatactgctcatgta

SEQ ID NO: 78595 - DNA, 2949 bp, Oryza sativa
ttttcatatgcgcatgaatatgctcccgtttatgccagctaatgtttaaggagtggtcagaagtaagaacattctcagaaattgcctcccagatagaagcagatatttataaatatgaaattgtctattgcttcacaaagtgaacaaaggggcaaaaataaaaagaatgacatatgttttcttgttagaagggttgaaccaagaaccagtcctcagggagccttcgtctgcacgtaccgctgctcgcgataacgcatgttatatacagaagctgtgccattcattgacctagcaggttacagagatagtagagtttttagttgtatcaacgtatcacatcagatgatttcagatgatggaacggactgacggcgctgaagctgtcaaacataggttcagtaccaataatgaaaaggttgatgtcgaatcctgaagcaaaatgtccattgcgtcacggttttgtgattgatgaagtaaacaggctggtcaggggagaactgaatgatctacagatggcatgagagcatattaaaaaattcacggacatcttcttgttagccatgaatttcccagcacaaaattggatagtaaattgacaactctcgcttaccattcacttcacctcaaaaagaaatcttacagagtagtacagaactgaactgaaatgatggtctagtctatacatttcataagcaatggcagttgcatggaagctgcagatgaaaaaaaaaaggtgtatggtagttttctttacatcaaatatacaaaatagactcaggataactaatgcttcattgcatttcccggtactacaattcgggctcaccgtctctgtggagaacagatggagtaggcgccttcattgtcctgtcgcccattgtcggcgaaccccccagagggctaggtccaggtgatctccgtggagctgatggactctccataatgaagatcgatggactagcagtgctgctcctgtatggcgaacctggatttgacctaaaaagaggcaaaccatcttcgcgcgacaatggggtcattacatgctggcttctcgcagtaatctgctctgtatatgacctatcttcagcaatatcataataatcagcagttctcacctcctgggcaagggagcatgaggagcagcacaaccactggaagcaatctgtggcttctgcactgcggcagcagaagttgttcgcaggtaggttaaatctcttcctcatctgtattctccaaaagccaccatacagtaagccgaaaaagcaaagtgcgagaccggtaagccctaatgcttctcgaaggttttcattgttaatattgacagcagccaggttgaagatgaaaaacggagcaaggcaaaagagcataaatgtagcaatatggacatacatgttaccaaatccaagcctctgcatattccatccaaacacacagcaactgcagaaaattgacaggtaggcaagagatatattgtcccagaaatccattagtccaccaacccactcaggcctactctccacaaaacggcgctcttcactttgaatgaaagagtatctcttttcaagtgatgttcgtgaggttgctggcctggtgagttcagtttgtgcttcttggtcaacttcagtcagttctgtgtcataatccttcccaagaggactgataatgttatacaatccagcaaatgccgctgccccgatagcaacggaaatggtcaggccaacaccgataggaggtcgttcagatctgcggtatcctaggttgagaccacataaggcatactgagcaaagcagttcaaattaaggaggaccacaaccaccatcatgtgcatccattcattgggcttgtatgttccatttttgcaatatgtttttctaaggaccaaaacatccttttgctcccatcgacacaacagcacaaagtaatatatccgctttgggtgttgataaaggcacatgagtgtgaataatgcattcaaaatctggttgtttacttcaaaccaggcatctctttgtgatttgctaggcaatgcacgattgagcattccagtcatgacaaggaatagtattgcaccagatacagtaacacaagcaatccaagcaaaaagggccatattaagaggctcttttatccaatccttgcacattacccacagatggccccaattaattttcctgataaactggaagtgctcatgattatcatggctgtcagagtggatggaacgtgagaactcatctcgctcaagtgcaagctgtcgaaacttgaatgaaggcgaaggacccaacttcttaaacctgtcaccactggaaaagcgattacagaaattcagaaacccattccgctgcttcccttgtcgtggaacaccttgagtaggaagagtactggcacctggggctccagtatcattgtccactgttgtcgactctactagttcaacatccgctttaagatcttcattaccattggagaccattctgtcgagccagagtctcagatagtatacgcaagctaaacccctttccaatctatttctagactgatgcaatgttccacagaaaggatcgctgtactataggtttgcaaggacaagcatatgtattattgtccgccaagctctgcgccaaacagaaagagacccataattaagcaaagcgcgccatattggtatcaattttttggacggataactggaatgtaatgcgtaattttacatgctaatgtttgttgctaaattagctgccaatggagaatagccagcagaaagagcaaaatttatcatccatgcaagcattagctactgtgcacgcctcattcgtactaagattatccattgtatgtctggcgcctgaaggttgaaataccaccaaattgggcaccgaaacgtttgtaatttgagccaataaagtgaataaacccccatctatcccaacacacagccatgaccgatt

SEQ ID NO: 78596 - DNA, 8277 bp, Oryza sativa
gccttttggttttaattttttgacagtggtctcggagaatagaccagagtaattctcttttgaagacacattttccctgaccgtgatgcacacggttaatttggaccgtgtcttctccgatcattccttggctagtcttcgttgtctcaggattgctttggaccgtacattgaatcttacttaacctgcgcaacactgcagtgacatatacagacaggtaagttgatcgcttatgaggaaatccagaaaagcgacatgtgtgttcagcaatcagcacacaataatataaagttataaacatatgttgatatatgtcatttgaccacatactaaccctgttgtgatgatatctctctgtctagacagtgtatatattgtcttcagcctccagccagacatattcagtctcacagacgaagtgatggagatagaggacctagaggagagagaactcattggcgatgatgggtcatgatgaatcatgacaactttaggtgattagggagaggactgattaagtgatttgactagtgcacgcatcgtgaagaattttggccgttcgaaaataacgggatttatgacaggcaaatgggggtaatatatatgcccatatctgttgtctaaagtattattgcctcttatgatattagatttttttttcttggttacacagaacgattgaagacatgtacacactatgatcatgttcggataatgagttatgatcatgttttcgcgcagtcattgatcgatgtgagctgcatgagatccccctgcaaaacaggaagttcacttggagtaatgagcgtcgaaaggcaacccttgtcaagcttgaccgttgcttttgcaatgaggaatgggatcttgctttcccccaccatgttctccatgcctttcctacagggccatccgaccattgccctcttgtactgtccaacccgcaaggcccacatcgtccgaggaccttcaagtttgaaaacttttggacacgggtcccggggttcaaggacaaagtcaaggacatctggagccaaccttcttcgcacactgagcctatgcaccacctgaatcaaaagctgcaacgtacggcggtcggccttagagattggacaaaaggcatctgctcagaggctaaattgcaattccatatggcactcaatgtcatccaaagactcgacgtggcacaagagcacagagaactctcccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcagggttaatgcgcgaaggagaaggaatacaatccaaagattgaaaaaggacagtggttgggcggtgacgcacggtgaaaaggaattgacgatccatgatcacttcgcaagcttcatggggaggccggggccgaggccaaacgagctaaactgggagacgttggacatcacaccgattgatctagccacgctgggggaacccttcactgaggaggaggtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgcggttaaggccccacatgcatgagttgatctcggtcaatcaaagcgctttcataaaggggagaagtattcatgacaactacctcttcgtaagaaacatgatcagaagataccaccgcctaagacgggcaatgttgctcttcaagttggatataacaaaagccttcgactccgtgcgatgggattacctactggccttgctgcagcgcaagggcttcccgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagttgggtgcaatttcaaaattacgaggaagaacaactcggctgcggatctcaatgtatgcggatgatgctgtgatcttcattaatcccacccagaacgatgttgcgacttccgcgaacatcctacatcgttttggcacagccacaggactcgtcaccaaccttcagaaatcccaggttgcggccataagatgcggcaatatagacctggaagaggtcctccaggcgttccggcgaagcgagcaaatttcccactaaaatacttgggcctcccgcttgttctcggaaggctgcgaaaaacggacttgcaaccggtcttcgacaaaatatcagggagagttgcaagttggagggggaaaaacatggcagcagccgggagaaccacgcttgtaaagtctgtgctttcagcacagccaatttatctcctcactgccttgaaggtgatgaaggaatccctggagcagcttgacaagcagagacgtcgcttcctttgggctggtacgggggatatcaccggggggaaatgcaaggtcaactgggcaaagacatgcttgccgaccagccaagggggccttggtgtcctaagcttggacaaatttacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacgacgcgcttctgggactccgcatggattaacggccgaagaccaaaagacctaatgccgttggtctatgagatctccaaaaataggaagaaatccctacggcaagggaaagaagacgactcctgggtgcatgacctgaccctcgatgcgggttcatctatcacaatcaacctcctcgatcagctagtccgcctatgggaggcggtacggaatgtgcacttagacagcgaggagccggatcagattgtttggaaattcacaagcagcggccactatacagcttcctcggcttatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggctggcggaataacggacattgccccctatgtcgttgtgacaccgagacagccttgcacctcgtcgccatgtgtagatacacgaagagaatctggcgcctcgttgctacatgggcgggatatcagcagttggaaccggcccaatgggaggaagcccggtcagtccatcagtggtgggagagcctagctaatacacccggcattccaaagaagggccttcggtcccttatcctgctagtagtttgggaaatttggaaggagcgaaaccggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttacccctaggggttgtattttctccttctatattcaatgaaaaagcactactgtgctgttttttccgttcaaaaaaaaagagttatgatggattgaattagaaaatggaaatgaacgaatgggtaagatgaaatgacgtgagatgaatggatggctaggagttaaaaatatcctaaccatcaataagtgatggatgtcggcgatagttccatagcatcagtaataccatgacattcttattttctttttagagctccttcaaggttccccatagaaaataatacttcttccttcaaaattgtaacgcctatatttttacatgatttttaatagcataatttgttcaataagttattcgttattatattcctaacgaatataaaattagtatcatatgaagtatttaaaaatacaaatataatgatataacatatataatacttagcatagatatagctagtatgatcattagtcaaaagctaccaaatttatttttttttaaaaaatagaagcgtcctgtaatttgagtgagacggatggagtatgttggatttttttcttccataaaacaatcccacaaactgtctcaaaatccattggccacaagaaaaacaattcatagatacattctatacatttgatcttaaatacacccgaaaagggacaatattatcctatactgagtagaaaagttttccctaccaactttccctaaaatggtcagcctgtaagttgcctttcttggtggtacatccactaaaagtttgctggatatattaaaaccgtccatgtaaaaaaaaaaaaagctttgtccagtcacagtgatttgcagcgcatctagtaataaagtgagctgtgtattatcctttcctttttggccatatacgtatatacgtacacacaagttgagcttctcaatccaccatgggattactcaaaaagattagaaaaagaaactaatgaaacaaaatatttttcccagaggaaaaaaaaaggcaaatcatcaaatcctactccacatcactagctgtagatttttttctccacttaattaattacgtggcacctaattaatttgttaaactgctgtactagaaacttctggttctggtcccttgttatcatctcctaagttagtcgctggccgctggccggcgcatggcatcgtcgtcgacctcgccggcggcggtagcctcccggcgaagccgcgcgacctcgcgtacagcacggtgcagagcgccgtcccgacggcgcacgtggcgccccagacgaggaaggtgccccggtagcaggcggcgccggcgcagcggctggcgccgcgggcctcccgctggtagaggaacgcggcgaggtagccgaagcagagcgagccgacggggatgttggcgacgagcacgttgtggttcaccccgaagttcttcctcccgaacagctcccccgtcgccgacaccgccaccgacgtgatggcgccggtgcaggtcccgaccaccgccgtgctggtgtacaggaacatgtccctcgggtccagcagcaggaagaacgcccccgccatcggcgccatcagcgccgccatggacgccgtccttgacagcgagtagccactcctgcgcatagtcaaaacccaaaccaaaaattcatcccctgtcaggacatgcataaacaaagactccaacatttaaacaagttgtaaaaaacacgagtgatttgatttgatcggcacatgcatgcatgcatgcagcttggttgcttactttgcggtgtagtaatccaagaaggcgggaaggaggcggccgaagaatccgaaggaggacgacagggagacgagagtggacgggtcgctgagcccgcgggactcggcgatctgccccaggttgttgaggaagaccaaccccagcgtgccactgaacatgtagctcaggaagtagagccagaagtcgagccgccgcagcagccggatgccgccgacctcgtcttggccgccgctctcgccggcggcggcgtcgtcctcctccttgttctccgccgcctcggccacctcgagcaccgacacggccgtctccggcacgtcggtggcggcggcgacgtcgtgcactctgttctcccgcttcgcctcccgtagcttgtccatgctctcccgcaccttgagcgccgccgggatgagcaccgggagggcgagcaggatgtagaggctgatcatgtgctcgctggtcgagagcccgatggacttggagccgatgctgccgacgacggcgcaggctccggtggcgagggtaatcgcgaacatggcgaggaacgccgggtcggtccggcggtggctggtgagctccaccacccggagcgacggcgccgccacgagggtgacgagcatcggcacgacggcattgaggaggaggtacaccttctccttggagtacctcgccgtggcgccccggggcatcttctcggccatggtggtgtagagcttggcgctcaggccgaggtagctcgtcgcgaggctcaccgcgacgcggctgtccgacgggaagttcttgatgcagaggaggtagcacaccgtgttgatccagcagatgccgttgccggcgagggaggtgagcaggaacaggtgccagtacgcgagcccgggcctctccaagaagaggaactggacgccatacccgacaagcccgaacgacgcgccgacgacggcgacgagccacaggggcaggtacagggcggcgacgccggcgaaccagccgaagagcttcccggcgtcggaggcgaaggcgaggaagttgagctgcacctgggagatgcccttcacctccttgagctgcgacgagtacaccgggaagtcggcgttcgggccgttgatggtctggagccagacgcttccgaccaagctcagccaatgagctgaggaaggagaaggcatagctagcgtggatttttcctctctagctacctacagcctctgcctccctctcaccggcgccgctgtacttatgcgagatctcggtggcccggcgataaatgcaggggacgacggcgacggcgacggcgatggctgtggctgcctccgagcaatacgctctattatgtgtggtttcttgttggccattatggctcatggcgagcagcttatatagtgcgagctccgctatggtgttctgaccaaaggagtgtacgtgacaggcacctgacctaacagcagtggtcggtcagggttggcagcgaagaggagatgcaaactttcttgaacatctctgcaattaatctcaggaggggctcgaaactgcaattcagccgttgtcaatcggaagcagctgctgggtgctgtatctttcgtcagaaactggatcgaagagagatgccaggtttctggtacagtaacgtgcagcgtgtgctgctaacctgtagacgctcgtgcagttcatggccgagaaattcagatccgtcagagagaagcggctctgcaagccacgaggttcagacgccggcctagctgagatcgtaaaactacgattttactacgtgttggccgtcggaaatctgatcaaggaacgtgttaggctgcaaggtcgcaacgtagcttgtcatgtcacattgtcaaaacaggcctcatgtcttgaagagaccagcaagaggcggcggcaaaatcttcagtaaatgcagggcacatcataccaaggatattttttttcagtaaataccaggttaatcctcgtgcgtggcagatttttcatggtctctgaagtactgcgtctgaagatttttcagtttgtaccggacggcttaccatttgatgcttctgatgcgaaaggttggacacaatgcgagcatatatacaggttcagatttttggtgcagatttttatcagcctgcgtgtttacatacgtaggccgatcgaactcatctaattctccaatcttcgtatgcaagttctacagataaaactcagttgctgatgatctggataagagatcttttacggggcttgaaaggtaccccaggtacctccttaacgaattgttatccaccgttaatcttcaaagggtaatttaggaacacaaatttttattaacaagggtagcttagtaattgctcaaatcccacccgtcacccaatcaaccaagccgtcgcaccgttgattcaagattaaccctaatcaaccgagccagcgcgtgcgatggcggcgaccggctggcgcgacgggcttgtcggcggtgacggcgaccttctgctgcgtacgtcagctgcgaccggcgggcgctacgggcgcgtgcgtcggcggaggcgacggtgtccagctgctgctttcgtaggcgcgtatggcggcagcgagcggcgggcgtgtgaggcctcggcaagcggcggcgtttacggcagcgacaaccagcagatcatgtaggttcctctcgcacgcgagcgttctaattcttcctctcgtttttttcttcctcctgctgaaaatg

SEQ ID NO: 78597 - DNA, 3484 bp, Oryza sativa
ttttgccctttactgaaaaaaaattaatgaaaaacaattaccattttaccctcccaccttccatacctggcccacccttttaataccttttttcaggtaccttctctttctgtccgttagatcattgcagatcaatggtcctaattaatttcaagtattgaagaagttctctctggataaaggatacgtattaggagttgcgtgtttaaatccatttgatcacctattgtttcagtaatcacaacacagaatcaatcactcgatcaaaaacatttcttacttgggttctgtacttctgttgttactccagttggcaattaggcagcaattctgtgttagctggttaggctggcatgtgtacaatcatattcagataaggaaaaaaaatatatcagagcgggttaggtaagcgtctgtacaatattatgtgcacgcgttcagggtgctctgtttataatccctgatccagagtggttacatttccttcattgacatggtaatttcttcatggtgatacactgatacgacaaaataaacatgtgaaacccgtttgcttgttcatggccacatttgcgggttaccttagttttggtgttcaaattgaaaacccatcatactcggaagagtcaaaatacgtcaatcataaaagggtaaatctatctatctattatattattaaaacagccttgaaaggaggctccacgttcattgtgggggctagaaattccaacattaattagagaaaaagaaaataagagtccaagtagaaatacaactcaaaaattgctgaaattcagaattaaaaataagaaatattgaaagaagtctccatataagaaatcaatacgagattaatcaaaattcgaaataaaaataaaataaaatccgaaattagaaaataaaaggagagtccaagtaggaatataatttaaaaataactgaaactcgtaattaaaaataaggaatattgagataagggtccatataagaacccaatacgagattagttaatatacagaataaaaatataaataaaatccgaaattagcaaaaagaaaagaagagttcaagtaggaatacaatttaaaaacaactgaaattcggaattaaaaataagcaatattgaaagaaaaatccatataagaacccaatacgagattaattaaaattcaaaataaaataataaaataatatccaaaatgaaaaaaattaaaagagttaagtagtaatacaattttgaaaaaactgaaattcaaaaaataaaaattaaaaatattaaaagaacactatacggtattaattacaatgaaaaaaaataaattcataaattataaaaataaaaaaattcaattaggaatacaatttataaataataaaaaatgatgataaaaataaatactattaaaaaaagaccatctaaaacacatgacgagataaattaagtaaaaggcctataaaaaagtagagtgctggcggttgatacgacatataaaagctgttagtaaaacatcaaatagaattctaatgatgattaaaaggagggatgacaagcaggcagtgaagcaaacgagtaaggcggttgccgggacttctagaaagtaagaaaaacaaaccccattgataatcatattcgatttttaaaatctcaatgacaataaaaaggagaagcagcgtgcggggtgtataggagtacagttgcagagccgccgacggttggcaggacttctagaaaataaaaaaatgaattccaacgatagttatgttcgatttttagaatcccaatgataataaagaataggcagcggataggccgtagaggagtatagtagcatcgtttgacgggacttctaaaaaatataaaaaaaagaaacccaacgagacaataaactctaaaaactacaagatccaatttttaaaggttcagaacttctaaaaagtaaaaaaaaattaatgataatcatgtttgattttaaaatctcaatgacaatgaagaaggaaggcagcggtcaggccataaagaagtataatggcaaagccgctgacggtttggcgggacttcatttgtaaaaaaataattatgttcgatttgtaaaatcccaatgacaataaagagaaaagacagtggatgggtcatagaggaatataatggcagcatttgaggggacttctagaaattataaaaataaaacccaacgagataataaacttaaaaagctataagaaacattttttaaagattttaaggagaatgaatagaaatagtggtagaccgagcaaacaaataaagaagaatatgacagaaatatagggtagcagctggtgtgacttttaaaattatataactagaaatacgaggatagctatttaataaatcttaagtaaaatcatactaaaaaatatttgattttgtttaggtgctagccgcacaattgcgcgggccacccaggtagttgttttgatcttagctgcaaaaagagatgaagttcaggttgctctgtactgcatggacatgactcattgtaatgtaggggaattgtggatatagcgagatttattaggtttgtatcacagtatgaaaagcagaaaactacttacacgtgcttgagtagtattcgaagatactcataggggtagagtttgcgtgtgtgtgttcataggggtgagtgtgcatgcgttgtgagtgtctgtgttgtattgtgtaattcttaaaaaaaaagttttactcaagctcttttatacctttgaattttgtttcataggttttcacatttatccctatatacccacatggccacgtttcattagatatccgttatgtttctctaaaataattatattacccctctctcatatatactaatgtgctacttaaaaaatatcaatgttattttttaaaaaaatataataaatcaatagggcataattattttacaccaaatttgaaaaacaaaatttaaattttgaaacaaatatttcaaaagatggttacagccataaacgagtttcactgtgaatgaaaaccccttttttttgttttgggtttaaattttggtgaaaatgttgtatgagtttcatcaaatttattctaaaatttatttaaaatgtatttttggttaatttgtggtcatataataatggaaaattttgcttccgacactcaaattacgtaatttgttggtgaacatcacaaaaaacttactacaggtgaaggacaccacaaccgttaccatattatttcatacctaatgggagacagtgcgttgaaatgacaaatttgtcctcgaagcagcacatattactcggcttgatttggaccaaaccaggccatatctcccttagaacatccccaacagctcatccaaatttaatccttcatatgcctatatagatggccatccaaaaagattcctcctctatatccctactcactccaacagatcatccatattacaccctccctatgttttaataatattttccaacc

SEQ ID NO: 78598 - DNA, 5594 bp, Oryza sativa
ccacgcgtggggagacggcggcggacaaaaggccccgcgcacgccggaggaggaaggcggcgggcgcagagcggcggccacgcgtggggagacggcggcggacaaaaggccccgcgcacgcccccagatctggtaaggctcgctccacaaatcgctgaaaaaaaagcaaaaaaaggggcacggggaactcatctacgccggttggggacgacggcgaggggaaggcacaccggaggggtggtggttgcgaaagtctggatgggggcgggtgcgaaatggcgtgaggagagagatacgctatttttgcctcttctctctcctactatggcgcatccgccaattttggagtgtgggggtagcgcatctgctggagggcatttttttcacccatatacgccaataccgggatggaggattggttagagtatctgctgggcatgctcttaaccccctccaaaaccctagagcagcagcaactggtacattttgcaacttttccaaaataaaaaataaaaaatctgaattttttaaaaataatttctagattttcagaaaaatctaaattttcatatacattttctggtagattttcaaactacacatcatgcaactctcaatctatcctcccccaaagtacactgctaccatacatcatattcttttcttttctccagcgtagcttataattttgtggcctgaggggaattcttgtctttttgaaaaaaaaatcccttcgattggatctaaaatattaaaacaatgagtgtggtgtcgttcagtaaattaccattctgtaggtgtcctctagtcatcgcacgtttttggatgtccacatgtaaattaaataaacattgactatcatgtagcaacatttgcctataattatatcccatcaatttttggaaatgaactttttatgttgagcattctgtttttcttaccatgatgtctcactctcttgtgtacctctattttggtttgatcccttctaaatttgtggagtatattgttggatgtgttgcagtttgttgtatgagacagttatatttacgagtgtcattatgtgaggtattatcacgacaaaaaattttttagacgataataaagtatatttctatttattaaaaagcatatgtatcatatttttgtgacagtagcacaaaagatttgacacattttgtatatattatctaaaaatgctactatacaagacgaattgtcatgtttatcctttaaaaaatgctaaatatatttctttaaatatatgttagattttctgcatttaatactttctcacacaataaacttatgaatattatagttatgcaataaattacttacttccaacggtagatttcataaataacttaggctattcccaacccaagacactagacatagtttctataaactccacattatcaagaattatcaagaaactagtactagacactattcttccaatgcaaacaccactatttcatacttaaatttaatgctacttatctcatatgatgtcttggatgttgtgtagaaaccatgtctcatgcaagacatgtcttatgcaagacatgatttccttctctttcctcatgtattcacttgccacatcatttttcattctagttggcatattatttaatgggagcgtatcctatgtacacagaccttcgcgtgtacacaccatgtacaccaactaaaaattatcacaaaaaattctaggataattcatacatgtactttcaatagtattacatctacgtgcaaagtcgcatcttcaaattcattctacatagagaataacaaaaaagataaaattctgacaaaattacaaccttaaaactgtcagattttttgtttttttgttacggctaaaatataatgaatttgacgttaagattttaaccctaggtgtaatacaattgaaagtatgtgtatgattttttctagattttttggtgacattttttagttggtgtgcacgtgtgtacacatgagggcctgtgtgcataggatatgttgccttatttaatgctgtagacatcatcctagtcattgggttgggaatggccttacatgcccaatggtaaaactaacttttcttatacattaaatggtcaactgatgaaatgagcatggaaggaattaaattaatatttaagggacatgacactaagggagtaaataaaactcaacgccatggaagggattggctaaattgttaggggcatacaagaaattatctacaaaaaatgatcaaaataaaggggataaaaaaagtaaaatttaagtacatagaaggattaccgcgtaaggaatttttttcgataaatatgatgggtcgactgattggttaacttacctgtccttggatgagtggtctgctgatacagtgcggttcaataacataataaataagttataggtttatgaaatacaacccatgtatcaaaataaaaggttattagcattggcacccatataggcctcaacatctaaatatataagtactatttttgtatttaaatatataaaattgttgactttagtctatcttttattgtttgaaggggagactttactttgtctttgatgcgcaagtttaagcactatttttctattagaatatagtgatagtatccaacaaaattataatattgcaaacgtacttaaaacgaaaaatctataaaacctactcatattatttttatgttttcaaactaaagagagctattgatgaggggaatttcagaagtttaaccaaataagttaacataatcatatatttaatatggagggagtatgccactatatgtatacaacatcatatattgtgtcttcagtaacctataccaacagattaatgacatgtcaacagctgcatgctctagctataattaatcgatgtaatgaccacgcatgcaaaatattgctcctgtaaattaaaagggtgtaaacgagttataaaattagccggtagagaaggagccatcacatcaatgaccccaaacaatgatcaccagcctggatctcctagttattagaaacgcaccagcacaccgccatcaactaactccacctccgaacttaatactcgctccgtatattttaatgtatgacgctgttgacatttttaataaacgtttgacatttctgcttatttaaaaaatttatgaaattatcatttatttatttgtgacttgatttatcatcaaatgttctttaaacatgacataagtatttttgtatttgcataaaaaattaaataaaataaatggttagacgttggttaaaaagtcaacgacgtcataaattaaaatacggacggactacgtttttgattcaccgggtaggtaaacattattgcatttctgccatgcatggaagttcaggacggtgtgtttcgtgagccgggtgtttcctctgcccaaagtagagggccctgcaatgcaaagcaagagtcaacgcggcgcactgctcgctggggatgcggcttcctgtcccgatacctgttcccttccctgttcctggcgacgtgtcaccttcttattcgctgggttttttctggtgggtcagtacgcatgcgctcctctttcacttaaacggcgtcatcgtcccatgttatactatcacaattaaattggaaacaacgcaatttaagcgctaacaaaaatatgacgccaagcaaataaaattagtggcgggaaaaaggattagagcggtacataagtacaaatacacagttgttttattttcatctacacagattgcgtctccacactaacaagaactctcccaaatcttggcaccatgatgaactcccgattcctgaaccaatgccatcacaattgcagaatacaggaacatgcggtacgttcgcattcttggatgatacttctgcccccatcatcatcatcatcatcatcatcaaatcctgctgagtccacagatccctctgatggcctgagaagaaatcaattagaagctgtaagatccctatctattctcctttacattttgttaaattagttgcatctaaactgtaagatccggacatgtgcacgtgcatatgaacaactatattcatcgttcctttttttttttttgcaattttttgatggaaactattaccacggataaaattaggatgaaggaacaaatgaagctgctcatacaacaaaatatctggaagacttggtgccaaagattggcatgaaatttagctctgaacaagaagcttatgatttctacaatgcttatgctcttaagaaaggtttcagcattagaagaagcagctatcattacattggaaatactaaaattataaaaaacatgacattttgttgttctcgtcaaggtaaattctttgtttctttttatagttacattaactttcaattagagacattttgtttcaattagtgcactgtattaacaggaagtagaggtattgacaaaagagcagaagcttcaggctatggcgatagttttagtaagccagaaactcgatgcaaatgccaagcatgtatgaagataagtctcatagatggattctattctatctatcactttgtgcctgaacataaccataatcttgccactagaagtcaggctcatcagttaagatcacaaaggaagataaatgaagctcaagttgcaagcattgaagtcgcaaaatccatagggatttctactaaagcagctattgatttgatggcaaaacaagcttgtggatttgagaatctcgggtttactcgtgttgacataaagaataaattatactccaagaggtcactacaaaccaaacaaggtgatactgggggagtgttagaatatatggagaagaaagcatcagaagatgtcaagtttttttattctattcaggttgatgaggatgacttaattacaaacattttctgggctgactctaaaatggttgccgactatgaagattttggtgatgttgtatgctttgacacaacatatagaaagttggatgacggacgcccttttggtttgcttgtaggagtgaataatcataagaagactactatttttggtgctgctcttctatatgatgagaccgctaatagttttgtctggttatttaaaacttttctaaatgtcatgtcaggaaagaagccaaaaacaattttgacagatgaagatgcagctatggctaaagcaattaaaatagttcttccataaactcatcatcggatatgtgtatggcacatgaatcagaatgcctgcaagcaccttgctgggtgtgttaaggactataagaaatttaatgctgactttcagaactgcatatatgatcaggaagaggaagaagaatttttacgtgcatggggccaattgcttgaaaaatataagctccagcaaaatacatggttgcaacggatttttaagaaaagggagcaatgggcattagtatatggccggaacacgttttctgcggatatgagtaccacccaaagaaatgaaagcctgaataatgaattaaagggttatattagtgtgaagtatgacatgcttactttttttgagcactttgacagattgggggagataaaagatatgaagaggta

SEQ ID NO: 78599 - DNA, 16104 bp, Oryza sativa
  unsure (1)..(16104): unsure at all n locations
tcgaacaatgggcgttcgacaggccgatttaaagcccggtccactcaggccaggagttcgatttgtgaccacatcgccagccaccgccgagagtcgccacatcgtcgccgtgagcgccggagggagcgaggggaggggatagcaggcctgagaggaggccgaggaggcgccgtccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacagttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtaatagcggggtggatttgactgtatatgccttccatgatactagtctgaatgcaccggagcatatgggtttgaacgacgtgttagggtggttgtataatatgtttggggtagatccagtgcacataaatttgtcataaatgccgtgtggccagtgaggggtcaacatggatggcagtggagagtagtggaggttgcgtcatttgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgagggcaagaagtagtagagggtaatacacaagaagaggtcattgttcatggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactagtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttctcccctttcaccataatgcatgacgttgagaaagagtacggatatgagatatcgtacgacaaggcttggagggcaaaacagaaagcattggagatgaggtttggaacttatgaggattcttatcacaattttcacccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgtggcacattaaaatgtgtgttgttgaaaacagaccaaatgtgtgtgttctgcatgaccgacacaccggtttgctatcagcgatacagaagcttcaagaagatgtcacacagtccgttccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctataattgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccattgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcacctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcatgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagatgatgagtacggttcggcgtcgacgcatcacggaatgcctgcttactcccctcgcacagcattcattgaggacttcttttccactgatcctccccagggggaagtagcgatggattactggcacgcagcacctcaggtcacacagccgacacaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacattttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcaaaaccctaaatcatatacatataacattacaaaaatattttcctttcttacacactaaaataaattacatattattaaaaaaaataacttattacaaataaatggagaacacgaccctgtcgaactgcgccagttcgacggatatcctgtcgaacaggggcagttcgacagctgcctgtcgaacgggggcagttcgacagccctgcctgtcgaacgggggcagttcgacagccctgcctgtcgaacgggggttgttcgacaggtcctgtcgaacggcagccttccgatctcctcgccagtcgcgctctggccgttcgataggcgccctatcgaactgcacccgttcgacagggacctactttcgcgattttccccggttgaccactacttttgcgattttccataaaaataatattaattctcaaaaaaattcccgggacatcggctagctgcaagggttgggaaaccgagccaaccgaagtgggtcgcctttgcccgtttcgccatggcgtcgtgtgtgttcccaaccgccggtgcatgcatggggcatatgcccttttccagttagctcgcgttactagacacacccatgagtgaacgcacgcacgcacccacgaggtgcgcgtgctgattgcgccgtggactgcacgcctgcacggaggaatctactccgtccaagtccaatctaatccgccgggaggaatcaggaatggagtacgtgatcaatagtggtctgtgctgtgccgtgcgtgcaccggtggtggtggcgcaatgcacatcaggaggagggacacgacgaccgtggttgcggcaaaggtgaattcaccgtcacccgtgtccccgtcaccgtggtgaaaaaatttcaccgtccctgtccccgttcccgtcaaccacgacgggctacaatttcttcagccccgattaccacgtggtgaatttttccccttggtgaacccggttaaacaacaaattcatcaacaaatcatataaatgcaatggaacacaaatcagcagtacaccacattgatatttttccaaaataatatactcaacaaactgctggtcatatcgacggcgacgaacggcggaggaatccatggcggcggatggcgtgctggccggaggcggagggtgccgcgaccatggtctgaggcggcgagcgcgcggcgacgacggccggaggcgccggtcggcgcgatgacgtccggacgcggcgagcgcgcatcgacgacggtcggaggcggcgagtatgtgtcgacgacggccggaggcgccggtcggcgtgacgatggcaggaggcaatgggcggcgcaacgacggccggcggcggcacgcgtgcatcgacggctgggggtaggatcgcactcgcgcgaggggagacggcggccagcggcgctatgcatggtgccgtggtggctggggagaaatttggagatggggagggttgattagggttagaagatatatacatggttactaggcttcatttttatgggccaaaataactataaagtctagaactggactctagctacattacatgcgggtcaccgcgggggacggggatggtgaatggtgcaccgtccccacccccaccatccccgatggtgatgagttttggaccattagattcaccatgggtggtagatatcaaccatccccatcctctaatatgtgaattcatcgtggggaatcggtgatcgggtccccattgccgcgattctttgggggcggtgcgagacatgccaagcccagtcgaaacgatgagaggctctcgggctctcggcacgcgacggcccagctaatagtcgtctggtcggtccggcgcgggggacacgagcacggggccgggagcctgcttttttgctcaaccgcgcgcgtgccgagtcgcgcgttgcctgccttggtgagcggcccacgcggacaatgggaggcgtcagcgtggcccgtgcacctgccgtgtgcgtgtgtgagtgtcgcggatcgccaaggagacgtgagaggcggctttgattttaggcccacgagaaggcaaatgtcttggccggactaatgagatatacaccgctacacgcgactacgccgttggttcgtagccgcacagctggttcgggtagttcgctgctcccagcctccagccagccagcgtgtcatcggccgcatcgggtccagacaaacgagcgagccatcaatctccatcgagagattcctcgcacaagtcatgcatgacatcagctaatctgtctccctttccacccccctctactcgtgtgtcagtgccagatcgccggctggcagtacattcagtaagacgcgacttgatcgcacgattggccctttccttccaaacaagagagtgtacgaagcggttttccaacacaagaagagatttcacgcatcatccggtgaagctccggttactccccagttcacgacttcaagatttccaaaagtttggtactatatctaattttgaggaaacatgatgcatgtctcgtaaagaattcatatggatcggtgcctcttcatattttggcgcacatttatcactttcaaaacttgaataattaaagattaactgatgatcaaaacttaaccctattgattgcatgtattctaaaacatcgcttatttatggtaggcgaagtataaaaacgtaacccatctaagatggccgacagatcgacggacctgctgagcaaacttaagctgagttcataagcgaggattaggaatcctccttcccaacatgtaaaatagagcagtagattaacgtatgattaatgaagtattagctaaaaaacttcaaaatggattaatatgattttttttaaaaaaacaacttttctatagattttttttcaaaatacgcaccgcttaacagcttaaaaatcatgtacacataaaacgagggatagaagttgggaaagtgtaaaaaaacacaaccttaggttgagttcgttccttatgctcccaactccactctgttgattcccgtgcgcatgctttcctaactaatactgaattaattatgggctaatatgccatttcgtttttcttgcgtgggggattagttcttagcccacaataaagaaaccttaacctatctatgggaggtcgaccatctttccttgtggtccaccacctaccccaagtagccggcttgccatcgttgttgatgcaccagatctgccacctctctttttccccgagcttgctccatctccccttgtgtcatctagtagcacgtctgtcactgtctcctcctctgtgcacctcctccttaacttgcttcgccattcgctgttgagctccctcaaatgcctcccctcggtggcgttaagcaacatggccaccaatgtaaactcccgatgtagtcatgctcactctaacacttgctagtgagctctctcagccacctccaccttgtgccgaggctttctcatacttggccaagcttcgtcaaccacccacaccacacaccacctcacatgacatagccagtggtatgggcaatggatggggtagatggataggggagatcataagagtgggtaaagaagaagggaaagagaggatggcatgtgggacccattggagaagcagtaggagtcagaaggaaatatggatatcgactttttctagccatatgaatatttggagtgccaaaaatagtcagaatgctcttagacaagaaatgatgaaatatatgcattgggggtactatgacgatgttcaaaacaataaagtactacatcagtttcgaaatgtagctttttctagcacaatagtatgtcgaaaaagaagttatttctccactcacctttcatataaaccattcacaaccattcttcatttaatttatctatttactttttcttctcaatcaatcccaaatttccccaatcatttctacctattttttttaacatatatgtccgatttaagaaaattcttatattttgggacggatttattaaaaaagaacggggtagtattttgaaaggtttatgacctagaaactctgccaaacaaacatattgttttcactgcatagaattttacaactagaatttagtattcccatgcatcggaatcactactacaaaaatcgtttttctgtacgaggaggtcggtaggttccatgcgggccgcttgtggtggcgcctgcaaaaaccaccccccgggggcgggttgatttgccgcatgcgaagatccattatcgcatgcggctgcttaagacagccgcatgcgataataggtctattttcgcatgcggccgtcttaaggggccgcatgtattagggcatgcggctccttatatggaccgcatgcgaagatctattttcgcatgcggccgtcttaagtgaccgcatgcgaagatcgatcttcgcatgcggctgcgacggccgcatgcgcaaatggtgatatttgcagaccatttcgcgcatgcgggccggccaaccgcatgtgaagatcgattccgcccgtatgcaaaaacgctttctgtagtagtgaatgctgatcagtactgaagaagaagttgagaagttccaacgcccaactgtcttgtgaagttgaataatttctgctgacattgaaatggatacgctggacggctggaggtgttcaggttcaccaacctcactctaagattcttaggtacaatagcaagctataagccagctataaacatattttaaaaaaataaaggaagagagaaaagagcagcgggctacagatctatagccagctgtagcacggactccaagacgtaatgtgtgtatgacaggtgggaccaggtattaatagtatagtaagcaactattgtatgaattagcaattacatcggctatagattatttgaagctagcagtgtgctatactattaaacttgctctaaaccaacggtagaagagccagtggcaaagcacgggacaaccggacaattaagttgttggttatcgatgcctcgcataaataatcacaatacacgtcatcacttacgtttcacgcacgaccaacttgactgtagcaagctactccttgctaggacaagcggacacatcagctcgattggatcgggagggtgactcgcaccagtttaatttgcctctggacaagccaagcacgccgtctctgatcgctatctgctaatttagtcactacagcaagcaagctagtgactgacgaaacgcagaaaaccttatcaaaattatctcccaaagctaatgtacatgcagaggtgaactgagctatcttgagcaagagatccccggccgtgcagtcgtgatctatcaacatgtaaatatttggaactgaataaaataagattcggagaggagaaatggagggagaaatgcaggagaggtagatagaagttcagtttaatttggtgacgatcatcgcgtcgccatctcgacatcgtacaagctcaatcagtgatttaagatcgtcgaaatactcgaatgcatcaaccaaccaaccaacaacaataccagctggttagtagtacttcactagtactagcattgataaatatataattaaggttcatatcagatgattaagcagcgtagtgtttcccttaaaaatgattactgaagtgagttctttaacatcgtcttcagaaggtgcttacagagaaccaacaaccttgactgcaggagacaacaccatcgccggccgtcgtagtcaggattgccccacgacgaggtgtccggggacctcaatcagtcgatccatcaatctccatgataaggcaataggataagcagccaatagacgtttccagaaaggagcaaatggcacactcagccaatgttttaagtactgaaactctcaaagcttacataaatgaaaaggcagttttttttttggtgaaaagaggataaatgaaaaggcagtactatctgacgatgaatcgatgataactccctgaactgaaaggttaactcagtgattaatttagttgtgttttcctatcagacatgaaaagatggcgacctactatgctataaagaacatcgttactacatgatacctacatgatacagcacatctctcttgcaaaggtaaacaagttgtcttttcgtcatgaacagcaatgggttgttcattcgactgatcggacttcgttgggagcagtttcttgacctgcgacacagttagccagttttgtagctagctggagcagaagttcagaacagttcattttgtttccttttttccccccttcttcttcatttgcgattaagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctcagtggcatcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggggggcgccgccgcgcccgcgccggagaatgccttcgccgccgccccgaagatgccgncgttcgactacacgccgccgccgtacgacgggccgcgggcggaggagatcttccggtagcgggccgagttcctcagcccctgcctggtgcacttctacgaccgccctgtacgttacgccacgatcttttcaccgctcccatttctttggaacgatttggggggaaaacactgtagtattacagatcggattcttgattgtttataccttaaattagaaagaaatactgcaattttgtctctataacaagacgcatttttccattttacatccaaatgctgccacaaatgcatcggcgttcggcgatgttcagagatgatcaggctcgtagcttaaacaaatctccttaatttgtttgcaaaggcggttgttttctctgtttttttatgatctcttgctggtggcttattagtgtatcttgttacaagaaaaggcagcccttttgaaagtgcaacgtctttttctgtcgctattggataggtttggttggaatgccattttacctgttcttacttcttactctgagcatttcttacttcttaccgtttggagtgggcttaccgccacccgcggtttggcagttatcgcgattatcacaaggtatcccgtggttttaaaaactgaaaagattaccgtatactgtttggtaaacctcacaagatgctctgcagaatctccaagatagtcgtactactaattgtagtatggggaattgtgaatctagtacaaaaatgtagttgtcttttctctttcccataacatagatgttctgttctgcttagtaaaaacgtcagcctctatgttcttgtctgcaaatatgcatagttaagaagaaataatttttttttatcttgtgaatagtagtaggtcagtttgctcaactacgtcttgtgctagtagtctgctagatctcaaacatatgtggctgcgccaataacatatgcatatgtctctctctaaaatagcttcataactgacacctttccattttaaaattgcacatgcattgccaagtactctataaacaatgttaaagattggattcctgaaggaggatatagcaccaaccaaactgtgcacctaacattgtgtcttgctgactcctctcatcactggagatcatgcacattgctaaactcctcgtgaaccatctgaaaaatactttttgacagggacgtttatctggttgataaaattggtaggaagaaaaagaaaacaacaatagctctttgagatcaccttgaattctttagaagagggttattaaaaattttctaaaaagggaaaattctcgttctaaaacatatcaatatgtgataaagatatggtttttggagatttcaagttccaaaaactgaccatttagtatgtaacaaacatttcagttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggtagcttgagaaaactggactttctctatccgaatattgctaattgtttagaaatacatgaagattgttttgcctgttgaaagctttacctgaatctgttcctttcttttcaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcaggcaagtgttggtcctgttttcgcttacagcattaggtattgagtaaacacgcaggacttaaaactgcgacttttgttgtttcaaaaaaaaaaaaactgcgactattacatgtaaatcattgaaactaatgattattcatttataatttgttcagacgggagtgcaccatgcacttaatccagacccatatagaggtgctttcggttctgatggcgaaaagtatgcccgagatgttcaggaaatcattgattttggaactacaggaagggtcggtggtttcatttcggaagccatacaggtacatatatcaatctcaatgcattatcatacaatggccatcttatttgtcatttcgatcaacagtgatttcttatcattctgaaaacgagttctttttcctcctccagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaaggtgaatcttgaggatccttccataacattcagagtttcagactcaattcatccctcctttgacgaatacaatctttgggaaactcacatgttccttctcttcatcttcagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacagtgagtatcagtaactaagataaaatcagtaaaatcacgttgcaaccacatggatccagggtagatttgttccttacattttggcttgtatggatggattttccagtcattggtgatgttagagggaaaggcttccttcttggggttgagctggtgaccgatcgccagaagaagacaccggccaaagttgagatcggtcatgtcatgaaccacatgaaaggtactactgatcctctcagcctcttccagttttgttactgaaagatctcaccatgagtgatttctgaactttcttctttgacacagacatgggtgtgctggttgggaaaggtggtttctacgggaacgtgttcagagtaacacctccactatgcttcaccaaagaggactccggtaagacctgctactctgctgctgataaattgtcaatacatgtttcagtaatttctgatccatgactgtaacatggtttgatgaacaacgtatcttgctgcatgcagatttcttcattgaggcgatggacatttcactatcgaagctgtgagtcggagagggactggcaggatcaacctgtccgcatgtgatccgtatccataaataatgttggggattggtgagatagcacctcgttgtctcgtaatatgtcctgcaaacccaccatgcgctgctcaacacatggtccaataggcgctcctccggtctctaatcagatgtgttgtgactcgtgaccaataagcgcatgtcaatgtcagatgtattgttatagttattgtttacatgctgaacgacaaaacgaaccaatcacaatgcccaggcgatgtaaatgttgaaaaaaagttatattggcaaatgtcagtgatttcgcaatgatgttgtgcaaaagttgtttcag

SEQ ID NO: 78600 - DNA, 8550 bp, Oryza sativa
  unsure (1)..(8550): unsure at all n locations
tacatctgatctcaaatcacgattccttgactggctaaaagttaactgaaacatacggacatgccaccctaagctgaggttaacatgcaaaagtcgtccggttggcgccttacacccccttctagttctcataatatgtaatcgctaccggaggcggaaaacaatccatggctacatactggaggctacttcccaaaatccatctcaatttaacctcaatcaggtagcaacagcgcgaaatcgatcgaaacattgaccagcacacgccgaaccaatcgagtcaacgctccctcctaaaaccaatttcgacgaggacagcagagccgcgacagaaatcagaaaagctaaacagacaaaattccccgttccccaccgcaaaagctcagctccaagcccccgcagcacaacaatccatccccgcacaaaccacggcggcggcggcggcgcgagctagcacggcgagaggagaggagaggggggaaggaggaggaggcgagcgagcgagcgagcgatcggtcaccagcggtcggcgttgagggtgtcgcatatctcgaggttgatggcccagtcggggccctgcagcaggtggctcgtcgccttgtccacccgcgtcgacgccggcagcctcgccgcgcggcggccccgtcaccaccgggtacatcccgctcgcctccgccgccgcagccgccgccgcctcgggttggggggttcggctcgggtgtcgtacgcgatacggagctcgagaaattcttcgatttttcgccttccttttacgaggagggcaggtggactccggaatcgcgaggagcaaagcgaggaggagacgggattggttcgttcggtttctggtgcgtttaatgcacatcggattattggcaatcaggtggatgacgggtgggcccggggcccacctggcggcgggccatgtttagccggtagggggaagaaatcgggggatggtgttgtgtggaatgttttgggtttaagcggttttggtccaaggggttatctatccattgacgacagtttagtagtcgtacttgcaagttgcaaatcctgttttctcggcttgtctcgcagaggctgattttgtcatttttggaaggaggagacgtctagattgtttcagatgatgaccaatagaaaaaatgtgttattgttgatctttttatggttttatttattacagaagaagggcatggaataatagtatacacgtttctcgagcttttaaataataatatgtatttttaataaaaactttctacatatgatttttctttatatttatttttaagcattataatatcaaattattttgtttacaccctcaaatggagtaattatttaaaaatcattataattattcaacgtaaaagaggataaccatatactcactccgtcccgtaaaaaatcaatctagtactggatgtgatacgttctaatattataaatctggacatatctctgtccaaattatagtgctagatatatgtcacatcctattttagatttgtttttttatgggacagaggaaatatgtgcttatgattgaacaaaggaattatataataccatgacattataatttttttatttaacattcttatggttaaaagggagtttagctttatgcaaatggttttcaagttttagattaaataaatatagttttgaagtttatcattaattttcagtttttccacaaagccattttttgtagcaaaatagattaatttcgtccatggaaataatccccttatatatatccctaacctccttacgtttgcacgtacctgtactgtatacgcatcattattatttattacatagtaatataaagaaagggaaacttattctggccttaatctatttgggcggcacgtaaccagacctttcgagctttccgacagcaagggccagctagaaggattcgccaagtattcatgtcccatcgccgctaatcaacgaggctttttagctttgatcatactataagtataacataaagagattaaattccacataactggaaaccaaagcgtcgtaacagttaaattaagaactacacgtatagaacgatttttgcttatcatgttgcgtgtctaggccaaaactgtgacccagcaacacaagaaaaaagaataaaaataagttattgtaggtttaaaaatttagatagaaatattaaagaaaaacaaaatgaaatgcatggtagttagtattttttaaaaaaaaatggtagtcagtagtatgattgaactcgtagcttcctaaagttttacttttgaaaaatggcgcgaagcatctgccgtcacgccttatcctttccaactgattatcaatttaactaataactactagtaaactactatcgcatatttgactaatccaataaataatcaaatcggattggcggcttgtccccgttggttgcttggtgaggagaacgaggcgcatgggagaagagaacaaaaacgttgacttgaaaatgcgagtctcgcgagtcgcgagtaagaaagcgaaatttacacgagctagatgcatgggtccacgtcatcgatccggacatgtattttccacctgtgccgtgtctcgccgccaaagctgaacgaacgatatatgaaaaatatgcatcgtgttctacttccgatcgcactttccaggtcagtcatgatcaaggacagcatctcctgggtgggaactaatctctgtagcatataaaacggaacaactcattagcacataattagttgagggcctgtttagatccttcaaaatggtaaaagttttaccattttgaaacactttttgccattttggataacactagtagcaaaagttggtaatttggtatttaccatttgctagcccagggtagcaaattgtgccaaaaagtgctccaagaccacgcgcgcatgctctctatctccaccaaaaagtgctaaaaagaaaaactttaggatgcatctaaacaccaactccataccaaatcttttaccaccaaaacttttgctatttgccattacaaatagatctaaacaggccagtattagctattcttttgaaaaataaattaatataatttttaaaataactttcgtatattttttttttgaaaaaaatgtatcttttattagtttgggaagtatacgcaaaaaaaaaaaagagttgagctggaaaagccaacgaaagaatacaaccttaataagactccactctactttaaaagataatttttacatacgatccttcaaatttctacggggagctttaaaaaaaggaaaaagtacgaattacacctctaaactattgtggtcgtccgaattacccccataaccacaaaaacggacattcttcaccccccaactatataaaccggacgaattacccccctcgatccaatccgcggtggttttggtctacgtggcgtacgcgttacagtccaatcagtattctatttataaaaaaatatgggacccacctgtcttcctctctctctcacacactttctctctcttctctctctcactctctctcacttttcctctctctcacacaggtcggcggcggcgggtgactagcctcgtcctggagcgctactgcgtgctgccgcacgcgccgcaagcgcggatgtggggtcggtggagcagagcagggagacgagccgagggaactcgccgcgcgcgtctgcgtcggcttcgacctgaacatgcctttaatattactccagctctgtttcacctgcttgcttggaagcaatccctgcaccctgcttctgcatcagatcaccgactgttcacgcagctaactgatgctgagtgctgctgctgcttgtgtcgtcctcggacaggaagcaatgcgaccttgccgccggagcagggaaaggagaaggcgtcggctccagctccaggcagagcatctcggactggagcacggcgcagtagtggccgaacgtctccggcggcacgttcaggtcgaaaccgatgccgagcgggctgcggatggcggccacgaacccattcagcgcgcgcagcggcgccggcgaggcggacgcggacgcgaccagcgcgccgacggcgcgccccatcagcaccggcccgacgagcacgtcctcgttgaaagcggaccagcgctagcacgcgccgcagcgcgcccgactacctcccccgcacccgccttcgccgcgaggtccgctcggcgcgctacgacgctggccgcgcgcggtggctcgtcgacgccgtcgacctcgccacgggacgcacggagcggtacgcggcgaggcacctcgtcgccgccgcgggcgaaaacgacgagagggtggtggccgggatggacacgttccccgggaaggtcgtccactccgccgactaccgttcagncggcgcgttcaaggggaagttcgtgctcgtcgtcggaccgtacgttgcacgcgcgccgacgacagccgcacgccgaccgcagtgcgcgctttgtgcctgagagagagagagatagagagagagagggaggaggggaggaggaggtatgaccgcctctccgccatggccgccgccgcagcctgagcgtcgtcctcatcgtcgtccaccactccttcgtcaacatcctcgtcgtcctcctcctcatcccccgccgccgcctccgcgtcacccactgccgccgccgccgccgctccgtgtcccccgccgccgccgacctgtgagtgagagagagggggaagagagacagagagtgagagagagaagagagaggaagagtgagagagaggaagacatgtgggtcctacagttttttaataaatagaatgctaattggactgccacgcgtacgccacgtagaccaaaactaccgcggattaagttaaggggggtaattcgtccggtttgcatagttgggagtgaagaatgtccagctttgtggttcaggggggtaattcgaacgaccgcgatagtttgagggtgtaattcgtactttttccttataaaaatctgcaagtaaaaaatgtatccttttctcggtaaaggtccattagtgaattttttttgatagatccatctgcaaaacaatattattttttataggcaggtctattaagagattttttttttaacattctattaagagatctgcatatgaattttcgcagcctcctgactacacatcaaacgtaaagctctcaatactcccctccctaatcttcctctcctcgctctccctctctaacataagacgagcgcttccctgtccgacgaccggtgactggagtccaccgccggaggcctccggatcgaggagcgcgtggccggcgggcgacgggtggatcttttttacccgttactccttttactgtttgagagaaaaaaaatggagtaataatcaaaatcaagcaggggcgccgagatccatccatccatgtctacccgaaatgtattaatcgcacagttgcagtgtcatcgtcgtgaaagccatagtacgtcgatcgcactgtatacggccggagcgcacgtacgtaactacagtatgtacggttttcttgtccttcttttttctactacgacaagatcgcgagctgacgcgagtgcgtgacatgtgcagtacgtgtgcgccagcagagcgctgcatcgcgcgggcagagcaagcgcatgtgttcatgtctagcatcggccggcacgcagcagagacgtacgtacgtcgttcggtacgcgtatgtactccctccggaaaaaaataactctatcaaatactccctccgtattttaatgtatgacgcggttaactttttaaccaatgtttgactattcattttattcaattttttttgtaaatatgaaaatatttatgtcatgcttaaagaacatttaataatgaagtgacaataaaagaaatgataattacataaattttttaataagacgaatggtcaaatgttgaataaaaagttaacggcgtcatacattaaaatatagaagtagtacaacgaactcaacatactttatctgtaaactcgttatgctagaattcacattctaacatgaggttggttttttttatggaggaattactctatctactcccttagctagggtcacgactcacgaatacgtgaggttaacttagaacaagatttgatctcagatttttttttaagttttggtcattggttatttcatgcgtgttgtatgtgtttcaatacaaattaatgatagaaatctaaaattgatcaaacttaccctaaacgttgaatatttattggagagtgtggtccatgagtagtggcggtggttctgccaccactccgaccaacttcctattttgttaagaggaaaataaataggtgaggctagagggccttcatgtaaaccatccccatcaactctttactttttgtgagaaggtaaaataacagtatgactaaaggattcacatgtcagtaaaaaaaatctagcaattaaaaatagtatatcgggttaatgatattcttttaattaaaattcggttgcaaacgcatggggaattaatatgctagttgtgcaaacatgtatatactccctctatcccataaaaaaacaatctatgatagaatgtgacgtttcttagtacaataaatttgaacatgcccttgtttagatttattgtactagaaaatgtcatatcccattctaagttagtttaaaatataaatctagtgatataacatgcataatacttagcatagatatcttagtatgattattagttaaataagggtgccctataatttaggacagagggagtactttatatgtatattacattttgataacattaataatagcacttatataaggtataattataattgaaatgtgtgatggtaaagtggtacacatcatttttttttcatgggaattttgctcggattcaagcgtggaattataaattttcactcacctagaattgcacattgcaaagcctaaaatgtaacatgcaattttagttcattgttacttcatttttgttgttatatatgtggttttaattttatttttatctaagctcgatttttttgcatgcaagtttataatttttatgagctacaaacttatttcatgtaattttgtagattttttgtatgtgagatatttcattgtagaagcattggagagtggtaatcaataagtagggggatggcgagagccgtagaattaccattgattcaatggttagaaaaggtgacttaaattttcaaaaacttcaagctagcgtcttattaaatctagaaactctctttaacatgtcatcacaataaacaaatggtcaacattaagtaacactggtacgcttgctaaatttagaatgaaatattttaaataccaataaatatcacctactattaactttagatcttaccactatagtgttacaaatttacaatcagtagttgaaggtatcaacgttaaaacgctcttttggtgtatatatatgcgccgtgcttttaaataccactgtcagctagtagtatataggagtatagtgtattggtgttgctcttctggtttcgcacaatcatgcatacatcttcagtgccagacacgttctttgtgcttttcaccagagaaagacgagagagcatcataagaaagatttactacttgtagttagcttacgcattattgcatgcgtacggtcaaaaggcgtgtgtccaaggaacttgtcatttctagctatctcagcaagtgcagaagctctagctcgcatatgcatttcagcgatgctactcatctggcgactgaacaagccaaaagagaaccccaatgcaaacaacttattagattaattactcacatccatctgccaggtccaaattcagaagtttgtgtacatacatgtgtcgaggacatatattgcataaagtataatttgaaaaggtgtactccaagcgttgtacacaacaatttaactagcttatatttagcttacgctttgtaattttgctttattatagtttttttgtaatgcaaaaaatttgtctgaagttaagtagagggacgatgtaagaataacacacattcatcatccttattgaccgcgctcaactaatcgaaggcaaaacaaatagtattaattaattaatttgctttcgaaaattaaagatccaaaatcctattatgtgcgtacatgtagccatgtactagttgaaggctcacagtactgcaaatgaggttctctaactctaccaaattaagatgcctgtagatatatataggtcaagagaacttgattaatcatggcatagaatcatcaatctttcgaaatagaaaacacaagggaagatcgaaacgatgagaatggcatggccatcaatccagtatagtatgaccaacatacctgcacatatctgcatgcccctgcctgtcttcttctccccaaaaaaaaaaccgtggccggaggttgcaatcttggaaaatttgcgaaacggccatgcaaagctgcagctggcagctcttgctaccttagtgatcagggactcaatcccatgcagtgctgagctagcccatgtgctcgaggtct

SEQ ID NO: 78601 - DNA, 8680 bp, Oryza sativa
cctcgccatcctcaacaatgacgacatagccggcgacatggagcaagctactagccgacggcgccgtgtcaatcaaggccggctttatacctctcctactacttactcatctcatcctcctcctcctacctgtaatcacacaaggctttgaagactaattaaggagaccggttagccgctctgctgtgcttctaggtagtagtaactactgtactgctacggctacatatatacgcactagctagccggagttatggctgtctcgtttcatcactgcaagcttaagcaatcaatcttagccaagaaggggaagaagaagaagaaggaggaagagaggccaccagcgaggcaccaacaacccggccggggtagggtccagtacagcatgcaagcaatggctgaattctactcaaaggggaccatgaattgacagccgagtgaccgagtgagtgagatatatacacatgggaggacgacgacgagtgatgctagcgtgctactggccttttagggtgtgtttagttcacgccaaaattaaaagtttggttgaaattagaacgatgtgatggaaaagttggaagtttatatgtgtaggaaagttttgttgtgatgaaaaatttagaagtttgaagaaaaaatttggaactaaataaggccttaatttgcctttcgataaaattaacagggcatcctccggtatccatacatgttgccttcggtcttgtttagataaaaaaaatttagccaaagacgccacatcaaatgtttagatacatgtaatgtttggacacatgtatagagcattaaatatggaaaaaaaactaattgcacagtttgcatgtaaattgcctaattatgccataatttgacaatttgatactacgtacattaaatatttgctaatgacggattaattagacttgataaattcgtctcgcagtttataggcgaaatctgtaatttgttttgttactagtctatatttaatacttcaaatgtgcgtccgtatttttcaaaaattttacacccaaataactaaacacacctgaaatctccctgaaccatgcagctaataagctactcctaggtactactagtagctggctatagcgctgctaccgtttgtctgacctcagaaagcgtcatggagcctgcagcgccatgtgtcgtggatgcatagggcgacgtccctcgtgggactgttcggttttgaaggattttcacgaaaattttagagagattattgaactgtttcttatcaatactcctgtaaattatattctttcgtttcgaataagccctaaagcaatgcaagcgaaagggttaaaggcagctcactgctggcactatatattgagagcttctccttttggaatccgtttggtgcacgatcgatcgagctctccatacttttgctttcgatgttccttccgaggcgagctttgagtgcgagtgtggctgtaaaggttctgtacatagtacatgcaagtccaacgttgttttgttcctgttgcaacttctgtttaagatatttgctctactagctcttaaacgggtggtcatggtttgatatcaacgttcaacatgccaggcacataattctcgggaagtcctattgcaaggtcaactgaaagttaattattagctcacggtcacatcattccatgccatggccccatatatatgcccgacaacctagccagccgatttggattatatatgctcaccgttgtgagggcctatttggttggagggaccctccactttagcctactttaatgctaaagtcccagacaggggtgactagaagagactaaaaatatgttagttcattaatccctatggaagaagcttatatagactaaaatgtttttcttccacctcttgccccgctgccatgggctctctttgcatgggctttagaggtaacatagtctttgtacagtgtaattaatgacctttagtccctacatccaaacaagtatggactaaaatttttagtcctattttagtcctagaactatccaaacaccctctgaattacctctgaattatgagcactatgccacctgctttatgtgcatatatatctttccatcttggccctgaaaatttctgagttataaaatcaccgttgtgacttgtgaattaggagtactatatgccaccagctttatgtgcacataatctgtgtatttttaatagatgacaccattaatttttaaacacatgtttaaccattcgtcttatttaaaaaatttatacaaatatatacaatataaagcatgcttaaagagttcaccgcgtactatactactcatgggaagatcggagaagtgagatagcttgtggttatatgaaactagggttcaccaaaccgttttgggtggggttatcattgccccaccatttagcggtaaccacacggttatcgtgaaaaccatgcggttaccgcgaggtatactatggttttaaaaactgagaaggttacaacatgtgaccatgataaccgcacggttttgtaaaccctacatgacacccgctcgtttgcaccggggtggcaattagttcctccattatttttttaaaaaaagatagagtgatataacttattcctaactttactttatgaaaactacaaccaattatgaacaagattgcagggcaaataattaaggtgtggttaaatcacatattaatcccgcggagaagcaccaaatgaaatggtggtggaatcatgagtgtatgactacacccaccaaaattaaaattttgatgtccatgaatattacgtacatgtaggtggactttcaacaggaatttagtgagatcaagaatgtgtcgtcgatttccgtctcttggagcatgtgttaggggacatactcgtagggtgtgagtgtgttgttgcatgtataaagatgtatgtgcgtatatatgcatgttatgtacaattgcaaaaagaaaaagcaattaatcctgcatattctcccttgcttgcaagctacacttcgatcacgtacggacgggttggttatgaatgcaccttaatttttcgtaaatgtaaaaaagattgcatgtcaatatattagaagaaaatagagttttagttacatcaagcaaaaaggtcggaaaaggtcattgtcaggagataggaaaaaataaaaggaaagaaaagactgatttataaaactgtgaaaaagaaaacactactcctatattgaaccccactatcgccgcgccgtgtttagttccaaattttctcttcaaactttcaacttttccatcacatcaaaaaaacttttctacacacataaactttcaacttttccgtcacatcgttttaatttcaaccaaactttcaattttagtgtgaactaaacacaccatatagtcctaacagacccaaaaaaatatataacatgatctcagacaatcttcctgtaggatggacggcgccttatataatttcctatcagtaatttgcaacgtgcaacaaacgtcgatgcatgtgtaacaaactgtgcggatgctcgccgccgtacataggcagcacatactacgaattgaagcaccggtattgaatactgcgtactgctgcttgcagtcttgcagagagcagagctcgattggtacgagggcgcgccattgaagcgaaagctatcgtaccggttgctttgaagcggagcaacctacgcacgtactagtacgactcgatccttacgcggatgggcatgcaagcacacacacaatatatatatgcacgaacagaaacgtacgtgcagtgcgtacaatacgcggtacaccgataaatttgttgtctccagcaaggactagtagtagcaacaaattgaatggtctggacgccgtttgattgataatcgatcgaccgaccgacagatggccggtgacaccggcccgtacgtgcgtcgacagattgatggattatggggctatatgtttgtttccttctccgaaagggattgccaatgcactggttgctcagcttccatagatgtatacgtgccacacatctctcactctcacgttcggatcgacgaacccgtgctggcttattaaccctgaccatgaaacaaagaagattgacgaagagagaaagatatttacatttacagtgcatttgtggacgagggatgttaggttccgatcttccgatagatatcgataaacagttgatttggacggagtcgcgacacaactcgatccggcttctgaatgaatacgttactaagccccgcaatcgcagcaccacgtctcctctggttatcaaccgtgccgaaacccggttgacctcgccgagaaggctaatcccaacatacgaatcgaagaacacaagcgagaataagatagattgcgattaagcactcgaattaggggttccacaaaccgatctagcggctaaactgttcttgacagattaatctaagcaaaacccgacttaaaacgatgacgtctactgaataaatataattatgggcgtctagggttgccctagggcgcacacccccttgggctaagcccacgacgcaattacaaggtacaaaacacaaatcagattcggactggataatatatgtggcttgttttgcatattccgggcagctcggtaggaattttgatgtaggaccaaaaccatatgaaagtagactccataagctttccaacaagtactcatgggccccaaaattctttctagatcagcggctaggtccgtttgaagttgatgctgtcagaaggcccgaatccgaatccaaaacgtgtaggtttatctcttgtcttctatggaccaaaagtgacgtggtgagatgaaaaaagacttggaaaaggtcttggtttgatccccaatcaaattcttcaatcatccatgcattccttacgctcggtctcttttctttcgcccaagtaagtacctctgcaagtaaaaacatacaaaacttattgtgtagtaacgtttgttcaaatatataacaagtaaatctaatatagaacatatacatctttggtttattaatacataagttagtcattgttatatccgagctagttgtgttctcatcatttgttttgttattagtctacgtttagtattttaaatgtgtatccttatacgctaatttttttttaccaaaacaactaaacacggccgaagtcaaatttgtctctccaacggcatgtgtgcccgcgtgatgcatgtgagtatgtgaccactgaccagcaacactgagtcactggcaatcctatggaggtacctcttcgtcctatcaatcctaaatactacctcgtctcaaaatagcttaatctataaatatgacttgttctaacccaacgaatttaaacatcattttatttatattcgtcgtattagaatatattatggtatatcctagcttaacttattttgggacggagagagcacaaatttgttagataggtctcttttttcttaatgagcaaacaaatgatcgtgcatactccagcgttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaatagttgtagtaattaatcaatattaaccaaacactgtccaacgctaccccacgttgcaacaggcccaaccaaccacctgaactacaccagttcattaagctaaactaggaatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaatcatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtatttcatgacttgccttgctctcgcactgacgagacctcagcaacgtcttcgagaaaccgtggatcgacaaaacggccgaaacctacgcgacaaacaaagcacacaagcaaaacaggctataagacaactgaaacagggaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtggcgccgacaggcgggccccactgatcagcggcactaagggggggagagggggcggctggcaagcgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacggggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggcactagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagcgcgcgcgcgggccgggagatgcgggggaagaggcggcgacgtgggcgcgaggtgcgggtgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggaaaggggaacgggccggcccacaaggggaggccgagcgcgggcgacgggtggactgggccgacggcccaagaagaggaaaaaggaggaaacaggaaaaagaaaaagaaaagaaaggattttcctgggatttaaaaattgcactttggtgatttttaattggttaaaattatttccaaggctctgaaaattccactaaaaatcctgttaatatattgtgacatgtagaatccaagaaaaattccacatgccgattctgattattatttgcatttattaattagagaattagctctaggttaattaagataatttcttcggacgatttatttagccaatttttaaagcaagcaaaaggggggaaacttcagggcgtgacaaacctaccccccttaataaattctcgaaccagaatttctaagctgaatgtgcattaaatccctgtccaggaccagccagggtacccaaacaacaatt

SEQ ID NO: 78602 - DNA, 3911 bp, Oryza sativa
catcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgctcatcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctggcttccgcggcactagagactggaaggttaccacctctccttttgcattggttaacttgatggtgcggctggcgcaatcaatcactcctctgtgccttgttaaccaatccattccaagtatgacatctaggtccttggattcgagaagaatgaggttggctggaaaaatcaacccttgaatttcaactgtcacagatgggcagtagtgagttgtggtcatgccacctccaggagtatgcactcgcattggtatcttaagcttcactaaggataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggaggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagaaattctagcagtttggactgaggaggtggagaaccaaactgcaggttctgctgctgcagctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactagcccacaagcatcaaacctaaacacgaaaactagcaagcaaacagactaagaaggcgataaagctaagggcggcgactctgaagctcgaggcggcgcttgcaaacgagggataggactgacatctaaagtagacaagggataggaaccaattcatgctcaaatccaaattaaacaaagcaaaagaagactcaaatcaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactatcgaataaactccaactaaaatttttctaaagccctaggctgagctcatttttttttttaaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgccgcggaaaagataaaagcgagctaaaccgggaagcttgacttcagcagcgggcgactccactccacaggcaaaccttgacggcagcgacgaaaccaactttgacaaaacagctcccactaggaagatcttcagctctggtgtgggggaaaagagagcaagactgagtactacccactgtactcagcaagtcatcccggaagaggaggtatgatgcaagatataacccaagggggctagagggtcttttgcataaaactagcatttaaaaacag

SEQ ID NO: 78603 - DNA, 571 bp, Oryza sativa
tatcttactacgatccaacatataattaattagctactcgaatggtcctttttctctacctttgccgtagtttagtgcttcgtcatctacattggtttgctctataagcagcgtggagccaccatccaccatccgggctcactgtcaaatacactgttaaaattttattttatttgaaagaattaaagttaaaaatattatagcaaatattaggtatatttgagttttcctgtgcttggaaagttttctaggtccaccactatctacaagggcatcctcaatgtttgtggtgtagtgtaaccttaaggtgggccttatgaatagtgagccattgttatagccatacccataatgctatggttagaatttagccacaagatggcccacatagaatggaaaaataattggttcatctcttgttcatgaagtgaatgagagagaaaatattttctttttgcttatgggagaacttaagcataagctgcatcctaagctaatgctactttccacaatgtatatggctcactttacaagtgcaatcattgccttaaggtcacctttttcatacatt

SEQ ID NO: 78604 - DNA, 729 bp, Oryza sativa
  unsure (1)..(729): unsure at all n locations
tcaccatcaataaaaatcaatgcgtaaactagtcctttacattttggaactaggctctattgctaaatcctttcaatctaaactactgaataatcacacaaataagtatcttctattttactttgaaaaaagatgagaaatcataaactaaatttgtaatcatgtttcttgctaatgtttttttagaagtaacattgtaagtacagccatacaacaacaggaatgagaggagggggtgtggggatggttcggatagggggtngctgngcctctgccctcctcctccatcgctgctcgccgcggccaggcttgggagcagcggatatgccgccgacggcgctcccgggcctagggcggccagatcacgtggcggcggtccccaggtggctcggagatggcgtgcggctgcgtcgacggcttgcagcggcggccccggggtggctaggcgacggcgtgccacagcgtcgacggcttgcgcagcgccagccttctccgccgcggcaggcctagtacggctcggtggcagcggtgcagcgacgacggcagaggcgtcagctgcgtcattcgtgagcctgagttcttgagcaccgaggtaatggtcagcctgctcccctttgatcgggtctcatccttcgcgagcctaagatcttgagcatagaggaatgaacagcagcagtacttggtttggctggatcgagagcagatcttggaattgcatgatttgtagag

SEQ ID NO: 78605 - DNA, 4052 bp, Oryza sativa
gcgttgaagatttggcgtcactacctctttggtactcgtacggaggtgtacacggatcacaagagtgtgaagtatatcttcacccagccggatctgaacatgaggcagcggagatggttggaactgattaaggattacgacatgggacttcattatcacccagggaaggctaatgttgtagcagatgctctcagcaagaaaggctattgcagtgctacggaaggacgacagttgccgtgggagttatgcaaggaatttgaaagactaaacttgggaattgtcagtagaggtttcgttgcagctttaggagcaaagcccactctggttgatcaagttagagaagttcaaatcaatgatcctgatattcgagaaatcaagaagaatatgagaagaggaaaagctatcggttatttggaagatgagcaaggaaccgtatggttgggcgagagaatttgtgtcccagacaataatgagttgaaagatgcaatcctgaaagaagctcatgacactttatactccattcaccatggtagtaccaagatgtaccaagatctcaaggagaaattttggtgggcgagtatgaagcgtgagatagcagagtatgtagctgtttgtgatgtttgtcagcgagtcaaggcagaacatcagaaacccgcaggtttgctgcaacctttgaagataccagaatggaagtgggaggaaattgggatggatttcatcattgggctacccagaacgtcatcgggccatgactctacttgggtgatagtcgacagacttaccaaagtggctcatttcatccctgtgaggacaacatattccggaagccatttggcggaactgtatatggcaaggattgtgtgtttgcatggtcttcctaagaaaatagtatccgatcgaggtagccagtttacttcaaagttttggaagaagctgcaggaagagatgggttctaagctgaacttcagtaccgcatatcatctgcaaacagacggacaaactgaaagggtaaatcagattttggatgacatgttgagagcttgtgctttagacttcggtggaagttgggataagaatttgccttacgcagaattctcgtacaacaacagttatcaagctagtctttaaatggctccttatgaagcactgtatggtcggaagtgccgcactccacttttgtgggatcaaacaggagaacgtcaggtttttgggactgatattctaagggaaatagaagagaaggtaaaaatcattcaagaaagattacgcatagcccagtctcgtcataagagctatgctgatagtcaccgcagggatctaagttttgaggaaggagatcatgtgtaccttcgtgtcacgcctcttcggggagttcatcgttttcacaccaaagggaaattggcaccgcgtttcgtgggaccttataagattgtcagtagaagaggtgaggtcgcctatcagttggagttacctcaatccttggcaggtgttcataatgtgttccatgtgtcacagttgaaaaagtgtttaagggtacccactgaagaagctaatcctgagcagatagaaattcaagaggatctgacttatgttgagaaaccaatccgtatcttggagacagatgagggaagaaccaggaatcgagttatccgtttctgcaaggtccaatggagtaatcagtcggaagaagaagctacttaggaacgagaagatgaattaaagtcagcccatccgcatcttttcgccagctcttccgaatctcgaggacgagattctgtttaagtaggtttgtcacaccctaaaaatcctaaatttataaattgttgtttaaatggaattattagaaatgattttaaaagccttgaagaaaagatctaattttaaataataaattccaatataaaagtgggctaaataaaagtttattaagtacttctcttgattctatagttcctagatttttctgggatttatttgagccaagaaagtatttttaataaatggaattgcatttcatgaataatttaaaaggaaaaaggtatgaaaatcctcttttggctttgggccgaaagtcggcccaagtctctttcttctgcttcggcctgctcgcgctcggcccaagtcggcccgccaagttaagccaccctctctccctcctctctctcgctgacaggtggggcccacctgtcagggtcgtcttcctcctcccgccgcagccgcgccctagccgtgcgcaagccgccgccatcccttccaaattccgtcacccctttcccaatccgatcaaattgatagaggggaaatgatcccttcgatctcctctatcttttctcctatagaaacttcatctaatttcgtttggaaatcgtcggattcgagctcgattcggatttgtttttttctcctctaaccctaaaatttccatcgtcgccgccggctgccgtgggcctagccactgccccctagcccctataaaaggaccccaagacctcctctgtccgccgccaccttcgccttagcccgctgtcccttgtagcgccgcctccgcgtcagcccgtgcgccgccgtcgccaccgccagtccagtcgtgcgccgccgctgttccagtcgccgccgtcgctcgggaaggccgccgccgctgttccagtcaccgccggagctttgccgttgtcgtcgacccgaacgtctcccctgcttcgacctcgccgccatcgccgttggttgccgtccgtcgtcgtccgagcctttggtgagttcgccgcattgccctctacccgtaggtgtggtccgtttgtgccgccgcgccgacgttcgcccgcgagcacgaggtgccgagccgccgctggtgatgtcatcgtcgatgtcagcgccacgtcagccgtagaccgcggtagatcggttagatctcggccatccattttgattagattagatctcggccgttcgttccatagaccgtttccgtgcacccggtccaccgtgaacccgagccagcgtgggcaacgggtttaccttttgtatagtgtagttcattgtggagcaccagactatgaagtggcggagataagctgacgggggtcgctggggagtccatgccttgtttataatggggtgattattatccaggaagggtgcactgcttttaattgtgttatgcagagggtattgtcacaatctctattctggccagagtaaaactattcgaatagccatgcccacggttatgggcaggtctaacaatgtcttacgtgattagtctcacacctctgaccataataaatgatgctgaaggtgttctatagtgatgctgaaggtgtggaggattaggcgtagccctggtgaagctgcttgtgggatggagtcgcctgcgctgtttatctttttccgctgcttagatctttattgtttgagaggaactatctacctctgtaatgactttatattcgcttaataattagataaatacttgcactctattatcaatttgttattgtgtgcctcggctgattcctggacgagggtttgcacacatgtaagcgtttggagttttggatagaaattccgggcgtgacaattaaccatcatgagctaccattgaatataaccagaagtaatgatgtagtgtgattcatcccattaataagctaatgtttataggagcaacgactcgcggcctgatgctccggaagaaagcttctggattttctttgaagttttccggaaagttgtaaccagtcatgcaccaccctattttcacaacaaaagtgaaaacaaccaaggttagcctgtaaaggaaaatgattatacagagggtaaatacaaaatattagttcaggtaatctctattatgtatcttccccggcaacggcgccagaaatgcttgtcggtatttgttaacgacattactagaaatataattcctagcaatagtgcagaaatactcttggtatattatggttacagagtttatccgcaagcgcacggatataccattgtagcatttcactcgagagtattccaagggtattgttgtcgaagtgacaactgcgtac

SEQ ID NO: 78606 - DNA, 11779 bp, Oryza sativa
ccctaagctctatattctccttgcggagtttcttcacttgcacggcgagcttatggatcgagggctctgacgacttcacctcatcttctgatattggccgggaacccgtcctgagatataccagccatgggtgttcactaggacttggatcaaaggtttttgagggtgaatgggagattgaatagagaggcttttgcaaaggaggaagaaagagaggaactagctcaggagagtgatccgatcgctctacctccaaactcgcatctaaacagactcaggacgggcgggggagtctaccatccaaaaatggggccgaacgggtgcgccctggttcggccgaaccctggtgggtccggcaggcctccattttctttcctaagcctactaatttctaagctaagcacaaacatgacaattataaagggttttaagcatgcataagatgagatcatcatggttcataattgattaattcaacgacatccacttcttcatctaaagtttcatttggctaaaggaaaatttttaagcgttgaccgtttaccttgaatatattacctgaatcgttgcggagagtgattgccccgtgcgaagaggtattgatgacgttgaacggtccttcccatttactacgcaattttccgtgaccgaaaagcttaacctcggagttgaacattagcactttgtctcctggcttgaatttcttgatttttatccttttgtcatgtcagtgcttcgtcctttctttatatatctttgcgttgtggtaggccttctctctccattcttcaagttcggtgatttgcattttcctccattctcctgctccgtcaaagtcccatgttccagtttctgatggcccagtatacttgctcaagttccacgggtagtcgacatgacttcctgtagattatctgatatggggacattccaatgggtgtctcatacgctgtccggtatgcccacagtgcgtccgacaatttatccttccatcctgtttccattttgttgaccgtcttctacagaatattcttaatccgtttgtttgatgtttctgcttgaccactggtctgcggatggtaaggagtggccacattgtgtttggctcccatctctcgtaggaggtcttggaaggttttgtcaatgaagtgagaacctccgtcacttatgaccattctggggataccaaatcttgtaaagatgatttctgtgaacatcttcttggcatgcctcgcatcagcggtgttgcatggcatagcctcaacccacttggagacatagtcaactgccaccagaatgtactcgcagttgcgagacttatggaaaggtcccataaagtccataccccaaacatcgaatatctcgacattctttgcatacatctctacttaatcgtttagtgacttgcaaattgtatgtgaggggcattgcatcgcgagcagtgattcctccttgcctctggcagcttgtgcatcttctgacgaattcttttgagtcttcgtacattgttggccagaagaaaccactttgtcaaatcttggcctgagtgcggaatgcaccgtaatggccaccatagggtgaggcatggcatcgctctatgatcttaagttctcatcagttggcacacatcttcatagtaagccattggagcagacccgatataggtatggctcatcccatatatgacggcgactttcataattcagtttttgttgattttcccctggtggtatgtacttggataccatgtagtttactatgttggcataccacgggttggagtcgcgaaccatcatcagcatgtcgtctctcaagaagtcgtttatcggctgttcctgcgtgtcagtgatctgcagcctggacaaatgatctgctatggaattttctactccctttttatcttttatttctaagtcaaattcttggagcagcaaaatccatcttgtggtttagcatctttcttagtgagcaggtacttcaaggcagcatgatcagtatagattatcagcttgcctcccactaagtaagacctaaacttatcgatagcaaaaacaaccgcgagcagctctttttcggtagttgcataattcaactgagctccggttagagttttgctagcagagcagattgcatgatgatttttatccttggtttggcccaaggccgcaccaacagcgaaattgcttgcatcacacatgatcttgaagggcagagtccatccaggaggttgaatgattggagcggagacgagtgcctttttgagaatttcaaaagattttaggcacgtgtcatcgaacacaaagggcgcatccttggctagcaaattggtcagaggtctagcgattgtagaaaagtccttgatgaaccttctataaaagccggcatgtcccaagaagctgtgaattcctttgatgttcacaggaggaggaagctgatctataacatcaattttaacccgatcaacttcgattcctcgttcggacactcgatgcccaagaactattccttcatggcccatgaaatggtacttttcccaattaagtaccaggtccttctcttggcatcgttgtaagactttgtctaaatttcgtagacaatgaccgaaggtctttcaatagaccaaaaagtcgtccatgaagacttccataatgtcctctatcatgtccaagaaaatagacatcatacacatttggaaagatgcaggagtgttgcacagtccaaagtacatcctatagtatgcataggtgccatacggacatgtgaacgtagtcttactttggtcctccggatggataggaatttgatgatacccggaatacccatcaaggaaacaaaaaaaggaatgatttgccagccgttccaacatttcatcaatgaagggtagcaggaaatgatccttttttgtagccttgttaagtttcctgtaatcattgcgggattagttcattttgagcatttgcaacgaccgtcattcctcccttctttggcacgacctggactgggctaacccactcgctgtatggtacgggatagataatcccggcatgctagagtttcaagaccactttctttacaacctctcgtgttgcattattaagccatcgttgaggttccctggaaggagtactctcggggtcaataggaatacgatgggtgcaaagcacgggattaatccccctgaggtcttgaagcgagtagccatgaacagaacgatgcttttccaacatggtgagaagacgttgagtctcgttttcagagagcttgtcactgattatgacaggagcttctctgtcattgtgtaggaaagcatatcgtaggcctggaggtagaggtttatgctcaagcggaggtcgaggtgacggttccatgattggcaggtcgagagtctcaacgggatctgcttcttccttgataaaatcggggacctcatcttccagaagggcctcgggagactcgtgagtggggagctgcactaacctcctccgctgactcaatttatgggagggaatcggtcaaggcgatccttgctcgtgagaatggaactgaaaattcattccctcccagtattattttgaggctatctaatcggggtgtgttaatgagaagttgctcaatgggcagcccgattaggatgtcgaaatcttgaatttcaaagacgtggaaatccaagatcgcctccctgtcttcaaagcagacaggcacatcttgtacaatcccaaatccttcaatgatatttccgtttggatgtttgaagaatttgttagtcggggtcattgccttatcgcttaaataagcgaatgcaaaagactaggaaacgagattggcccggacagttggactgtagagaataccgacgtcgttcccttccagatggcaaggaatgattcggggagcggtatttatccgaattactttggatgaaagttctgcctcccttagccattcatcgctcattatggatgttaactcccgtacagtttctcgtaggaacccgagttccataggattaggaggtggcaaaggaacgggtggtttcctctttctaaaatagttcagggtattgccgtagtcttcgtcaaagccgtccctgaacagaattgcggcataatccggagtctgaatttcttcattctcgacagtcggctgcttaggaaccttctcatcaatcgagctagcagaagtggatggttcagtgagtggctcgatcgttagaggttcctctatcttggacatggatgcctctggctagggttcattggattgcgccatgaaggaagtattttctagaatgcgatccaaaattgtccttccttctgacggcgttttgtgcatgaacgatcctcaagcggttatgtccagatagaatgcagactccttatccaaacccgtatggaaatgttggagtagcacatactcgggtaaggacagggttggtccggactacactaaattagtgaatttggaccaggctgcaccgattgattcatttttgatctgcttaaaactgagaatttctactcgaatggcagtaatacgagtaactggaaagaaggcaagacaaaatctgtctcgcaacttctcccagctaccgcctacacatccaacggtagaggtgtaccattgctttgctctctcttgaagagagaacgggaacaatttccaccgcacagtttcttgtctcatgccacgaatcttaaggcatgagcaaacttgttaaaagtatcgcagatgatggtagagattttctagatcaaagccaaaaaaaggtttttccctaaccatactaattagttcgggacgaatttcatagccagttgtataaatgggctctgatgaaggaggtggttcatagaattcgccccgaggagcagacagctcaaaaagcagttgctccatggtcgagaagagtttgacaggaatacttctctaggatagcaggggtgaaggtaaaaaaaaagtaaaaaggatgcgaggatgaacagggttcggaaatgatcagcaaccattccccggcaacggtgccagaaatgcttgttggtatttcttatggtcactgataaaatctgtaagtgcacggatataccgatgtagcacttcccctacggagtattccaagggtatcgaatccaagggaacgtgtgtgatcagatcttcctccggttcatccaaggacaccaagcaaatgataggctaggatagagaggattttctagtgagaaacaatgtctagggaaagcttaactttaatcctaatgcaatacttcaggcactggcaacccgctgttcccaaatgtcgctctactacgtacccggacagggaggacttaagtgatctcgagggctgtcaccacctctacacccacctcaaacgtactgtgagatacgcagcaattactggataacaactacctaaacaccatgtctaagcaattaatatctaccttagtgtttataactcaccaaagcaatcaatatattctagttgattatagtgaacaataatcccgtatgctacttaggaactaaccaagagataattctcacaagataaatccaaattactcaagaagaatattatattgacttcagagtaataaataaaataaaagaaataggagaatattaccgacaactccggacttcttccgactccttctactctactctcttcctattctagtatacaatatagtacaatagagcctcttataattcatctcaagcttgggagtgtgtgttgaagtgagtgagctgatgtccttatataggggtaggtacgattggcgaaggggaaatgtccgaagtgcaatccaaccgtcattagggatgcatctgggacgtccacgccaaaccccacatccaacagtggaggtggtggttcggccgaacctgggctgggccctcctggcctggccatcagctcatgttccccccggtcctcctctattcattcttcggtattttgggccgatttactgatgttttgatgaagttcacaacccatccttgcaggggtacacatttctcctcactttagtctgattttcctcccatcatcgaggtttatcatttgcaaacaaatatataccaacacatatggaatatgtgagattatgtacctatcactatgttggatgttttattatctgaactttatgcagatgttggcggtatagaattgacatttaacagccgccaacagttttctaagacctttcattagcagctcgctttttgcctaaagcatcagtggttttagcttgcgcaaagacgagatctttcaaggagggttggttacagaaattactgttattgttacctccttgatagaataggcgtggctggttccaccactgacctcattgtggatgatactcgttgttgttgttgcccatgtacatcgcctcttcacgggtttctaggcaatcaatcccagagtggcctgtgctgccacagactgttggtatttcttacgatcacggatagaatccgcaagcgcacggatataccgatgtagcacttcccctacgaagtattccaagggtatcgaatccaagggaacgtgtgtgtttatctcctcgtcaggttcatccgaggacacaaagctaatatgggcagagggtagagaggatttcctaatgagaaacagtgtctagggaaagcttaactttaatcctaacacaatacttcaggcactggcaactcgctgttcccagatgtcgctctactatgtacctggatagggggcactgaagtgctcttgagggctgtcaccacctctacacccacctcaaacgtaccgtgggatacgcagcaaccctggagagtaattacccagacaccgcgtccttcaaacactaaagcaatcactacaaataaatggactatagggaacaatgatcccgtatgctaattaggaactaaccaagaagtaattctcactaagaaaatcttaattactcataatgatatttctattaaagcagagtaataaacaagatacaaaagtaagaggagattaccgacaactccgggattcctccgattccttctagcttactctctccctattctaatatacaataaagtgcactagagcctcttgtaattcatctcatgctttggtgtgtgtgaatgagggagaggagaggggtatttataggtggagagttgcttagagagagtggagatgctccaagcatcatatgagcatattccttctagcttcatctcctcttgacaagtgtcctctctatgacagtttccaccggtagaaacggccacaaccatcattgggatgaggagtacaaccgtcataccgaatatgggctggactgggccagctaggggttcggccgaaccctggttggctcccctggcccacatctttcttcaggatgctgacatgtgggctccacttcatgatgctccatgttttggctccaaatgattgcacattttatatgttgtagctcaaaaccatgtgagtccatcagcacggaatatatttccattctttatcctcatcctctcccaacgttggtggttgatcacctgcatacaaatatacaccaacactcgtggaaattgttataaataaatcctaccactatgttggatgtttcacatttatggttttctgcaagtattgacggtgttattttggcacttaacaaccgtcaacaaaactctccacacttagctcattactcgtcccgagtaaaggttaaggattaatgtggaataaaatttcccaagatacaatacaagtacacaaattattctaagtcatacctgtacctatgaacctttgccctatctaacttaccatcttgggaaattgatgaatggaacggtcatgattcaagtccttctttttcctcctatcaatctgttagggttttcatttattttcgcaaagtagctttactcctcaaatgaccttctctcagatcactcatgtggtttgatttgtggatcctcaccatgcatgtttgccgaattgtccctattctactaggttgtataggtggagctcggtagggatcaatcggggcatacctgcatcacatatatagcaaagccaagataccggacccaaggagatagcaagtcatactctctgatcaagaatgtgcatgtgtgtgatctgtgtatgggtatggagaattgtgtggatggaaaaaggaaaatagaagataacaactcctttgatatatctcctcctccaattttctctctttggaaatttgagagagtgcatggctatctttttttcttcccttttttttcatcatgccccatactttgtatgagcagatttttttattcatttttttctcttttgtttatcaatgctccatacttgtatgagcaagactttttttccttcttttgcatagccatgcctctctctatctctgtttttttttctttgaaagaattttggagaaaaaggcataaatgacatggagtatttattttgtggataatgggtaaaataaatgatggatgagggatgctaccttccagtgtagaagtttagcatagtgtgtgtatatggagtgtacgtgatcttgatcatgaaagtatgaaaagcatctcacacgggtcacaataatttgacaaagctcaatgtaatgcaagcagcctaaacatatatcaggattttgcaatgagaatcatatatggcctttgtaggtaataatatagtcagtgaggagtattgctctaaaagaattttttaattttcgcaaagacaaaatcccaagtatcatgacagttggacaagaatttcttttgtcataaccatatcacatatatcaattacttatattagcaaggttccctataatggatgtttgttcacaagtgacaagtgttggcaaagaataaaaagtatacatgattaatcataggaaaattgtattcagtttctttttatttgttgagagttaatgctttcaattttcatttggacttaaactaaattgtattcaaattttctgccaaagtttaactcacaaacaagggaggataaggaaggagacgcgcaaacctgaccacacggcgaacgatgacagaactgagccaggcatgggtcaaatgaacacttggttcgaccaacccaaccaagacttggttctgactgctaagttttgtgcgcggccgtgggcgggtgttcaacatattgtcatgttgagtcgatgctgttgcacgtcaggagttccgaaaagactcccccacacttgttttgtaccttgtctttattcaacaaaatgatggaaagcaaaatgggcttccaccggggtaaaataccggtgagccaaattttattcaagtaattctaggcgcatgaagtgcctaaaattacttttattttatttcacttttattttgtttttatttatatttatattttatatttttttatcattttttatggcagcaatagaggtgatgggtaacctagcagggtggacatatgtgacgcaatgatacacagggtgtttcgaattcttactagataggacttaccaagctttgattcggatgcaagaatgcaacacaactttgcatttgctctgcctggttccctgagcatctgtcttctcatagtccaaggagcgtggtatgaatgttgagattattatacacttccccttagttgtctttttatttcctgcagaaggtcagtggacaacaaataccggagggaccacaaaaagttgaaaagattttatcatagcctcaagattagttgttcacattcatgctaaaaaggaattggattgaaaacttaatgagcatggatcccataaatttgccataattttatttttgtcattatttttactttttactcgagagaaaaatgtttttttttccgagagacatttcttttattcttgaaaacaatttttatcaaacttttatttaagaaaaactcatatagggctgagataaagttacataacatagcaaaggagcatttgacaataggtcacggcagctaaggcgggagtagaccttgcaaagcagggcgaaccgggcttccatggcgccatcgacggtgaccttgggcttcttgttcggcgcgatcgccctgcgccgccatcggagagctttcgccgactcagacccggcctcgaaggggatggagtggtaaaaccacttcgacatccagtggcgagccaacttgaacatggcggcgttgaccggccaaagatcagagtgctcggggcgaacattgaagttcacgctcccgaacgctgtcttcttcgtccctgcgggagtgaccaccgtcttcgagtttacgttgcgtaaaaaatggtgccgtaaaaaatggttcgaacccagcggtccggcacgcccagtcgaagatggcgattcggacgagagccgatgggcttagttgagggagctccacctaaaaaaggcgaaggatctccgaaaacaacacgttgcacggaaaccgaaggccgtctcgaagaacacggcgaagaccaccgtccggctatcgccgggcttcggcacaacagcctttcctgggggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaaaatacatatgcacaaagtgtacacatttcctgtaggactgtattataggtttcggcaggagcgtcggtcgaaagggggcgcctcataccataccacatggtttgcacggtctcggccgaagctcctaactcacccttgcccgtgaggggcttgttggcagtatgtcatgagacccttcgaccagacctgccgaaaccgtgcaaccagcgaggactatgaagcaaagatggcgaaggccgaagagtcgtgctggtatccggcaagaccaaatgcgtcttgggcgaagggtgtatgccgaaggatggagacttcgcaataacaagcccaactttgaggaggctcaaggggccatcccggccgctcaggcctgttcgccaatcggcccattagaggcccatgtatccaaattacactgtatacccaagcaaacgtccctttcataagggcaaccatgtaaattcccctgtaaagcctaaaccctaaaggggtgaacctgtaataggattataaatagtctctagggacatgtcaagggggatcccaaagaaaaatcttaaattaatacatttactgtttccaacactgtcggtgacatggggccgggggtatcgtgactagaggcttgggtagccgcggtcaccctcgtggcctgaccccctcgggggggtcgggctcgaaggtgacgtggccacccctccctctgtctccccgagggg

SEQ ID NO: 78607 - DNA, 2260 bp, Oryza sativa
ttaaagtctctatttatttcaactgtgcatttattttcgaatgtcaccgggtggtgtgaacttattcctttgttatggtcaatttgcattgattaccctatttcttgattaccttgggttattataatttgactagttgagctttatatattggttcagctagatgttagacataattgcttagccattcttagaaacattagtacacgattgggataactaatgttttactattacttaatgatggatatttaatgattagctcacgatggtcaatcgtgattggttaattaattaatatgctaactaaaacttgataatggtgggttgtgagcacatggttttgatggtcatgcacatgacaattaaggaccggttcacaagtttcagttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaacggtgcaatgctttgagttgtgttgtgcgaagggtactgtcacgatttccccctttgcagtgacgtggtggtacttcagggcatggtaacatgtgtggaatcgtgtcttgtgggtacagtggtacacctctggccagagtaaaactattcgaatagccgtgcccacggttatgggcgggtctaacaatgtctttcatgatagtctcacacttctcaccataatagatgatgctataactggtaaaatttgattagctcctggtttggaatggtatattcctggtttggagatagatctgtacagccgggtatggttgtttaggtttggttgggcctgtgcagcatgggtgtgatgttcagtgttgattaaaattgatgattaattgctctactattttacttctcttaaatgtttgctaaatgctgcttttgcaaatgagcctattgttaacaaccaaatttggtaatatcaacatcggagatgaagatgaaatcgaagcggactcgaagataaggtttttttcggaaacagagtaagaatcggctggagtccggatcggctacgactgggattggctaagtctgagtcagtctggttaagtgatacagccgattccgataatacgacccatgtgcgacattgggttcgagttgatgtgtttcaagatgattgccacgcatagatagagtcctgggaaggcaattgtatctattaattaggatattttatgtaaattccttagagataaatgtgggcaaaagtctgccgcaaagacttgtggtatcttagagtttgttagagataagagtcgtgtccaatatggacatatcttgtatttctcgggtataaaagaccccgagccctatgtaatgatgaacacacacgttcaatacaatttcggcgcatcgccactctttttgctttcgttttatttcaacgagttattgctttcgggttgagctgcatcggttttgatgttcaacaagaggtaaaacttgttatggcggcttgtgttctcgagattagtgcttccatctttatgatactctaatcttgtttatgtagtccgtcaagttatcatatatcttacataatccttgacaatatcgtcatttaacctacaatcggctaacatctgctaccagaaggcagccgattaggttaaataacgacattggcttagattatatgagatatccaccactctatgaaacatccagcggcttgatcgtctagatattgttcttcttttcatacttaatgctgtatcagttgagtttgatctattaagtcgtgcttaaaatttcaatctctagcctgcctactggttgccgattagggtagtatcggagtttcagccgatcttatctgatccaattgcttttgttctacatgctcaattaacatgttggatctgcccttcatgttaagatcttgttgcatttaagtatattagatttctgtttagtatattctctttgctttaatatcttaatataaagtagtatcggagtattagccgatacacgctagatctatctgatcggctatgctatgaatatatatataatctcattattaatatatatttcgatgtaagtgatttatactgtctcggcaaggtgaccgatctatcccaattacttgattcaagtatacatcgatataaggattatgtatcattgatatttacagccgat

SEQ ID NO: 78608 - DNA, 1593 bp, Oryza sativa
ctccactccctccactttgagccaccgcccgtggggcccacatgccgtgccctttcctctctcttgagtcgctgacgtgcggggcccacctgtcggcgccccccttgctgacgtcagccctggggatttattgcgccataattaattaaggccttttctttattagtaaaaacacagattatcttctaaaattcataagtaattcatccgagctccgtttaagtccattcaagtctcaataaattcataaaaatccctagaatctattaaaaatggttttgttctctgttacagtagtcttatagcgtgtttttcttttgtgctttgtttgtcgcgtagatttcggccgcttcgtcgatccgcggtttctcgaagacgttgctgtggtctcatcagtgcgagagcaaggcaagtcatgtattacatttgatcgtattgtacccaatttacaaatatcccgcatttctattaaatgttgcattcttttacaatatcatatgggatgggtcctattattcagccatatattgtttaccttatgccattgataacttgggtttcaaaatgattagatgttggtttaggaaatgcttagccatgcttagttcaactagtacacaaagggggatcacattattacatagactttgactattagcatagctttggattggttccaccgcaatggtgttagttaattaaaatacactgaatggtgggctgtgggtgcatggtttcgctggtcgcacccatggcagttaaggaccagttcacgggaaaccctgggagacttaccgtgctgaccacaagagggagtgggtaactgcttgatctgaagtatagctcgacactttcctaggcaccggtggcgatggtgggcgtgatggagttgggtcggccggggtgtccggttgtctagctgccggattcaccgcggcgcaagaggggaccgcccactgccttttgaggggtgggggtgaaaccttagcgtggtgtgaatggttaggggagggttatgcggagggtcttgtcacgatttccccctttgcagtatcatggtgatacttcggggcatggcgacatgtgtggaatcatatcttgtgggtacagttgtacacctctggccagagtaaaactattcgaatagtcgtgctcgcggttatgggcgatcaaccagattcactgtgattagtctcacccctagtttagtttaatgcacattcagcttagaaattctggttcatgaatttctaggcgtgacattcgggtaaccccaaacggatatcgaactcagggaacgtgtataatctatctaaggctaagactatccaagaacaacaactgaaggtaggctaggcaggctagagaggactttctatgtttttaattatctaagctgagtaaaacataatttcctgtatgatgctccggacaccgacccctgctggtctgccaacgtggttccggctatagctctatgatttatccgaatgcggaggattactgggacgggattcagggctgtcaccacctgccgtctacctctgacaaatctgtgggatacacaataaacaattactactctaatacttg

SEQ ID NO: 78609 - DNA, 3302 bp, Oryza sativa
cattattggagtaaatgatttacttcgataaaaacaacttttcggttttcggtatatattctatttttcccgtacccaaccaaccactctcgcctcacttccttttttttctcttttttttggatctaaatcgatccaccatcccaccccacagatcggcgacacaccatggaggaggacgatgacaccgtggcggttgatggcggtggccggtgagcgatggccggcggcggttgaggcgaaggcactgcttcgggcctcgttgccggacgttgggcagcaccttaaccagcaataaggtatcacctgggccaatagcaacaaccagcggctactccaccacgtcggcggcattgatagaataagcaagtaaggaaatgacactttgatttgcatctgcatactctccttcaacttcatgcatgaagccccaatatttttttcaaatcaaattaacgtgcaatctccaatattacctgatctcaattgatgggctgcacaggtcctacatttgcacatcgtgctccatgtggctggccgtagaggatagggtggagtccgtcggtgatgtaggttgtttgatatttttcttttgctcgtcatctctattgacatgaacgagaatgtttttacatttttttgcgcccgctagatgatgatggctgacctacgtaatgctcatgtctagccgaccccgcttcatccctgtatcattccatcgtagtatgcaactcgctcgatggatgccctctccactcccagtgtgtgtgatcagtcagtagacacagactgttctatcatctttatagcaagatccagcatagccaccatatggattttgagttgaatcattttttttcatttctagtttgattcacctgtgagtaatttcatcgtctgtgtgtgagtgagcctgtaattttttcacttgtatgactattttatgatacagatcaacaatactcttagtatcaattttttactcttatactgtacattgaacatatcagtaaacatattactatatggtggctacgagatcatggctatatcgagaggaaggtggtaattgtttactcgcagaccaaggaatctcagtttttactcttatactatgtattgaacacatcagtaaacatattactacatggtggttacgagatcatgggctatatcgagaggaaggtagtaattgttttactaacataccacaaaatctaaacaatatttataatattggtaaaagaactactagcattgtaagctggtagtaattcttttacgaccatctaggtatggcgtcatacgatgtggagacattcatgtgagtaaatttgttacttttaaatgagcagatgtgggaggctgggagtaaatgaaaaactccacggagtaaattcgttacttttgaaacgtgcggagatactagaaaaatggaaaactcggaaagaaaaactagacggtaaatattttactaaaacgcgaaaacagaaaaactacagagaaggaaccaaaaacagaaaaatctggatggttaatattttagtgggcccattgatgaagcacggatgagatggaaaagagaaaaagaaacacggaaggtggagtggtaaaagcgaaaaaaacgaaccgagaaaaggtgggatgcggaggaaaggtggggtggtaaaaaagggaaaaccggaaggagagagcgttgtgcggcactcgaactaatattccgcgctgtagagcgcggaatagtgctaatggaattttatcaaatcgaatgcgagaagatgaacaagagagaggatggaggaggaagaaatgctaagttagtccaaaatttcattgtaagggcagtgagaggcatatatccaatatctacaagtttataatggtatatatgttcaaatatataaatggtagtgttatatttcaaactacaaaagttacgatgacaagcctaccagaggaggtgaatggtagattatgtcagcggaaaacaaataatcgaatcttaatagattaaaagtacaccccaacctcaaaaaccaatggaatacacgtccggcggtctatccgacctactagagtcggtctgaccaaaacctagccggtctaaccgcaggtcactcggcggtctaaccgtcagccctaaaaccagcacgacaacgcttctgtgaaaacttgatctctcttaaaccaaccattagatcgagttgcagactcgatagaataaactaaataaactaaggaacaactccacctgagagatttgcaaactataaacggtttaagagaaaacaccctcgaaagtcagctgtctcagaattttagcaaatctgaactaaacctaaaacttaagcaaattcgaatctagtaagaaccaatcaacgaaactttccagatctgatctatgaagtattagaaaggttttggatggattaacttgaacaaaatcgcagcaaaacaaacaatcacaagttaatgccaaaaccaaatataaacgtaaaacttacgaaaccagaatagatcatcgatgccttgatgattgaatatgatctttatcacttaaatatattgttcacaaggtgtagctacaacaccccttataaatttctcacgaaaccctctctaatatgggagttcgtagtacgcgcgtacgcgccgcgagcagaactagcgcgcacgcggcacacgttttcggaaggacgcggtagccttactaactctgttagttaaagataatgatggtaattaacaatagattttttattttattaggagagtttttttactaatagattgaaaaaaaataagttacatttgaaaacttttgacttaagatttaaactttgaactcaaattttgaaaactttcaactcaaactttgaaaaatttcaatttgcaagaaaattttttaaaactttcaactcaaatttgaaaagtttcaacttgagatttgaaaactttcaactcggatttgaaaactttcaactcgagatttgaaaatttttaaattaagatttaaaaattttcaagtcaagatttaaaaacttttttaaaaaatgaaaacacttgctactggaagattaaaaagtaatcaggaaaaaaagcaaaagaaagcggaaaaaaaagaaaacagcggtggttagatttcgtgtgcgcgccgcgtgggccgtatgggccgggagtgcgcgctgccggcgcgcgcgtgcgaattaggattatcactctaatctctcaaacttggcttaccttaaggcataacctccatctctatttataccaagaaccttcaacttcaacttaaagga

SEQ ID NO: 78610 - DNA, 6799 bp, Oryza sativa
aaatgggtttggctaaactggtggttcaaccgaacccgggatggctccgttcggctcatttttcctcgtggacactaattttgaggcctttagcccattggcatggtggattgggccatttggaggtgtttaattgggtttttgggtccaaaactccataagtttgtatatgtgtttgattatcctccttcatgtatatttcctctcaactttgttagtttgtcacctgcatccaaatatataccaacactaatagaaatgattagtaataaaccctaccactaagttgaataccatattttattccattatatgcaggtattgatagtcatatattatgatttaaggaccgccaatagatacgagcggcacgagtgcttctaaggcaatcatcttccaggacaaatcagagatttgtgcagccttgaggtgaggtttttggcgatttcgagctgggcttttgtggaggccatgggatcggaaccagaagaatctggtaccaagatgtcacgggctagagagttggaatgaggattgcgatgcagttgatatttgaacaaagtggatgggcgtggccctggacctcgtcggcgcaacgtaatttgcgacatatgttggaattggacatacaactcctcgtcattcaaaattcccaaaatgttttagattgcgctcggggtgcatggttttcatagtagcacctcggccatcataaggatcggtcttcgggcttctgtttcaaagcactaccgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacctctgatcagagtataatctaatcggatagctgcaccctcaattatggataagccgagcaatgtacccaagttagtggtttaattcttaaaacttgctaagcaactaaaatttggaatggatggcttgggttggcttgggacgagccgaggcccagcttaaggctacctgtccggtccaactcatcgtgggccttaggccaagataggtttgtgtgggttcactgccttgtttaataatactgtgaagacttaggttcgagtttacaaagtagttttgagcaactattagtggttattaaatgccaattctatatcgccaacatatgcataaagtccagataataaaacatccaacatagtgataggtgttaagtctcacatattccacaagtgttggtgtatatttgtatgtatatgataaaccccgaaggtgggaggaaaagcaactaaaagtgaaggaggatgcatatccatacaaggaggagctttgaacttcatcaaaacattgaagaattagcccaaaattccgagaatcggataaggcaagcccagaaagagaaatgggccgaaggacaggccaagggagcccagccagggttcggccttcccctggtttcggccgaaccacaattacagtcgtccaagctggggtttggcgtggacgtcccggatgcatccctgatgacggttggagggcactttggacatttcctattcgctaaccgtcattaactgtcctatttaaggacctccctcacttcacacacacttccaagcttgagctgaattataagaggctctattgtactatattttatactagaatatgaagagagtagagtagaagaagtcggaagaattccgaagttgtcggtaatcttctcctatttcttttattttgtttattactctgatttcaactgaactatcttcctgagtaatttagatttatcttgtgagaattatctcttggttagttcctaatagcaaacgggattattgttcactataatcaagtaaaatatagtgattgctttggtgagttataaacactaaagtagatattaattgcttaaacgttgtgtttaggtaattgttatccaataattgatgcgtatcccacagtacatttgaggtaggtgtagaggtggtgacagccctctagatcacttaagtcctccctgtccgagtacgtagtagagcgaaatctgggaacagcgggttgccagttcctgaagtatcgcgttaggattaaacttaagttttccctaaacactgtttctcagtagttaatcctctctatcttagcctatcctttgcttggtgtccttagatgaactggaggaagatttgaccacacacatttgttaacaccataatttggtaagcccgatgtcatcatcggcctagagtcagtatcggcttcagagtcttggaattggccgatgggagtcgtcaaatcgccagcagttgtgttcttgacggagtcggatcaattaaagaaatttatccagaagagtccgagctcaaggaggaatagtttgttagtttccttttgtctttaggaaagtgtgtttagtgtccgataaggacttcgtgttttcctgttatctttaggaaagtttctttcttgtcctacaaagactagtatctacccatgtgtataaatatgtacacccggggtcattataatctatcaatctctcgatcaatacaactactctccgcgtatcgccaccttctttactgaggtttttacttccatccggcggaacttggcacctgacgcggggctgcatcggctttccatctctggcgaaggggtaagtcctacgttccgctggccctggtgaatctaccgactacattggtgttgttcaagactgcatcgcttcgatctcttggatcgctctggtttggttgatatatttgcctacctgatatctcaattctatccctaattgcattctgtttagagacacatcggtttagttgggactgtctcggttaggtctgatcttttgtcttagccgatatatctctacaatcacaatactctacaatcacattagacagatctatcggcttatcgagtatgagattatcatatacaatctcgtgctgcatcggttagtttcgacctactagattgttgttgataatataaatcttactaagtcgataggttcatgctaatgttttattggtgtgctagccgataagttatctggacgtggcatcggcttataaggattgcatatacatataagttggatttagcggatgacaacaaaggtttattgatttatctaaccttgtggattttatgacatcggacctccagtcgatgtatggtttaaccatcggaacagtacttgttctatcatatcatattgttagccgattggtttgtaaaggattatattgttgttatattgcgtcatcatcagccgactgcctttatatcattatcttcattggacatattgtcgatagctcaaaaccctatcggcatcgactaatatcggctatcggctggaactgctccatcggcttgtcagccgatcggctcattgatatactatttgcatattttgtcagttgcaggatcaaactgacgggcacacccacatatcgtcaacctttggacctacactggagctaagcagatctcccaagccagtgtgtgtttttcgagtcaatttttggcacgcccggtgggacacaagttttgcacccaacatgtctgaagaggaagtcaataccaagaagtagcaatctcgcaagccgatggttgaaacacttcaagatacagttgatgaagcaattcatcgcgcattgtttaatcaatctggagttttggcggatacattacaaagtttgatcaaggtaacagttgatgagttaattattcaaaaaagtcagctcggggggtagattgaagaacaacatcagcatcggctcggggggcaagcacatcggtgtcagcatgatgaggcatatcaacaatatcggccagaaggaattcaaagatatcattatagggaagatttggccaatagaattgcaaaggtaatagaggagcagtttggaatcaatcctaaggaacatacttctgtgtatcggctgccatatgccgagtggtttgatagggttccattgccacaccgatagttccaaattactccaaattttcagggcaagatgatatatctacaggaacaaatcagccaattcttagtgcaatgtggggaagcaacggctgaggaagctctgagagttagattttttccactgtgtttgactggatcagccttcacatggttttcatcactaccatcgaattctattggaggatgggccaatcttgagaagcaatttcatgactatttctttgctggcatcgatgagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgtcctacaaggactagtatctacccatgggtataaatatgtacacccggggtcattgtaatctatcaatctctcaatcaatacaactactctcggcgcatcaccaccctctttactaaggtttttacttgtcatctgacgttacttggcacctgacgtggggttgcatcagctttccatctccggcgaaggggtaagtcctacgttccgctggccctggtgaatctgttgactacattggtgttgttcaagggtgcatcgcttcgatctcttggatcgctctggtttggttgatatatttgcctacctgatacctcaattctatccctaattgcattgtgtttagagacgcatcggtttagttgggactggctcggttaggtctgatcttctgtcttagccgatatatctctacaatcacaatgatgttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggcttaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatgttttatcggggtgctagccgataagttatctggatgttgcatcggcttataaggattgcatatacatataagttgtatttagccgttgacaacaaaggtttcattgatttatctaatcttgtggattttatgacatcggacctccagccaatgcatgctttaaccatcggatcagtacttgttctatcatatcatcttgttagccgattagtttctactggattatattgttgttatattgcatcatcatcagccgactgcctttatatcattatctacatttgacatattgccaatagctcaaaaccctatcggcatcggctaatatcggctatcgactgaaactactccatcggcttgtcagccgatcggctcattaatctactatttgcatatctaccctatagttaaacaaatgattttattcatttactcattcatcatatcacatatctaacggtgtaaaatcatccgatgtgttagatcggacgtcccacatgggcgcgtgtcggtcctcatcctctcccgcacccccccccccctctctctctctctctatttgccgcaatcgacgcgcctcctccgcatcggcgcgaccgcgcatcctctcccgcatctccctctcttccggattcgccgtgcctcctccgcatccctcccctccgggtcaggatcgagcgccgcctcgcgcaggggttcaccggcctgctgcaagcgcatcctccgcagttcccgtggccggcggcgtcgcacaagcggattcccttcaagatcgacctccccgtggtccccttcggcccctccc

SEQ ID NO: 78611 - DNA, 2328 bp, Oryza sativa
aaatgtcaaggcgatcacgatgaggggaggtaagtctactcgtgatccgccgtatcctaaccctgcaggaactagtgggatatcaaaagaagcgccatctaatgactcggctgacaaggaagttcaaccagaaaagtcagtgccgcaggagtattgtgacacacggttgctgcgttccctcacggagtaggaaaccgtcggtggacgagcaattcgctcgttttgttaaagtaatctagaagatccacatcaacgtgccgttgttggacgctatgcaagtgccaacatacgcccgttatctcaaggatatactcaacaacagagaccgctcctaacaacggaggtggtcaagctgatagaacaatgcagcaacttgatactccacaagctcctagaaaagaagaaagatccggggtgtcctacgatcatatgctcgatcggggcacaacaattcgaccaggccttgtgcgaccttggagctagtgtcagcgtcatgccgaaagacgtcttcgacaagctcaacttcacggtgttggcaccaacaccgatgcgccttcaactggctgactcgtcagtccgttacccagtagggatagcggaggatgtgccagtcaagatacgggatttcttcatcacggttgacttcgtggtactggacatggacacgggaaaagaaacgccggtcatcctggggcgtccgttccttagtaccgcagtagccaacattgacgtgggaacagggagtatccgttttcatattaacgggaaggaggaaaagtttgagtttcaaccgaggacagaacaatgctccgtggtcagaatcaagtacgggccaaacccgtagaatattcaagtggtcgaagtggagccacccaaaatggacagcctggtgaaattcatgcagaatttcctagagaaggaaataacgatgcccaagcaccgttattggaagacgccggtaaaaccacccataccggccaagaagttagagcagccggctcagaagaagccgtcttccgcaccaaagccgaagaaggtgtggaaggaaaagccaaagacgcccgctccatcacccccgaagatgggtggaactaaatcagaaggaggtatggtcttgcacgtcggactttaaatgacgcgagcttcgccaacaggtaaattggtatgtatccgcaaattttctttcaacaatttgaatttttgcatcaacatatgtttgaacttcaaaattgcatttatgaattttgaggaaattcttcaaatgaatctttcaaagcaaaccaaaataaaattttcaatgtaaatttgctgtgccacgaccacactgaccgttggaatccaacggccaaaagtggggccggttgggcccaccaggggttcggccgaaccagtgactggccaggccaacggtcggctgcctctctttttgaggcaatggttagtgggccccacaggtcagttttgatcgttgtgggtgcacttcttaagccaaccggccgggagagggaactccaccctgtttaaacacattttcattccctctccaaagtttgctctcaagttcaatcaagctttgatggtttccctcaaattcaaatacttagttgcatatatacaagttgcttgggtgaaactaaccggcgggtgaaattcttgtcattcctaattaacccccgccgagttagtccgttcttgttccattgtgcagaatgaggaggcgactgtctcgtctgttcaaggggtccggctcttcatcaagtcatcatgacgagtctagtactcgttcatcagcagatgtctcgatggaagatgccgaagctctgaggcgactcctaaacgacaccgacctcgaacttgtcagtgatcgggagagacaaacctactacatgctgagcgaccaggagtatgctcacacgcgagagtactcaccggagctgctaaaaaagataggtatggatgttgagtttcactctatttggaaagctgttgattggtagagatttgctgtggtagatgagcctggttctcgtctgcttactttgcaatttctgtacactttgaaagaaatagaagatggtatttcctctcgctttttccgtgaggagttcacacttacatggaaaggcttaagtacacttcttggttttcacgattcctgtaaaatcgatatccagaaaggaatttctgggttcgagaaaaataggttttaggaagatatttctggtggtccaatttgcaagaaacctaggacgaatgatatccataatcctacacttaggctcatgcacaaatggattgctatgactttgtttccttgaggtgatctta

SEQ ID NO: 78612 - DNA, 719 bp, Oryza sativa
tacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacactatgtcatgacgatgatattagagtagtatctggtagtttaggcgtggtgtctagattacgggatatcattatttggagttatatattgcggatgagaggtgggccgctgatggtgacagctcagtacgggtattcctccacgccggtatataatcctaagttaatttcctagggagggtattcctccatatttagccccggttgtatggtcatgacgggctgtcgtaaggaactcggcagtcaggggtggcttctcgaagtaccaggaggacatcggatagagggtattagctagtatatcggtaactagaatgtatgtatactatgtatattagaagtataggaatagattttcttcctcttttctatctacttagct

SEQ ID NO: 78613 - DNA, 19667 bp, Oryza sativa
cacattcaatactatggtgatcatataatttggagtacatgtttagaaaaaaaaactaatgcactaaacacaatgatgatttgaatgaatcaattattgctgacgatcgcatctgaatcaatggtagtttacccttgaatgatttgtctctgttcttctatgtttggtggtggtggtattatatacatgtttagacaaaaaaactaatgcagtataatttgcatatgttcttctgttcggttaccggaactatcataatacatttattcgtcaccattttctgatgcttgttatataaatatgagcatctctttcagtgatatcctctaaatatgtttcctgtgacatcctctaaattcacaatggaaacgtgttactgattcgaagtctcaatgcagtgacatgtttatttggacacatgtataattggagtacatgcatttgtgataagtttccttggtaaatgcaatgtgttcttcatcattgtcaattattctaggaggccttgatatgtcagttaccggattcatggccattgttccacaccctaggaattatttgaagggcaatatttttatgaagcttaaagattgaatttgaatccatctgccctggcttgaaggtgaacatgattttatttttaagattgcattttagttactcttaacatactccagttactcaatcatatacatatctgtttcacacatgatctatttatgcacttttgtcgcgtttagtctaaaacgatgctgtcaaattttaaaagggcattgctttactaaattgtggtgtatgtagtattagcatgtcaaattacatttatgcgtttcttgcttcccgaccatatgtcaaataactgaaagtgttagtacttgagttaacccttttttcatacttatgccatatagcaccctaattttgttcatgcgatcagaggataaaatattaagaggattctttagtatggctcattttattgtttctaagtttagggttattcagacagataacactttagctttctatataatattggttttacaactttgtctctcgaaggttttttttttttggaacgtattgatggttttcctcataatatgctcttgaaatccatcttgtccctgttcaatgcagtacaatccaaatattatggtatatcaacagcagcttcagtctgggacagagcaatacaaggtcctccctgtaagtttagtatgaacagtgcaatcaaatttataagtcttccctatcaaaatttcagtatagccccatttgtgctggtctgattaattatctttgaaatgatattctgctttgagattaaattacatgtaactaacttgctttgataccttcacaagtcgtgaaatggtttagctgtacttccatgtttgggttacttgtgtaatatttggtaggctataaacccatttgttgtgcctttttttttattatattgctcaataaagatagtcaatcaatgtgttgtaaataataagggaattggcttgtatcatttgtttcttctatgctcaagatcctgaactgttgtgcatgtatcatttgttgccactgagtcattatttggattcatcagagaacatccatcattttgattaccagactatggactgatttatgccatgcttgctaattgatagagggacatttgctacttctgcatataggacagataattaaactttttgtgcgctgaaatgctctttgtacggtgagtatatgacacgctaaagatgactgaaattaaacttaggatacttctgtttgcaactataagacatgagttcttttgctatatttctggataggtggagtaggttttatttttaagagtttggtctgtggattttcgtctgccgatgagtctccaatgtttgatacagtgtagcccatgagcagctgctgttttctgattttttttttcaaggtaatgtagctgctttgtgtatatgtgtttgtccaatagtgcctgccattccctttggatggtttgcattgcagatgaattacgattgccatctcatgttgctatggcactatgctaagtgaatcttgttcacttcctttattcaagcacaaggaatttatgtatgttcattatgaaatctgtaagttagataatgaacatacataaattcactagctgttgtgttatcacattgattgtaacatcaaaacaatcaactactagaaaatactaaagtttctaaatggttatcagaacacactggaatttttttatgggcttactgttccacactgcattccttcacaattgaagtttgccatctcttatggcactcttttagcttgataatctgaaaaaatagatgactaaatctatagtttccttttatccaggaggagatttggcttttcagtatgcttcagtaaggatttagcagatggcaatctttgctggtatgtagagtatttcattaggctaatcgcctatttgttgatgatcataattggcacataaattgataaatttgtattgatgattctactcattttaaatgttatatgggagcatcctttgtttgataaggaaaaatcagtgttctttgcatattcaattagagaagagcatgaatactgttgttactctaggaagaatgcttatattatgaaaggagcgctaacattgcgttgagaaaacaacaggtgatgttatctttttctgatttccttatattgcagtctgttagcaaggagcatcaagagttcctcggccttgtcgacaaagaggtataatgtgaacttgtaaattgatattagagtgacaattattcatgcagttatcttccatttttattgcaaatacttgggagggctcaataactcttggtctttgttgaatgcagattgaattatattatatactaatggaattccgccggcggtgtgaggcccactcagagtaggatttggagggtgcagaactgtttttgcattgccaatgaaaggaggaagaccgcctcaaagagccttgtccccatccaccaacatggtcatgataatcgttgacatcgaccaagatctctccagggtaagtagaacagcactaaaattaggattagcatttctagacaccatgttatttcagaaattgattagttggaatcttgtattcattttgctagcctgagtgcctaacttagtggaaatatattggaaaagtttctccatggcagattgaggctgttatttcctgtagatttaggtttcgctgtaaatactgaacaattattgcaattttctatttgtattgagtacttgggtggttctttctatcaaccaaatcaatttttattcatcagtgtagactctttgaactgcaattgttgtgctgctgatatgtgttatgtaggctgcagcagaaggtcaattttcccttttgtgaggtgccataattttgaaaatatgttaattttgtcaattgcttgatattaagtggagtatctcctttgtatgcaccaaccaattttggagctccagacaatgaaacgatagcttcataatatccatgaaaaagtgctattggatgaatccagtaaagatgtgttttctctggcattttgaatattgaagtgtgctgatgactttgtaattactaataatgatgcaatgcataaattctatggccggttctgttacttctttttatttggacgtaatttgcttgaaagatttttgatgtggctaaaggagaaatttttttaaggcatttggtttctcaggagtttaggagttggaaccatgcaaacatgcctcatgctaatgtcttcctgagctttcagaaatcgaagttatttctagcttaagatgatgttggagctgatcctggtgctgttagagaggccaatctattcaggtccagcagtttacatcaagatgatgttctttctagcgatgcatgtagtgaccattgatgtttcgattgcttgaggcgaccctctttgtaattgtgaaaaatgtggtgttatgaaacaaaaatatagatttacatccaggagataaaattattttattctgtattttagagtaacacggtatagctactggtgctatccatctctggacctgattttttttctgcatgatttaaaatttgttatttaaactgaacttttttttcttgactttaaaatttatctcattttatactttcaagatatataaaatattttgatttttttaattttgcattatcaaatattgtcgtagcgttagcacgtgcatattactagtcttgtcagttgcaggatcaaactgagtggcacgtacgtatatcgtcaacctttggacctgcactagatctaagcagatctcccaggccagtgtgtgttttccgtgtctaaaacgttcccttggattcgatacccttagaatacttcgtaaaggaagtgctacatcggtatatccgtgcgcttgcggattttatctgtgaccgtaagaattaccaacaagaatttctggcaccattgccggggaattgttgcttatcattttcgaacccagttcatcctcgtatctcttttcattttttttattctacctttacccttgctatccagagaagtattccttttaaattcttctcgaccatggagcaatctcttttcgagctgtctgctcctaagagcgaattctatgaaccacctccttcatcggagccaatttacacctccttcatcggagccaatttatacaactagctatgaaattcgctccgaactaatcgtatggttagtgaaaaaactttttctagccttgatctagaaaaccacaaccatcatatgtgggactttaagctaagtctgctcatgccttaagattcgtggcatgaagcaagaaaccgtacagtggaaattgtttccgttctcccttcaagacagagcgaagcaatggtacacctctaccattggatgtgtaaacagtagttgggaaaagctgcgagacaaattttgtcttgccttcttcccagatactcgtattactgcccttcgagaagaaattctcagtttccggcagattgaaagcgaatcaatcggtgcagcctggtccagattcactaatttagtgcagtccggaccaaccatgtccttacccgagtatgtgcttttgcaacatttttatacaggtctggataaggagtctgcattttatctggatataattgctggaggatcattcatgcataaaacaccgtcagaaggaaaagtaattctagatcgcattctagaaaatacttccatcatgacgcaatgcgatgaaccccagctagaggcatccgtgtccataatagaggaaccttcaacaatcgagtcacaatctgaaccttccacttccaccgactcgattgatgaaaaagttcccgagccgccatccgttgagaatgaagaaattcagattccggatggtgcctataaaaggacatcaccttctcacttcactcacacacctcaagcaatagcttctcatttgtctcaagtttagtttagtactatctagctggtggaataggaatagagtagaaatcaggagttcggaagccttcggaagagtttgggtatgtttctattagcttttctcttctcttttgtaagctttgtacttttattagaatactcttctaaatacatttatggtattgaaatactttccgagaatatgagcacctactttacattatgttcatgttatactaaatatacggctagcttatctgggagatgctttggtgtggatataatgtttgcttatgcaattactctatgtcataacgatgatattagagtagtatctggtagtttagacgtattgtctagattacgggatatcattatttggggttatatattgcggatgagaggtgggccactgatggtgacagctcagtacgggtattcctccgcgccggtatataatcctaagttaattccatggggagggtattccttcgtatttagccccgattgtatggtcatgacgggctgtcgtaaggaactcggcagtcaggggtggcttctcgaagtaccaggagggcatcggatagaatgtcggttaactagaatgtatgtatactatgtatattagaagtataggaatagattttcttcctattttctttccacttagcttagattataaagtatgagaatgagtagttaacgcttgtgtgtcactctacccttggattatcttaacccctgcttagaatatgattatcaccctcatatataaattattagtcaatgttctctctacatgatattcccacgggataaaataaatacgatacccttggaatactctcgggtgaaatgctacaatggtatatccgtgcgcttgcggatgaactctgtaaccataatataccagaagtgtttctacgccattactgggaattatatttctagtaatgtcgttaagaaataccaacaagcatttctggcgccgttgccggggattatatttctagtaatgtcgttaagaaataccaacaagcatttctgacgctttcttccggagcgtcaggcctcaagtagttgctccgcagaaaactctaccgacaaagaaaccaaccgtaccagcgccaccgacgttcaagactatggctaacaagactctccacgagttcgctgctccctctgctgacaatgtggtcattgggccacaggtgaacataggcgacgtggatttcgacttgaactctagcctcatcacgatggcgcaggctagcccgttttgtggcaagcctaatgaggatgccaatgctcatctgcaacagttcctgaagatctgtagcatgtacaccatcaagggcgtcagtcccgacaccatcaggctacgactatttctgttctcccttcttgagagagcgaagcagtggttctatgccaaccgtgctgctgtcaacacctgggacaaatgctctagggcatttctctcgaaattcttcccgatgggcaaaaccaatgcccttcatggaaggatttccagtttccagcagacaagagatgagtctattcttgaagcatgggagcgtctacaggagtaagtggccgcctgtcctcatcatgggatggacgactagctgatcctgcagaacttttacaatggactcaccccgatgtcccgctatcacctcgacgcggcagctggaggagccttcttctctaaaatggttcaaggagccgttgaactaatagagaagatggtctccaatatgggttggaacgaggaacgacttcagatgcgtcagcgaggcatgcacaccgtcaaggagtcggagttacttgctgccaagctggacctcctcatgaaatgcttggacgaccacgagaaacggccacaaggcaccgtcaaggccttggactctcacgtcacatgtgaggtctgcggcaacacaggtcattctgggaatgactacccggaaacccgtgaggaggcgatgtacatgggcaacaacaatgggtatcgttcacaaggaggttaggggtggaaccaaccacgcctatattatcaaggaggtaacaacaacggtaatttttctaacagccctccttgaaggatctcgtttttgcgcaagctaaaaccaccgatgcattaagcaaaaagcttgcggccaatgataagatcctagaaaacattaatgtcaagttagatggcttcgcttctgcttttcaaaaccagctgagcttcaataaaatgatagaaacccagctagctcagttggcatccttaaaccctgcaaatgaaactgggaggattctggggcgacccgactcgtgaggaggtaaagtcaaggcgatcacgacgagaggatgtaagtccactcgtgatccgctatatcctaaccctgtaggaactaacgggatatcaaaacaagcgccatctagtgactcggctgacaaagaggttcagccagagaagaccgtgccgcaggaatactgcgacacacggttgctgccgtttccccaacggtgtaggaaaccgtcagtggacgagcaattcgctcgttttgttgaagtaatccagaagatccatatcaacgtgtcgttgttggatgctatgcaagtaccaacatacacccgttatctcaaggacatagtcaacaacaagagaccgctcccaacaacagaggtggtcaagcaatgcagcaacgtgatactccacaagctcccggagaagaagaaaaatcaggggtgtcctacgatcacttgctagatcggggcacaacaattcgaccaggccttatacgacctgggagccagtgtcagcatcatgccgaaagacgtcttcgatagactcaacttcacagtgttggcaccaacaccgatgcgccttcaactggctgattcgtcagtccgttacccggcagggatagcggaggatgtgtcagtcaagacacgggatttctttatcccggttgacttcgtggtgctggacatggacacgggaaaagagacgccgctcatcctggggcgcccgttccacgtcaacggcaaggaagagaagtttgagtttcaaccgaggacggaacaatactccatggtcagaataaagtatgggccgaacccacagaatatccaagaggtcgaagtggagccacccaaaatggacagcctggtgaaatttatgcagaatttcatggagaaggaaacaactatgcctaagaaccgttattggaagatgccggtagaaccacccatactggccaagaaactagagcagccggctcagaagaagccgccatccgcaccaaaaccaaagaaggtgtggaggaagaagccaaagacgcccactccatcacctccggagacgggtggaaaatccgctaactgattcagaaggaggtacggtctcgcaagtcggactttaaatgacgcgaccttcgccaacaggtaaattggtatgtatccgcatatttgctttcaacaatttgaatttttgcatcatcatatatttgaacttcaaaattgcatttaggatttttgaattttgaggaaattcttcaaatgaatcttttagagcaaaccgaaataaaattttcaacgaatattcgctatgccaagaccacactgatcattggaatccaacggccgaaagtggggccggttgggcccaccaggggttcggccgaacaaccggccaggcaacggttacctgctacttttggcaaggtaacggctagtgggtcccacatgtcatttctgactgttatgggtaccctataaaagccagccagccgggagagggaactccaccccatttcaacacattttcattccctctccaaagtttgctctcaagttcattcaagttttgattgtttccctcaaattaaaatatttagttgcatgtatacaagttgctttggtgaaactaaccggcgtgtgaaattcttgtcatctctaacccccgccgagttactccgttcttgctccattgtgcagaatgaggaggcgactgtctcgtctgttcaaggggtccggctcttcatcaagtcgtcatgacgagtctagtactcattcatcagcagatgttttgatggaagacgccgaagctccgcgacgactcctgaacgacaccgacctcgaccttgtcagtgatcggaagagacaagcctactacatgctgagcgaccgggagtatgctcacacgcgagaatactcaccggagctgctgaaaaagataggtattgaagttgaatttcgttctatttggaaagcggttggttggcagagatttattgtggtagatgagcttggttctcgtttgcttactttgcaatttctgtgcactatgaaagaaatagaagatgaaatttcctttcgttttttccataaggagtacacacttacatggaaaggcttaagtacacttcttggttttcacgattcctgtaaagtcgatctccagaaaggaatttcagggttcgagaaaaataggttttgggaagacatttctggtgctccaatttgcaagaaacctagaacgaatgatattcataatcctacacttaggctcatgcacaaatggattactatgactttgtttcctagaagtgatatgagacccattaggggagatgaattaattatcatgtttgccatggttagaaaaatcaaaatttctcctgtgaaatgtatgataaggcaatggttagaaagtataaagttctctgctcctgttgagtgcacttctctgattactcggatagcaaaagggcttggggtcgttagcgaccaaattgcttttatctcagccgctcgtccgcgtattgatgaggcttatctagtgcaagggcatattttgaagcatggagcagatggatctttgatatacttttttcccggttgtacaaataaaatcccgttgccaagtacggggtatcatttgtacaactgccatgaactaaccattctcctgcagaccatacaagaatctcgtgcaggtggaacatatagggagacgcgcaacatgataaggaacgaacaagaaagttcatcatcctcaacacccgtgcagatgtatgaggcaggtgttacagaaaaactcaaagactgacattactattccttaccatgtttttgtcactgacttcctgttgcagcttcgcgcatactgcaattcccacatgacatcgtgtttcatagaaatgttggtttgcactatctgaatatatccttgttttatcctatatgttaattctgctagctatttccttggaatgatttgaagaaatcattttctcttgaaagggaactgtaatgaaaaaaagaactaaagtgataaattccaatttaaaaccttacatgcgattgatgcacaaaaattatcacataatttagttgcaaaactttctctggttaaccttatatattacactaattgaatgaactgaatttgccagttaatcaaaacatcttgtggctaatctcgaacaatgtcaaattagattacgctaaacaaatatagttgtattcgtgtttatatcctttgttaattctctttccccagtagatgatatgtgggaatagtgtatattttgtcaaagataactacatgaaaaaaatcaataatttgtcatactctgtcacaatgtgttgaattgtagttataaaattttatctagtagagcggttaattttatcgtgcaaatgatataaaactaaagttacagaaatatctcccagctgtactgctggacaaagggtttttaaccccggtttataaccccctatagtcccggttatgcaaccgggactacgaatacaggactacagatacccatctttagtcctagttaaaataaccatgattaaaaatatccatttttaggcccgattggtgttaccaaccggaactaaagatggagccaggccagctccagttggtagattttttttctttttttcattgttttaactttgaatattcatttcactacttccccaaatcatccccaaatcgatcatcgcagaaaaaagtatcatctctaaatctctaaattgatcatatccaaatacatcacaaattctaaaaaaaacatcacaaatacttcacatattcacatcacacacaaatcaaatacatcacagattatacatctcagatccatgcaatgaatcacaaattctcaaaaaaaagaacaaaaacaattttgcgatgtcgctgccgcctcctctctggcagaggcgccggccgcccgccgccgcccgcccgtcctactcgctcgccctctggcctgcttgcttgagaggataagaatagagagaggaaagggagaggataagaaaaaagaggaggataaagaagaggtgattgctagaggataagtgctagggattatatactatgcaccgatttttagtcccagttggtatttccaaccgggaataaaaagaatagggggcatacacttttttaaccaggactaaaaacgatctttagtaccaaccagactaaagatcataaaatagctatgggcttttcaaccggggctaaagatgatttttagtctgggttctttttggaaccggggctattaattgtggttttcggctaagccaacaaagattagttctccagtagggttgatagcataaactttagatggcacatgtgttatatcgtggtcaatattatattatctggttcttattatgcatgttggcaaagtattctcagccattatccatttctttttattgctggtgtcagtttaaattaattatattagtgctctttcaccgtgtcgtctattcaacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttagtataccctcgggtatccaaaatattagaaaagtatcttaaatttgtatgagaaaatatagtacattgtactttctgaagaagatctaaatgatcattaaataaataaatatttaatcaacgtgcaaataaatacaaatatttccacccgtactcacatatggtatggtaagtggcaaagagtaaatgaaccctgtgaatcttattacctgactgaattggtcaggttagctagtataacatgcatagcctggttcgtccttattgtggttttccacgtgtttgtctctgtgtttgtaacatgtcgtgctgatcaggtttcaactatgaggaaggtagagctatctgcatgtacagacacaaggtgactgtagtgcttgggaagtgaggatgaagatgtcatcttccctcacctatctacaaattaagctcttagtactgacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatttgatggatccagcaaggtactggatcttggccaggaggaagctgggagatcagaaggcgcctctcttccccacccctcacatcaccatcggcgccggcggcagctccacctcctactacgagtcatgggaggaacgtgccttcgcggaagactccgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggcggcgaaagccacggcatgccgccaaaccaaaactacatgatacaaccatgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttgcattgatgcacgaaaattatcacataatgtagttccaaactttctctggttaaccttatatattacactaattgaatgaactgaattgccagttattcaaaacatcttgcggctgatctcaaacaatgtcaaattagattacgctaaacaaatatagttgtattcttgttttatatcctatgctaattctcttaccccccatagatgatctgtggaaatagtgtatatttcttcaaagataccacatgaaaaaaaatcaaaaatttgtcatactctgtcacaatgtgttgaattgtagttataaaattttatgtagtagaccggttaaataaatatttattatcattgacagaaatatctttcaactgatatcagctgatagcataaactttagattgcatgtgttttatcgtggccaatattatctggttcttattgtgcatgttggcaaagtattctcagccattatctatttatttttattgctggtgtcagtttaaattaattagtgctctttcaccgtatcctctattcaacgtgcaagtatatgaatatcgaacaattaataatcacttcattaaaactcatatgacctcagcttctataacaacggaaatctatcaaaagatcaatattcaattacagtattaactatgtcgcgtatatatctgaactttcgtattggtagtttattttcaatatcatggaaaacatgtgtattttttcccctgccaggtgagatttatactagtataatatctaagaagtttcttaacattcacggtaccacattttttttagtgataatatgtccttagtacccttgggtatccaaaatattagaaagtatcttaaatttgtttgagaaaatatggtactttgtagtttctgaagaggatctcaatgatcattaaaaaaataaatatttaatattcaaccagcaagtaaatacaaatatttccatccgtaaggagtaaatcaagcctgtgtatcttattacctgactgaattggtctggttagctagtataacatgcatagcctggttcatccttattgttgttttcctcgtgtttatctctgtgtttttaacatgtcatgctgatcagctttcaactatgaggaaggtagagctatctgcatgtacagacacaaggtgactgtagtgcttggcaagtgaggatgaagatgtcatcttccctcccctgtctacaaattaagctctcagtactgacacattccagcagttaaaccatgcacatgcatatgatgcagaacatgctctctagtatatatttcctctgatgcattcctgcagctagcagtacttgcacggattccattctctacagtacatattcccttctcatttctccatgctactctttgttttcattttctcttcccaacaaaaaacatgtataccagaagacattcatatatatatatatagctcttgtattcatcatctgatagaatatacagtttcaatcgggttctgcgctcagtttgttcccttctttgcgcagccttgagtacagacacaagccccatccctagctagccttaacttttccattgcatatgagaacaggctaagtttccctgtgatctgcagagaatttaacaaacaagacagtgattgcatccaggaaagtgcagtacagcacgcacaagcaacatacgggcgatcagaaatatactagctagatgtcaactgtgactacatttagaggcccggtttagttcctacgcaaaaacttttcatcctgtcatatcgaatgtttagacacatgcatgaaatattaaatatacacaaaaagataaaactaattagacacattgcgtgtaaattacgagacaaatcatttaagcctaattgctccataatttgacaacgaggtgctacagtaaacatttgctaatgacgaattaattaggcttaataaattcatctcgcaatttacaggtggaatctgtaatttgttttgttattagtctacgtttaatattttaaatatgtgttcatatatccgatgtgacacactgaaacttttcacccttagatctaaacacggtcatagatgaatttaagaacatccttgtgtgcaccagctgtggcctcctgcaccaggaggccacggcattggcaacccgctgatttctcagtgttacagaagttttcagaaatcgtgaaggggcagcgcatgcatatgcatggtttgaaacctacaggctttcatgaatggctgcagtcaattaacttttacacttctctagaaacccggcaaatgatcaggataggtctgtaaagagtatactcaataaattaaaggagtactcaaattaagtgtgcaagctagcttctgtgtgctggccgctgcagatgcgagtatcattagtacagagatgcacttaactgtgcttgttttgatcgagagctggatgcgcgctcctggacaagtctgttcagtgagtccaacagcttgaagtgtactgaagggttgtctgcaagtgagctatagctaagctaatcagtttagtagtcatgcaaaatactatagtatatatggatgcacatggtcagaggaatgtctgtttaatagctagctagttacagggtatgttgctgtgtgattaattaactataacatttatatgtcctattctgtggtgcaaatgagattattagagctagcgtgttgtgtgaggggatggtggttggttagagcggattttatattttatggatgctatatagtactgcaagcaccatatatagtactggggagatgtctttaataatcgtgtgggagggaatatggaatcaaatgcactgatcgcaacaggtatattttaatcgaacaattgtactggatatgcgtatgtcgttagggttgagaaagacaaatacgcctttaggatatttggaaacgaaattatattttatggtatcaatactactagaaaaatggtctttagcgacgttggccatttatttttgcagatgggtaggcacctaaaaaccggagcaccacctaggataaatgataccggggccatggttttgttccgcctgcgaagatagatctttgtaggcggaccaagcgagccgcctgtaaagctccatcttcgcaggcggaccacataagggaccgcctgcgattattctaggtggtctaattatgtggtccgcctgcgaagatggaacttcgtaggtgcccatttggtgccgtttgcaaaaatcttcgcaggcgaccatttttcgtcgcatgcaaaaatcaggccggctatatagtcttgttcctccccgagcttctattcatatctgacgattttcactatcttaaaggcaccaaaatataggggtaggttttgaacttcaaattttcgagggatttttctacagtgattagatctatgcctttgcactctatatacatagttttttggtaatttaaacctccttttaggatggatctatgcatgtaaaatagtgaggggaaaagctagctcccatgattgtgttctcttttttttttttgtattttgctttgatatgtgtgttggatttatgtggtttcttgatgctatggggttctctcatcttctagtgattttataatgtaatataatggaataaaattatatacattgctcttatctatttgcctagatctagataggagagaaaacttcatgacatgtaaaaaataattattatgtttaatttccaatggtatgtttttgttggttttatgtatactctttgatgtcatgtggtcgtcccatcatctagtttgttaaatatgatatgttaatttcaaaatgttatatttgatttcataattgtttactaatattatgtagaaataagaatatatagtatgtaaggctcaaatgtatgatgctatcaaggctgaaattactcgattatatgatgctggttttattcggccgtgccgatatgccgagtgggtttctaatatagttccggttatcaagaagaacggcaaatttagggtgtgcattgattttcgagatctaaataaggctacacctaaggatgagtacccaatgccgatcgccgatcaattggttgatgctgcttcaggacataagattataagttttatggatggcaatgctggttacaatcaaatttttatggcagaagaagacattcacaagactgctttcagatgtcctggtgcaatcggcttatttgagtgggttgtgatgacttttggtttgaagagtgctgaagctacatatcagagggccatgaattacataatccatgatctgattggcttgttggtagaggtctatatcgatgatgtggtttttaaatcaaagcaggtggaggaccatatagccgatttgaggaaagtttttgagagaaccagaaagtatggtttaaagatgaatccaacaaagtgtgcttttggtgtatcggttggacaatttttgtgttttcttgttcatgagagaggaattgaggtccctcaaaggagtattaatgccatcaagaaaatttaacctccggaatataagacgcaactacaatcgtgatcggcaagattaattttgttcgaaggtttatatctaacttgtctggaaggttagaaccttttacacctt

SEQ ID NO: 78614 - DNA, 693 bp, Oryza sativa
caccagtcggcggcggcgaaggcaagccggtcggtgaagacgtagtcgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaat

SEQ ID NO: 78615 - DNA, 18253 bp, Oryza sativa
ccccatcgtgatgattcaatcggctcggttgaaattgtgcccttgactttattcgttgatggatcggtttgtactcatgattgtggtatcagcttggttataatctctcctcggggggcaagttttgaatttgcttatactattaaacttgtttgtatgataatttggcttatagttagtgcatgtgtgaaggacagattggtttagaattgatgatacaactgtcaaatgattcacttggaaaatctactccgtttacaggtgtaggaaattgtgatgcatcggtcatatgtgatagtattgactaaatgaatatagaccgatgtagtttataatattgtggcctgtgcaagctgattacatatatatgcatatgtatatttggtttttatgcaggctacagaagctatacagggcgtggtcacattacgttaatcacggaggcaggtgattatccctaattgggtgattaagtggcaagggaatccttcgttgctcctgcagatggaaagtcaggtgtcgtatttactgagccaaagagtctacatcgtcatcgagcgagccaggggctcagacgtgtggctgtgatgggagtgctgcttgcgtggatgtgatggtattcgctggatccaaccatcgcgtggcatctgcgttgagagcagggctccggcgaccgagccaagccgcgtgcgatatttatcaagttagaagataaagattttgttacatcgaattgtttcaaatattccggtaaaccatcgttgcatattgcgtgggaccgagtagaaatgccaaaagatcatggcaattagctatatatattggtccacggtagaatagaagggaacccgaacaatttcaatctaatattcatctcttttacttcttagttcttttctattttgttttcatggctgagttctagcaaccctataatatagttaatctttgctgttttatgctgaaaaacgatcgtgcttgtccacgaaagcgagaagcttatcctttgctagtttgctcggaaactagtcgttcatcgtcacgtaagtacgatattatcttctttactaatttgcttgtaaattagtcatgtgattccacgaaagcgatttaatctcgaaatcggtttcactagcagattttgatctagcgattttgacgactctattgaatacaccacaaatcattaggtcatattgtattagcaaaaaaaagcgtcaacatatcttggcgactccactggtgaaaacaatttcggtcctgcgattcaaccgaaatcaatctactgtgcatttttgtcagctgcacgccgaattgatctattcggtggcggcggccagtcagtcctgcttcggtatcgtttcgccattcggcgacgctatctaatctcatcacaagcttgcaatattcacacgatcaggcagatcaagagttgactttgttttgtttcttcgcacggcacaatagcaacacacgcgcaggaacataagagataaagaaacgatcaggtcagtgcttgtctctgtatattattttggtatatttgtttggtgtacagattgattgacgaggacatatctaactcggatataaccataactaccttatgtattaatcaaataaagattcatatgttctacattatatttacttgttatatatttgaacaaacgttgctacacaatgacttttgtgtgttttcgtttgcagacgtacttgcttaggcaaaggaaaagagaccgagcgtaactaatgcatggatgattaaagaagttgattggggaccaaaccaaaaccttctccaagtctacttctacctcatcatgtcacttttggcccatagaagacgagataaaattatacatgttttggattcggattcggccctcctgagagcatcaacttaaaatggacctagccgctgatctagaagtaatttttgggcccatgagtacttgttagaaagattatggagtctactttcatatggttttggtcccatgtcaaaattcctaccgagctgccagaaatctgcaaaacaagccacgtatctcatccagtccgaatctgatttgggttttcggccttgtaattgtgtcgtaggcttagcccaagggggtctacgccctagggcaaccgtaggacgtccctaatcttttttatttagtagccgtcatcgtttagagtcaggttttgcttaaattaatctgtcaggaacagtttcgccgatagatcggtttgtgtaaccccaaattcgtgtgcttaatcattcatatgcaatttggttgcaatctatcttgttcttgcttgtattcttcgattcgcatgcagggattagccatctcggcgaggtcaatcgggtttcggcacggttgataaccagaggagacgtggtgctgcgattgcggggctcagtagcgtgttcgttcagaagccggatcgagttgtgtcgcaactccgcccaaatcgactgtttatcagtacctatcggaagatcgggacctaactccctcattagttggtatcagagcgcagttgcccgttagttaatttatgttcccataaccagaaaattgccacataaaaatatttattctttacctggacaatttgagccgttgcattgttctattagattttgctttgttgaattctatgttgcatcgtcgtgtcgagtgctggtttaattttagatttaatttttagttttgagtattgcatctgttcatcacttaggtttagggttcatcactcaagtctgtctgagttgttttaggtccagtttttcatctggttggttgttgccaggaccttgaaaaattgaatcgtctcgtcgttgggtttccgttttcgtagtttccaaaaaattttatcgagcggttagagagttgatttattgctattgcttctgtgttgccgtgcttttggcgcgcagaggggaaaggagggtttatgtgttgccgtgcttgtgggcgcgcaccgaaaaagctattgggcgatcagtcgcgtgcacccctccccgcgcgactggacacatgtcgcgcgcggagaggggcggcggacgcgccgcgcgagaggagggagtagtgagtttttctcgtttcttttcggtttggtttttctttttttttccggtttctcttctgttcggttcttttccctgttttttcaaagatgcatgaatataaagtttgtattcgtatgtatgcaaagtttgtattcgtacatatgcaaagtttgtatacgcgtatgcgaagtttgtataagtgatgtattttctagtttttattgtatttttttaatacatacgtatataaagtttgtatacatcgtatacaaagtttgtacacatcgtatacaaagtttgtatatgtatatatttttttatacataaaaaatatatacatataaatatatatatattatagtagtaatactagtggtagtataatgacaatagtagtagtaatagtagtgtagtagtactactagtagttctgttgtagtactagtactgaactatactagtagtactgatcggctgatcgcgcgtctggagggccgcgcgactagtcgcgtattagggcccctcgggcgcgcacgagtatcagatctattaaatatctcctagaaaatagcatatacagggagagggagagatatatagagttgtggataagggtggaaccaattttgtttggctttttggtctgttcggtcgagtcatccataccgtgactgagttcctctagcacctctctccgtattttcctcaatcaagtattgttacactgaaattcctttagccaatttgagatatttttataaaaacggaacctacatgatatgagcaatccatttttgaggtgacccaattttagttttgcactttgcatttgagtccctataatattcatatttacatttgagtccttgtttgaagtcagtggttcagttcttgttaaaaaaaagtaaaaaaaataaaaaaagaaagaaaaggcagaaaggtgcaaagaaaaggcagaaagccgcacaaaaaaaagggcagaaaggtgcttaaaaaagccgtacctagaaagaaaaaaaaaaatcatcctttgagtatgttttcagagtgcagagttgtgcattgattcatatctagtcattagttttgtcgggtgcttgcttgagctagagttgagtctagactaggccagcacattgactagtactttgaactattattcaactttgcattttctgattagtacaattgcgttcctttgctactatatattgtgcctcccaagctacacatatatacttctggtcagcaccgctgatccttgcaatcgccacatcacgtccttcaaggtgtcacgaactagccaccggttgtaccgtccttagcattgctggtaagacacttgtaagagcttggtaaggtgctccgtttggctgagttgttaaggggcaccactacaccgcgtagcagattattagggataaccttcattgtttgttgttgtttttgtattcttaatgacaggtatgagtcgcgctcaaaatcagcgataccaacaaggtggacgtgatgacagtactttggtgcaacaagtactaagttctcaaatggagaaagcggagcaatggcagtaccacgaattatttgaaacaaagtttgtggttaaggatagagcatgtcgtactataatcgatagtgagagttgtaataactttgtgagtttagatttggttgagaaacttgaattgcctacacaaccgcatcctcatccatattacatcaaatggttcaactcttgtggtaaggtcaaggtaaatagagttgtgagaataaactttttgattggaaattaccatgatactgccaattttgatcttgtccctatgcaagaatgttctttgttgtttggtcaaccatggctatatgataataatggttcgcataattttgttgctaatacatacacatttagacaaaatggtcgaaaaatgaaattggtacccatgagttttactgaaattttcgaagataatcttgaaaggatgaagaatggaatcaaggaaattttcaaagatagtattgaaaggacgaaaaatagaatcgatgtgattttcagagataccaggaaagatactattgtgatgccttcaactaagtctgagttattacaaaacgaacgtaatgttgtgcctattgttttggatactaatattttacaggcatctgagaataaccaaggtaataatgacaaagagaagaaagacgaagaggaaaaagtcctatctatagctccatgcatgtttgaagaatgttcaattgaacaagcgcctataatttctgcagatgagaaaaaaggtaatgataacggtgctacagctactcaaggtatgcatatttatgaggtgccaactatgtctactacttacgctacattagagcaacccatggtggaaacaattgctgaaatacctttgtcacaaaacaatttgcttgatgtttctcgtgacaaagaagagttgtgcgatgcttcacttatatccatgccacaactagtgaatgaacatgctagttctatagtagagccaccaagtgttgagtttaaacatgttattcacattgctagcgagaatgaagaaattaaattgctatcttctttaaatacttggggttatattcaatttgatgatatttgtccactcaactgcttaaagaagaaattatttgctagatttgaattgccatgcccttctgatgtgatttttcatattattggcaattatgaaagtaaaggagaatataatgtgcatcgagtatatatttgttcgaatttgactatacctccttttcatgatgaaatgtattgtctagaggaccgcatgcatataagtaattctctatctagttcctctagttgtttaaatgagttacaagttggtttgcaagaggagtgttgaggttttcgactacaaagattttaggatccaatcatatgtccatcaagaaatgttccgcacaggatgttgtgatagacaaagataagtacaatacactccatgacaaggtgaaaccgaggacggtttccaatcaagaaagggaggatgataagaacataactagctcggatataaccataataactaccttatgtattaattaaataaatgttcatatgttctacattagatttacttgttatatatttatttgaacaaacgttgctacacaatgagttttgtgtgttttcgtttgcagaagtacttgcttgggcgaaggaaaagagaccgagcgtacctaatgcatggataattaaagaagttgattggggaccaaaccaagaccttctccaagtctacttctacctcaccacaacacttttggcccatagaagacgagataaaattctacatgttttggattcggattcgggcctcctaatagcatcaacttcgaacggacctagctgttgatctagaaggaatttcggggcccatgagtacttgttacaaagcttatggagtctaatttcatatggttttggtcccatgtcaaaattcctaccgagctaccgggaatctgcaaaacaagccacgtatctcatccagtccgaatctgatttgggttttgggccttgtaattgtgtcgtgggcttagctcaagggggtgtgcgccctagggaaccctaggacgtccctaatcttttttattcagtagccgtcatcgtttagagtcgggttttgcttagattaatctgtcaagaacagtttcgccgctagatcggtttgtggaaccccaaattcgtgtgcttaatcattcatatgcaatttggttgcaatctatcttgttcttgcttgtgttcttcgatttgcatgcaaggattagccatctcggcgaggtcaatcgggtttcggcacggttgataaccagaggagacgtggtgctgcgattgggaggctcagtagcgtgttcgttcagaagccggatcgagttgtgtggtgactccgcccaaatcgactgtttatcagtacctatcgaaagatcgggacctaacattccctcatcattgattgcaccagaaaaatacatggatgcgtactggagtgctacgtggtcaccttgctatgccagttgtgaggtacactctacagacacattgctcgttccacaaaataattcttcaagtgccatcaacactcatgtcaatgttgctagatatgctttaaatcaatgttcaagatctttaaattatgagaataacaagtcacagcctatgcaaaataattcacatgctttaaattttaataatggtagcaataaacaatatgtaggcgcaccttttaattcatcggcgattatttcggaacctattactacacaacaaaatttgccgatgaaagatatgtatggctatggcggtatttataattcagttgattctattagatcattgcatgccatgccaagtatcggtcagtcacatgttatatctcagtcttatgggtcgcactacataatatctagtggaaataattcggcttcatatactagtagcgattatagccgaattaatagtcgttccactagtagttccatcttcaaaatgtcaatcaaatagtactatgtatattttcaaacacgcacagagttcaaatgttgtaaattcggctagggggcaaactgaaatacgaactggcaatattgatcataagcacactttcgatcccgacaatagcattgtcacattagatgatttatctgaggatcaacgacgcgagttagagtgggagctcaaggtagaaagcgtggagctaagaaaacagaaacttgcacgccttctaaagaaaaggaaaagcgtcatggaaaaacaacaaaagccgataaatttagaattatcgtctaacaaagacgaggtagttgtgcttgatttctctagagacataggagtttttgttttgccagatgaacttcgtgccaagaaagttgatgagcatcaagtcgatggagcacgataccttgagaacacagaggagatgttggagggccattagaggatgaacgaggacattgttcatgtgaagaaatcaccacgcttctccaacacatcagatcaggtaaagtctgcaggtaatgcgattatttcccaatttgatcatttatctaaaaataatatttgcactagtaatatcatcatgaaataactcaaagggatcgattggggaggttaattttcttattggtaatagtaaagtgtttaaattttccatatcatcattgccaaagtttatgtctacatggtttgcttatcatcaatctagagatagagacacaaaactaaaattggaaaatattaatgaggctgatgctactatagtggataattctaaccgtgtagtcgaatgggtagatggcaaatctgaaccattcgtttgcttagctttaaaaccatctgcacaaaagtgtcggctagaggagaagaagtatacttttgacttaaccatgtgtgatcatatttttgatgcattgttgaaaaataattatattaaattacttgatcaccatgtcatgccatcacttcaggatctaaaagaacgaatttattgcaaatggcataattcgtttgatcattgtactactgactataacacttttcgtcagaagatacaatcggctattaatgaaggccgattgaattttgcaactctaggaatgtcacatgccaaggatgaccgttttggtaaaacaaatcggtctaggtggtctaataagaagtggtcttcggcgcaggtgggaggtagttcaataaggagcaaatatgggtgccgaagtctagaggtcaagaaaagggcttagctactagtgcacgtgtgggtgtacaaaaggcttcagttcagaaaaatgttattgaacctagggggcatgcacgtgtacaacaactagaaaatttacaccatgtgagtatgaagcgagaggcatcttcggcagagttagtaacaagtcaaaatctgctgaagagctcggggggcaatggcaatcaaccgagacactcacagagcttgtcaaattggcagaagaagcagctagaaaagctaagtgtagagaatgtgaagaagagaggtatggcatggattcctaaaggaagtgttcaggtgcataatgaaacagatgttaaagttgaagtagggtgtaacagccctaggttcataaccaggtatttagaagtgcttttgttgtcctttacatttcatatttactatattgcaatttgatcataggcgatgacaaagttaactctaatcggtaaaattgaaaccacttctatttgaacaataacttgaacagaagtgtacatttataataatttattcaaatactagtttatttatcaccaaaaaatataaattttgtggaatttttacttctgtttagtcctcctaaaaattcaaaccaactttcagcctaaccaatttcatcttttcaccagaattaaaatattttgaatttttgagtgaaactttgaaaaatggaacctagaaaccaacacctgtcaccacaccaaatcccttaatttttgaactagttttacctagtcaaattgaatttaccaagagagggaaagaaaataaatcctggaaattacaagaacgaatctatactcagtttttcacccacctctctcaccctcatagacagccacgacttgggcccacttgtcactgaccttgggtgcctctatagccccacaacacatccatgggcgtgctcccacctcaggacttaagggggggggggggcagagaaaacccctttcatcttcactgcttgttctatcttttcttcatcaagctgagctctcatctcactcctcctccccaaatcacatccaatagcccaagatcaattcctgcatgtttgaccacaacaattcccatcatccaagctttccatccatcccaacatcttgcacatgcatggagagttgagagagatcgagaaggaataaaagagtgctggtttcagcctacagggctgcagcagcagcattttgttttcctccatttggtgagcttccttttcatccatggtgcctcttttgaattccctccatgttgaacatccatagcaacgttctataggttgtccactccattgctgcagctagaaggtggctgcaactcaccccgagttcatctcttttgatttcggttgaagcagccctaggcaacgtctcttgccgtcagcccaagaccttgctccatctcttgccatcagcccaaggccttagcctcgcacaaccctacgtccaggttgctgccatgtgagtgaagtccggtggaagttggagaaaaggggagtgaaaatagaaatcgatttctgagatagctattgagctgaaagaggtgtgcgctttaaaaattcataactaattcatatgaactccgaattcagtgaaccaaatttctgtggattaagaaaaacgtgatcttcaacgttgtaaaataaaaatgaccaacttttgtactggttttcccagtaaaaatataaatagctatatgtatcccttgtgtggtatagctcttaataaattcgtaagaaattattggtaaaagctaaatttgtgaaaccaattttgttgagcttatattttagtactctttgctgttgtggtgttgtttttggcaaaactacctcttaaatcttgtttaggagttgtttagcattcccatgattttaacttgtaaaatccataaataaataatggcaacatatatagctatgaaataatttttcttaggacatgtgaaagatgtactttactctaaaaataatcattattatgaaaacttggtttgagttataggttgcttgcaatgctgtaaaggaaacattaatatttacagaaatgccattttcagcacctgagagcttgtcattttcatatctcccaaaccataagtgataatccggtgattctttcacctaaattcaagttaaaatatgatctacccactgtatttatttcataatttattgatcattttgcatgtacatgtttatttggctcttattcgcatattgcttcttttcgatagatttggagattccggagagtaatgagccatatccagaggaggatagtgacttccctcagcagcaaggcaagcacctaagcatatagaacctatgctttctctaaaaatgatttggttgcaatctatacatatatatatgtgcatgcattgcctagatattaatattgtcggtttatggtgtatgggaagaaactatttatgcatttagttcttgtaatattgatgtccttataacctattaccactggatgggattacttgggatatcttattcattaatgcttagccatgcttagtgctaatagaactatagggatggacattgctattaattgtggtacatagacaacttgctttattgggcataaaacttgagtacttacactaaataatggttgatgaaatatgttggacttggacgggtgatagggcgatgaaaggaggttggttttcgtctgatgcaagtagccccgtctgagtcattaaggatcgaacattttgacatctattcaagcacccttcatacttaccacatgccttatttgggaccagcttgtcctttactagttctactatcattatttataccacattggagagacgtgagagcaggtagccctttggagggcctcgggtgcctatgttggccgggggtgcctcccccgtggcccgcccgccttggtcacatcacgcacgcacgtgactgagtcgtcgggaaccccagcgtggtataggtggttggggtggggttaagaaagggcatgtaatgagcttgaatcacttgtgtaccgcacttgacagggtgtgtagcatttgatctttgttcatttcgtgtgggtccagttgtacacctctgatcagagtataacctattcgaatagccgcgtccttggttatggacattgcttgatgtgtatctcactcatgttagcatcaaatgtagattattatggatgggattatgtttgatggtggtgttggcatgttgtgccatgttggtatggactttggtggaccatggttgatgatgagagcgccgtttgggcttatttgcttatacatttcagaattatatacttgctgtccataaattaaaatgatgctagacttacttttccttgcttattttactcataattgctcaataaaattagctttatgcaaatgttgaacctagagacccaccataggctagaaagcttgcatacttctttctcccttatgtatatataattttgggtaagacttgcgagtacaatcttgtacttaacccggtgtctgcaatttcaggagaggaatccggttttgagttatgcttcttgtgtggtcagtgctctgccaagggtggtgagggcaatgagtgatctcttgcagcttggctcttgcccggttggtttgccctagtggggttgtggcaccaccgattttatcttttgcttatgaactctatttgagacttccgctgctatatttatgtgttgtatgttgggacctcggaccctattatgtgtcatgtacctcgctgcactttaaccctattatggtatttgctatgtttattaattgcttgcgatgaaagtgtgaggctagtcgcattcctagggactagctaagcatgagtaacgggttttgatcgcttgagataattggggatagcgctttggatcgagtcattggggtatgcttttggtcgccaccttcgagtggttgacgggcatatgacgtggtggactggcaagctatcttacgattatgtcttgtgcttactactcgacatttcgggtattataacagaaggttgtcaaccgcgatcatggacacattgaggacgagtggctatttatgcgtgtatggatcccacttctccaatagtatgtggtggtcgtgttggacactagatggtataatactcggggtgtccacatgggggcaaagaatgagaagggagttaggaggtgtgcaccaaatcaacagtttacatctaatcattaggttctttcgccaccatattatatatattcttcacttatgccactgatacctatgtcatggaaccaattctaaggtatgtatagttatccctcatggttttattcttatccttggatgtcatatgggtctttatatcatggggggatgttaccatatagttatgcatattgactaattactacaaatgttgatattaatttttagagaccgaaataattaagggctggagatatttttttttcttgtatttatatatattattctttagaatttatttcggtcatgttttgtgtgggttggcaaggagttggtattgttttatatttaccaagtaatattgcttatgacacatcggtccctatcagtccgtttagagtatccttgcactttagaccgagtagatgctctattattcggtttggaaagtttagtcgttgttggtgtgaggggtgtagatgctttcggtattttaatagtccaatagattaattcagcatttttcttggactgttaaatcattatttggaccggtgtttagatacattgacaggaaaaattaacaacgaaaattctttggcataataggattctagttatcaagacagtaaagtgtgtttttgataatagataaaccggctataattagcagtttggatgtaaaataatacatgcaccgactctgagttttgaggttttccaaaataaaattccttaatctttcttgatttaaaataaaataaaatggaattaaaagcagtgtctatacgtcactgtctactattttacaaacaagtggttttcaaacaacatgtatactatatctagaaataaatattttaaaatctttcccttgaaaaattattctagaattctatttgatttgcaaaaaaaaagctttatttacagccacattgaaattacattttttttactggtatcaaatggaaaggtagtcatctctttcgtcctgtcacacttgatatatcagctagctaagcacagaagcccaggatatgatgcactagggtgaaatagattttgccataaatcaattagtcacgcaagtgaaaaaaaaaacttgagcaagacataatgcgatgactgtgtgttgttatgtttggttgcctgccacttttcttcttttatttcctattggttctttcagtaaaaagagaaaacatcagagaatgcacctactgaaaagcttgcctacccctttgaaataataccttcctaccacccagtgtgtagaccgcattcaatatgtagagtgtggtggtaccgacaggtaccggacaaactagagtaaatcacattatgtgggtaaagctgtacaaactctgcagggtctaaaactaatcgattagccgtgctcacggtcatgagcgacttggtgaaatgatacaagtatagtgttggtgatttactaaatgaattgtgaaatgggtatggtgaatattggtgatggttttacccagtgtgggctaagaatgaatttgttacctgttgccatggagggcacaaggatgatactatgatggtacttatactgctactattatggtctattctttgttttaaaaattatgtttcaatctattattatttactattgcgaaacaaaatttgctttacgctaaaaatgaggcacaaatatagccatccttgatctcagcttgcaatagtcctaggtttcccaaggtttgggtaggacttgccaatacctcgtgtattgacccacctcttgttgtttttagtctcgtttgcaggaaacgggtgttccttctgttaccggagtttctaaggatggttctttctagggtgattcctagtcagttgcctgtgtggtttggtagatgggcatactgaagaacttatgtatctttatcttttccgctgcgtttaaactcttttatttggccagtcggcctaactactatgtaagaccattgcactgctaagttatgataaccatttcatctatttatatgtcaagtatgttgtatggatatgatagcaatgttgtggatgcgtgtgctagccactgatcatgggactagtacagtgtacgctccaggtattcgggaattccatcctttgttggatgactaaatatattgccgagctataggatgagtttttttaaaatgtatcgaagtttagatgggattgtttttaatttattttaggcccaagaactgcagccaattcagttaggtggacattacggacaactgaatttgtagtatagtttagtactaaatgggaaatatttgagaaggtattatccttatttgagaaggtagaaaacttgattgtcttagaacaaatacttatttgagtatcgttttgagaggacgactgtagatgggctcaagactgataccatatgtgggagtatcgttttgagaagatgattgtggatgggcttaggactaataccgtgtgtggagtattgttctgagaggacgatcgtggtctggattgattaattctatggtgttttcggtaaagcaaaagttatacgtccttcttataccgaaaacagggggcatgtgtttgtacgataatttggcttatagttaccagattggtttagaatagatgatacaactgtcaaatgattcacttgaaaatctactcagtttacaggtgtaggaaattgtgatgcgtcggtcatatgtgctagtattgactaaatgaatatggaccgatgtagtttatagtattgttgcctgtgcaagctgattgcatatatatgcatatgtatatttggtttttatgcaggctacagaagctatacagggcgtgaccgtcacgttacgttaatcacggaggcaggtgattatccctaattgggtgattaagtggcaagggaatccttcgttgctcctgcagatggaaagtcaggtgtcgtatttactgatccaaagagtcttcatcgtcatcgagcgagccaggggctcagacgtgcggctgtgatgggagtgctgcttgcatggatgtgatggtattcgctggatccaaccatcacgtggcatctgcgttgagagcagggctgcggcgaccgagccaagccgcgtgcgatattatttatctagttagaagataaagagtttgttggatcgaattgtttcaaatattccggtaaaccatcattgcatattgcgtgggaccgagtagacatgccaaaagatcagagcaattagctatatatattggtccacggtagaatagaagggaacccaatttcaatctaatattcatctcttttactttttagttcttttctattttgtttttatggctgagttctagcaaccctagaatttggttaatctttgccgttttgcgctgaaaaacggtcgtgcttctccatgaaagcgagaaggttatcctttgctagtttgctcggaaactagtcgttcgtcgtcacgtaagtacgatattatcttctttactaatttgctcgtaaattagtcgtgtgattccacgaaagcgaattaatctcgaaatcggtttcactagccaattttgatttattgattttggcgactctgtttaatgcaccgcaaatcattaggtgatcttgtgttggcaaaaaaaaagcatcaacaaaaccttatgcaactaacaatcaagctaagtacgaagcagttctcaaggggttgcagttgcttatggaagttgaagcccacgccgtggagataatgggggattctttgttggtgatcagtcaattggcaggggaatacgaatgcaaaaatgatgcgttgatgatctacaacgagaaatgctgggaattgatgaatagttttcggctggtgattttgaagcatgtctctcgggagcagaacgttgaagcttatgacttagctcagggggcatcatgatacaagccgatggtgaaggatgttgaggtggaggtagccgcaatcatagccgatggttggaggtatgatgtttatcagtatttacagaatccatctcaatcggcttcacgaaaattgtgctataaggccttgaagtataccttattggatgatgagctgtattatcggacgattgatggagtattgtttaaatgtttgagtgccgatcaagctaaggttgtgatgggcgaagtacatgaaggtatttgtggtactcaataattggctcacaagatgaagtggttgctttggtgcacaaggtatttttggccgaacatgttagaggattgcttttaatattacaaaggatgtcaagattgccaaaatttggagcaattcagagagcaccagcatcggctatgaatcatatcatcaaactatggccgttcagaggatggggaattgatatgatcggtcagattaatccaccttcaagcaagggacataagtttatattggtggcgaccgattattttaccaaatgggtggtggcagttccattgaagaaagttgattatggggatgcaatacagtttgtcaaggagtatattatctaccgatttgggattcctcagactattacaacagatcaggggtcaatctttgtatttgatgaatttgttcagtttgccgatagcatgggtatcaagttgttgaattcttcaccatattatgcacaagctaatgggcgagctgaggcatctaacaagagcttgattaagttgatcaaaagaaagatttctgattttcctcggcaatggctcacaaggttggctgaaacattatggtcttttcggatggcttgtcacgcatcggttcaagtccctccttataagcttgtttatggacatgaggcagttttaccatgggaaactacaagcggctcaaggagagtagctttacaggatgatttaacagccgataagtattacaatcttatagaagatgaaacagaagatctagttcaatccagattgagagcccttgcaaaggtgactaaggataaggaacgagttgctcggcattataataaaaaagtggtgccaaagtctttttctgaaggggagctagtctcgaaattgatcttgccaataggaactcgagataataaattcggcaagtggtcacctaattgggaaggaccgtttcaaatatacaaaattgtgtccaaaggggcttatatgttgcaaggacttgatggtgaagtttatgaacgagcgcttaatggcaagtat

SEQ ID NO: 78616 - DNA, 1240 bp, Oryza sativa
gactacacattattattgcacactattggaatttagttttagattatgtttctgcttagcataagttttgcgtagaacttgtaacggtcatttaaagttccggtccttattttcacgtggaatttgaggagctaggatggtttggattgtgtggattatatcgttattgagttatcttataactgactgtcgtggatgtccgtaattttaggaggagactgccgaaatttctaataattttcggagttaagtggtttttgagtgtattttggtatggcactctaggtacgtggttacctgggatgttacatagacaccaaccgaagaaaaagatcccctaactacttaattctattagagaacctcgacccgaagttggcaaatagatgcataattgtcgtgtcaagtttacgacattcatcatttattagcttgatatcttcatcatgtctttgtaattgaacccatcctcgaaactaatatgttgccctgaaaaacacctgcaaataagattttgatggtgtttttatcaaaaaccatatcatttctactaagcctaagagcccaacatacagcggaagctccaacaagaataattttttttatttttttactaacacccaaaagccaattcccaaacgtatgagatgtactatgtagaggataaagtccaaaaaataattgtatagctctccaaagaaatttagaaacatggcactcaaagaatagatggtatattgattcatttttcatataaaagcaacatcttaaactaccattccaattccttctagtcaaattatctttagttaaaacgatccctttaaggagataccacataaaaatcttaatcttaataggcattttaagtttccaaataatcttatttctctctatgtattattaattaaagctaagtaaatagatcgaacagaaaattggccattttgatgaaaattccatctaaaaatgtcatcctcgtctgttaagttaatatgtacaatggaagcacacaaattatgccacctaattagattttgaccaactaatgctcttctaaaagtaacattaagcggaatagaacccataacattagcaattgaggcatttttccttctaactatagaaaataacgaagggtacttttccttcaaagaataattccctagccacttatcctcccagaatcttactcccagaatcttacttgttcaccattattaataatccaggaagtcat

SEQ ID NO: 78617 - DNA, 4502 bp, Oryza sativa
aaagtagcaaagctaaactttaatctaaacaaaacccaagaaactctagaggggtacctaactatttaaggaggtgggaagacctctaggtcgtcctccacctggttggggcgcaccccacatgggccctacatgggccggggtcccaaaaatagttacaagcccaaaggcccatgacaggtgatgcagcagcttgtttcttcatctgcggttgaccaggatggaatttggtgatgaggctagatccgttggaaagaggactctgagagctttctatcaagcactcatgggccgaaaacggagcttgtatgcagattcggcggccgtttgaagtcagcagtgtagcacgtggccgaatcggattccagtacttggaggacttgcacttgatatcttgttgttcatccatgatgtgagcaacggatgtatccatagtagccatggtcacatcatcctccccttcttcacggaaaaccatcctcggtttttccatatggtgctcttcacatagtccattcaaaataacatgtttcatccaatcaaaaccagagaaactgaagtagtgtgattagcaataacatgtttctctaaattcgaacaaatgaaaactctatgcaccaaatatattcctctatcgttatattcgccaaagatatgaaaaatagcattagttggacatggcaaatcagagttagcaaataatttctcctccaaattattgagctcacaaaaatcatcaaattgaacataacccaaagtatttaaagaagttatcaatttacgttcctcatcatcattagcaatgtgaacaacatgcttaaaatcagcacacaaagaaacactagaaatagcattttcattcactagttgtggcatggatataagtgaagtattatcacacaactcttctttatcacaaggaacaacaagtaaatcaactcgtgacaaaggcaaatcagaagtagtttccaccaaaatttgctctagattagcatggatagtggagaaatgtgacaagggagaagcacactcaccttgagtaatatcaacaccatttaatttaccttttatgccctcttcagataatgtaggtgcaccagtcttctcttcttccttcgtgagcgatggagatggcatctcgatcatattgctcttctcctcatggtgaatgtactgagctccctgcaaaatgtcagtaataggaggcacaagcatagattgtttctcccttgggttcattaaaatattgctctcaacactgcaagcaagcatgaacaagtggcctatatgattatatgtcacgttaataagcccagcctgaatatcagaattaagccctctaaaaaatctagtcattgtgttctcattgctttcttttaaaccactataagtgatacaaattttaaagtcatgaaagtactcccgcacggttttgtcaccttgttttaaatgttctaatttctcaaggagagtatgtttataatatgaaaacacaaaattttttctcatcattgttttgcattcatcccaagtttcaaacttattgccaacaatataccaccaaaaagatgtagaaccagtacacttattactagcagccttaatcatttgagcattagagaaatcatactcatcaaattgtttgtctactgctagctcccaattaacataagcggcggaatcataattaccatcaaaaacaggcaaattagattctacccttgcaagatcattatcatgtaccttatatgcaaagcgtgaagaagacgatatatctcgttgatggtgaagaagtcgatgttgagcatgaccatctcgtttcccctttcacaatcctgccatggttagtagcaagcaagaaacatacacaaatatatgcacgctcctatcaactactaggtagtggcagctcaaatatcacacacactcaagcttttaaccaagctcttacaagttcttaccaaagcaagcggaaaggtgacatacaccgactcaaccaagcaccccaatggaggttggatgtatcgatgccttggcaaacacttgctgtacggctgcaatcaaatctgtagagctctgggtgggcttaaaatatgtagcaaaggaaagcaatggttcaaatcagagaatgcaaaattgaataatggttcaaagtcaagtaccgtgctggtcctaggctagaacgtactagagacgcgagtctagacacaaacgataccataagatagcactaggaacaactcatgcacaactctgatatatgaagttcagctcaaacataacaatattttctcttttctttctttcttctttcttttttttctttcctttccttttcttttcttttttttagggtgtagcttttctttgcttttcttttttttttgattttttttacaaaaacagattcaaggacctcaatataaggctacagggactcaaacgtaaatataaaaattacagggactcaaatgtaaaagtctaaacccaaaattaaaattatacaaaaatggaatgctgaatttatgccggttccatttttccaaacagatctcaaaaccgacaccaaacaaatattcaccaaggtgtttgacacaactcggaaccgtgaaagggagggagggagtcggactcggccaaaggggtgagtggaagtcgtctaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcaggacacaggcacggccaaaacagaagcacggcagtcagcaaaccaaagatgcaactcaacaactgcaaaaccaaccggtaaaaacttttgcaaactacaaaaatagaatcgtggcagcgagccgattccgttttcgtaggtcctgacgacaacagatacatggaggtgacgatgactgtggtacaaaacgtgaccagaactcgaaactctaaacgaactagacgctaacaccagcaactcgactcgacgatgtaacacaaaactcaacaaagcaaaaactgataaaaacaatgcaatggcacaatatggctaggtacaggacaatttttttatatcaattttctggttatgggtagataaaactcaccgagcaacgaaagctctgataccaaatgatgaaccctgagctccactcggcactcaaggctgttgtttggcccgatcttttggtgagttgatgataactacgatttgggagaaacgttaacgacccgactacaaccgtactagacgtttttgtgttacgccttagcgatcgatacacctctccgtaggttgttgatcttgccagtgcagatcaaccttattcctgcaagcaaatcgaagaaacaagcaagaacaagataaaagcaatctgaattgcagataggaatggagcaaaaatgataagtttgaggttccgtaacgagcaaaccggtgatctaaccgatcacgggattacacggaaaagtagcgaagctaaacttttatctaaacaaaacccaagatactctagagggtacctaattatttaaggaggtgggaggacctctacgtcgtcctccacctggttggggcgcaccccacatgggccctacatgggccggggtcccaaacatagttacaagcccaaaggcccatgacaggtgatgcaacaccttatttcttcatctgctgttgactaggatggaatttggtgatgaggctggatccgttggaaagaggactccgagagctttccatcaagtactgacgggctgaaaacggagctcgtatgcagattcggtgaccgtttgaagtcagcagtgtagcacgtggccgaatcggattccagcacccttgcacttgatatcttgttgttcatccatgatgtgagcaacggatgtatccgtagtagccatggtcacatcaaagagcaagttttcaccacaagcagaaagttatatattgcatcccaaaagttatgtttgcaaatttaaagttggaattacaagatttagctcatccagacatgtattttttgatggctgatattgccctttgcttaatccgatctacttcgtctatgatttggacatcgactgcatcagtgcttaggatcacctttcgagatttggttagatcggccaagtgcttgctagatgccttcaactttgacttctgatcctcaatggcttttggcaagtctgcaagcttttgctgttcaagggcgatttgtgcattgcactgctctaactcagccaggagttctattttttgagcattaagctgatcaatgatagtttgagttgaatctggaccagcctccaattcatcgagcttggccttctcttcattcatagaaaccctgttggcctggatggttgcctcaagatctcttctttcacgccgatcggcaatcctcctttgggctttttcaagtttaagccgatgct

SEQ ID NO: 78618 - DNA, 21898 bp, Oryza sativa
ttggctcgctagatttggaaattggggttggaggacgaataggctgaaaatacaagtacaaattagcatcggttatttaaaaaactgagagaggaaagttgatgaggtttaaaaatcaatcgatgcagctggtgcttgtggcttcttggaagcaatctttttctgcaagaaaatcaaagttgagaattggtataaaggcataatagacttaagctgaagattgaaaacatgcacatactcttggtttgtatgtgggacgtactggaggtgatggcgttctttgaggagcaggtggatcggctggaggagtttgttcccttgtttcactgacatgttcagccgcttcatccacatgttttgccattgtttcacccttcaggaattctgctacatccgaatctatggctggcaattcatcggcagtggtcttttgcttcttgggtttcttctttgcagccgatggtgcagcagccgattttgctctcttttttctgccagcatcaggggctattggcacacggggcatgccatgcagcagtgttgaagtcttgggggcattgtagccgatgaccggaggagatagtccactaccattgagcagtagccctggggcatattggatctctacaccgctgttgctatgatgaggaggagaatattctgttgtctgcaagagagaatttgcacaaggtcaagattaattcatcggcttgtagttaacataattgacaaaggagaagattcttacttgagggacggcttagggaatagatctattagatacattgaagacgattggtgaagccgatgttttttccactctatccaccatcggtcaaaggatgcacttctcaacatccttagcttgatattgttgatgctgcctaggggtggtccttctatgttcagcagccgatccatcataagtggtgatgtgatttctcctctactctggatcttatgggcaaagaagtgatttctcctctactctggatcttatcggcaaagaacaagctgatcggcagttgacccatgccgaattgccttgcagcacttgtcggatgatagaactcatatgtcatttggatttttttgccttgatggatgccaataggaaggatgcaaggacgatggctgctgagaatacttctctagatttgtcatatttttcggagttgatctcatcaaaccgtaaatcgcctggtagcttacaagtgccatgtccttcgtatgcaaactaaattctagtgtttttgggaaacccatcgtaaaagttgttgaaccactctctgaagggttcagccgatagcttggatgcaatgctaaccgatgccgcttctccaaaggacctgcatcggcatgtagtgattctttctccatcatcatcgatgatcggctcaaatcttggaaatcttgtatcggctaatggtggccgattgacaaccatcctggtgtgcaagtttagccagatctgcagtaaccactagggaccccctgtgccgattgatactccagaggccatcttggttatggcagtgttcagagtttggtacagatagcctagcagatactttccaaggggaaattgtttcttgtctacatgttgccagtttgcagtaggaccacaacttggaccatgaaaaaagaacttctcaagccacatcatgaggaaagctgcatgctcccttgcaaagatcggcctagtacccatgttcttggcaacatagcctgaccaaccgcctatgcttctgattttgaactcttgggtggattggatattcaagatggtcaggttagccgatgaggtcacatctaggccagtaatcattataacatccaaaagagttggagtcatcggtccttgagagaaaaggaaggtattcatggctgtggaccagaagtaagtggcagctaccatcatggactcatcttttgccatgtctgctgcagttaaagccaaggcttgggatatgccgatttcttcccagttggttaactttctagctgacatcctgttataccaagcgggccagctcttttcggccgatggctaagatttgaaggtgttcttccataggcttagatccggttagcaaatctaaaggggattcagttggtttcaccattgatgaactctgtggggtctgggttaccaattgggccaaggaaaaactggaactcatcggttatactagggactgcgacttgatgagagagatgctacagaaggaggaaaatcgaagattgagcagaagaaaaaccaatcttgcacggaaaagaaagaggattagccgatgggtacttacctcgacattctcagaggttgatgcgctcagaggactggcggtggttgacattgtcggcgatgaggagtggaatcacattagttacaattccagaggcccaagacaggtgacgcagcaccttatttatgtgattgcggccaaacgacatggaatttggcaatgaggctgtaaagagggctccgagagctttccatcaagcacttacgggccgaaaacagtggtcgtatgcagattcggtggccgtttgaagtcagcaatgtagcaggtggccgaatcggattccagcacttggaggacttgatcttgatatctccttgttcatccatgatgtgagcaatggttgtatccatagcactactgcaaaaacggcctgtagagacgttccgtaagagacggctaagcacgtcgtccctattaaagcccatctcccactttgcctcttacgtagatacgctaattacggacaggataatagaccgtctctacaatcacattaatcagcgctaaacaatttggtaggaatttttttttgctcgttccctccaaaaagatcaatctttccaactttttacctcattcatgcggattttttttatctcccttggaactcggaagtagttacgatattatctaagagaacaaacccctctccttctcttgtaaaatctgttccaatctttccattagctccaccgtgaagacggcggcctctcgcgtatgagccccatggccgccgcctgtgccgtctgggctcagcgccgccggcgacgccagggctgcgcacctactacccacgccatcgccgcctgcgccgtccggggtgaacgccgcctgtgccgcctagcacccaccgtccacccatcgccgcctgtgccttccaggctgagcgccgctggcgccgccagagatgcatggcccccgcgtcatccgccagccacacacccatcgtttgccccacagcagcagcatcgacacgccgcagattcatcggtgattttcttcctggtattgcccaaattcctcagccatcgaatcctggcaacagtagcaatcctaattgcaatactgtttctgcacacttgcacagctgatgtttgatttgtgttctgcttacagacaaagtatttaattcttaattatctgttatagcaacccaagtatattggggaaaaaaatttaatgcacagatggtttgtttttcctgcttgcatctaattattttataatgtataggtgactggcatgtaactttgcatatttgtgcaactgtaatttggtcatcgtagaggatatttacaacagctagcagctaagggaaacatcagtataatttgtagaacttggtgagtacaatatttaattatgtgtggtcaactaattcgaatgcgtatcttccaatttataatcatgtttgtgccaaaattgattgggaacacagcatgatctgaactttttgatgctctcttggactctaggcttgtaagatgtagacctacttaatacttcagcaaacattagaatttatactttggtcaatttagtttgatcagtggaaaagataaattacctataatgtagcaatagtatattcttgtgatctcgaaatatttataatcaaataatgctccacataatatctggtactgttatttacagtaatttatatgaattggattgttgcttctctatccattatattgatagcacctaatacgatgcatagtaacttattaacaatcaacaatacatcaaacattggctctcctaacattctaattcctcgatgttattttatttatgtttttcagtaattgagtactggataaatgaatagggactggattaataagcccagaacaactgctgcatataaaacaggagtatctcaattcctagaatttgcattctctaatgtacctcaatatgcaagggttatattgttacttatgcacctgtaacattctaatctgttttttaaatatagtgcaaatggcagcaaggtcccaaagactgcaaggcttggatttttcagagaatggagtacagaatcaagaaatggtcccaaatgatcactatgttgaagaacagaacataacaaatgcagaatggcgttcaaactgctatgagtatcgtaagatatattgtttattcgcttttaaaacttgtatgcttgtggactaaatctttaaacatgacagatcctgatggccgcattaaaagacgtcgaggaccaactaaactggcaaatgttgaaaatcttccggaaggtgttaagattattgtcaaattggatcgtttcaatgcaccttgctcacaatcttctatagttcttggatcctatttaggaacacttgttaggaagccacatctagctccactgaacattcttaaatggaatgataaactttataagagaatatatcatccaaaattgatttctgaagtacaggtattgcttgtttaattcacatggtttttaaatcatatttttatggtgattcctgtataatccattcactcttttcatatgtgctagagaaagtttgcaattgatggaagagctaaggattggcttctccaccagttagatggaaaatggaggcaatacaagtcaaatctgaagaaaaagtattacaaggctaacttacccatggaacgagtattgcaaatggtaccccaaactgttaatgaatctcaatggcctacactagtttcttactggtactcagaggactctaaggtaaatatgtgttgaactttttagtgagtgaacagccatcgctttgatttatatcaactcattgatggtatatgttgtatcattagaaaatcagtgatcaaaaccaagagaatgcacaaaatattaagcatccacacaaattaggaagaaagagctttgcaagaaagaggaaagagctggtaagaagtttagcatgtatttcttcattcattattgcttctatttctcatgcacttgacatgtataatctgcaggaacatgatagagtggaggtggacagagcaaccttctttgatgaatgccataagacaaaagatggcagatatgttaatgatgctacacaagacaaaatggtatgacatattacttgtttttctttaactctttctataataaaatacactatagtaagagtacaatttttccatgtagaatgaggtatatatgaaattggctgagaaaagagtagatggccaagaactcactgaagctgattttgaacaagctatgttagaagtgtttggaaaggatcatagtggtagagttagaggcatgggtccaaccattactccaacaaactattatggtggaagatttttgaatatgtcaggaagaagtgaacaagggagtagctccagtaatgtaaatggcttcattagttttatggtatcatatcttgctgagaaatatccagaagataatttgatgtctaggctgccaccttcactttgctaggctcattccaagacaagaggtatgggcacaagattactgttttgaatgttgcaacttatatagccataagctgacaaaataacatattcatggatgtatatgtaggttgattagaaccaaggaagttagtcatcaaataatcctccattctatcctctcttcagtttgatccaaatttaaccaaggaagccagacaccaaatactactccatcgtctagtactacagcatcatctcagacttgaagtgaagaggactgatttacaatggcgactgcatcatttcgcactacttgttgcattagaattagcacttgctgctgccggaaacatatttaagttttctcgtcgggaacaatgtatggatattgctttttctttaatgctaagctactagtgttgaaaatattatcaatgtggtatgatggtaactcagtctgctgatattattgtgtttatggattttctgaatgaaatgtttggcatatgtgactaatagcgctagatgcgggtattatttgttaattagacactgtgtagagacgggtgcacccatgtctatagaaatggatattgtctctaggagagaaataagtaatatattaaccattaatagagacggttagaaccgtgcctaaacaagacataaattgtctctactatatgatagagacggaagcaaccgtggctaagatcatcaagtgtctctacatgtttaatctgaaaatttgtatttcaaatttggaatgttcgtaatttatattagagacggtcaaatttaaagtagagatggttttcggcgtgtctacaaatttgatttgaatttgtagtcatgcgtgtagcgacggtcccaaccgtatctatcgaccgtctctagacgtacacatggctatttgaaccgtctctaatcgtttgacacgggagcaatggcaacgcctatgagacgggtgctaaaaccgtctctacctataatagagacgggtatagccatctctacatcacataaaaaccgtctctaggggctgtttctgctgtagtgtagtagccatggttacatcagagataaagctctcagataggcaattgtatttattaattaggatatcttatgtaatttccttagagatatgattgggcaaaagtctgccgtaaagacttatggtaagagtcatgtccggcaaggacatattttgtatctcgggtataaatatgacacaaacccatgtaatcaatgaacacacgttcaataacactttcggcacatcgccaccctttttactttcgttttatttcgatgagttcttgctttcggattgagctgcatcgatcttcaactagaggtaaacttgtcatggcgatttgcgttctcgggattagcacttccatctttatgacactctaatcttgtttatgtaattcatcgagttatcataaataccatataatctctgttagtttcattatataacttgtcatcggttggtttttactgttagaaagtagccgacagagttaaacctcgttattaatttagattatatcatatacttatcatctcttagaggttttcatcatcttgtttagatcttacaattatctttatgcttaatgctgcattggttgagttcgatctattaagttctatctataattttgatatctagcttgttttatgattatcaatagagatagcatcggaatttcagccgatcttacttgatatcatactcttgcttgttatgctaaatctgccctttatattaagatcttgtcacattaaagttatattaagtttcttatttgatatatcttgtttgtttcaatatcttagtataaagtagtatcggagtattagccgatacatgctagatctatctgatcggctatgctataaacctctatataatctttgctttaatgtatatttcgacttaagtgatttatattgtctcgtcatggtgaccgatctatcctaatcacttagtttaagtatatatcgaagtaaagactatatgatgttaatatctacagctgatcgactagatttagttttatcttatttattcatcattgtcgatcgattcaaatatgacgtcggctccgagataaatgatatgtcatcggcaactagccgatcggctatcgtttatgaatttaaccgcagtttttcttgtcttcctttcttgttgattacaagatcaaatcaacttgcacgctcacgaacctaaagcgagattttggacctgcacaggagttaagcagatcttccaggccagtgtgtgtttttctgatcaacaggtgtctagtggggtccgtttgtgggccacttgcctcggttgacacatggggtccgcttccgtcgacccgtggaccgtctctatgtacttggtctaccgtggccctttaggttgacatgtggggtccacatgtcaacagtgcagccttcctgtctttatggttgcaaagcttaattataataatccgcaaatctccacataacagcattaaacgataatcatattttgatcatacgaactccgaatcgacccgttcaagtctcttaatgtttgttataacctaaagaaccatgtgcctttctttttatgtattgttattgcttctttataggttgtagctttgcttgtgtgctgcgcgtagcttctgtcgttccggaggttctcgaagcgtggttcgcggttgtcgccgaaggttcggaaggccgttccctctgagcaaggcaagtcgcatcatccttgagcatattgaatcccagtttataaaattatttaaatttccacgttatcactgttttatttagccatacctatttatctttgttatgaccttatcattgttgctattgttatatcaccttgttcaccctagtaaaataataccccaactagtgggtacttattcatggttccactagtaagaatttaggtagattcatggttatgggcaagcctagcaatgtacccaagtttgtggtttacttcttaaaacttgcttaacaactaaaatgtggaatggttggcctgggttggcttgggacgaactgggacccaggtcgggttgccagttcggtctgaatcatcgtaggccttgggttaaggtaagttcgtgtggtttgacggccttgaataataatactatgtaactctaggatcatttttgtaaaatagctttgggcaactaggcgacttttaaatgctgtttaccgcaaaacctagccctatattattactccttgtacccccttgcattaatcatgcatctctcggtgtgacttgctgagtactgtgattgtactcattcttgctcaatctttccccccttcaataagagaaagctttggagaggaaatcctaggtggagtcctggcttataccccaattgagcgcctgtgaagatggagccgtaggctcgctagtccactgttgtttatttctgtttgccaggccttaagtgcctttgtaataatgtaaatattattgatataataaagatgtgtcttttgtatcaagtttgtgtggtgtaccccggcttttcctgggatggggattaatacattaacattcagaaaggcatatttcccgggcatgacaatattgtatctattacatgggctaccaaatgacacacacagagagaaacgactgttgacggtcgttatcgatcagttttgactgtcaatattaccaaaatagaggagagctagtgatgcttgcaatgcatatacatgttagaataataatattccactagtattaggttcactaaccttttgcagagaataaccataaagtggaggagaatcgacatcaactcaaacgataaatcaatcggacgatgttgaggatcagacttatgcatgaatgggccaagaactcagaattgacacaatgaattgggccaaaattcacaagtctacgaagtgaagcaatgttgtaggccacctgctgaatttggatccaggtttgggctggacggcgtggatcactccccaatgacagttagagggaaattccgaacattccaactaccacaaccgtcattggcagcctatataaggacttcactctcttcacttcaacaaacacctcaagcaagagctctctcatattctctcaagtttagtttagtattctcaatctagtggaataggaatagagtccggaaatcaggagtccggaagtcttcggaagagttcagatatggctctagtagctttcctttcctcttttgtaagctttgtacttttattagaatactcttctatatacatttatggtattgaaatactttccgaatatatgaatgccaactttacattatattcatgttatactgaatatactgctagcttatctgggcgatgctttggtgcgagtatattgtaattgcttatgcaattactctatgtcatgacgatgacattagagtagtatctggtaatttagaagtggtgtctagactacgggatatcattatttggggttatatgctgcggatgagaggtgggctgctgatggtgacagctcagtacgggtattcctccgcgcgtgtatatagtcctaagttaattccctggggagggtactcctccgtatttagccccggttgtatggtcatgacgcgttgtcgtaaggaactcgacagccaggggtggcttctcgtagtaccaggagggcatcggatagagggtatgagctagtatatcggttaactagaatgtaagtatactatcaatcaatctggggtgttagtcaataccttatcaaacatgatgaagtccatagccgatggttcaaaagctgagcagcaggctgcaggcccggtttatttgcaaggaggtgtctttccaaattatcggtctttgattaccaatgttcagccatcaactcaggcggttccctctattgcacgaacatctcagccgacggcactggcgtcaactcccctacctgttccgtcagcaatggcgccaggccagccagtgaaccctcggttattaatgagagagcagccacagcatggcgggcaggttgcgaatcggctgacccaagatcatgttgctgccacgtttctgccgcctcaacctattgttgatccaatacaacagcagccgattcagcagacaccccaattcagtaggttgtgcaaccaatccagcaacaggtcatgcaatcagtttagcaaacaccaccaaggtagcagctgattcagcagacgccgttaagacaacaaatcgttcagccgatccagcaccaaggttcaataggcgcatcggccgggtttgcaacgcctggtggtcagcctgtacaacattttttaaatcaagttgtcccagaacacttggttcaccacgtacagccggatggcacagtaatacctcaagttgttcctgagcatttggtacgtaatatccagccgaaccttcataattaccaagggggtaacttgaatttccaatatcagcctgcttccccgcaagcccaatatcagccagggggattggctcaacctcagtttgcgtctcagtatggtcagtttgagcccatgcagcaacagtcacaaggggtagcttagcaacaaccgtgggccgatgtgattgctgacgtaatgagggaacagtttgggcttaaaccaaaagagattggaagcttgtattggcaaccttatcctgagtggtttgagagagttcctcttcccaatcggttcaaagttccggacttctccaaattttcgggacaagatggtgtgttaacttatgagcacattagccgattcttagctcagtgtggtgaagaatcggctatagacgctctgaaggttaggttattccggttatctttgtctggatcggcttttacttggttttcctctttgccgtacgggtcgatcaatagctggaccgatttggagaagcaattccacagctatttctacagtggggttcatgagatgaaattatccgacttgacagcgattaagcagcggcatgatgaacctgtgcacgagtatattcagagatttagggaaatgaggaacaaatgctttagcttgagtttaactgttgcccagttagccgatctggcttttcagggtatgattgctccgattagggagaaattctcgtctgaggactttgatagcttgtcacatctgatatagaaagtaaccttgcatgagcataggtccgcggaagttaggaaaaactcaaagaaggttaatcatgtttatccgtacatgtatgggtcggatgatgatgaggacttttctaaaatagctgcagccgagtgggtgaggagtaaaaaggtcataccatgccaatgggtaaaaagttctggaaaagagaagtatgactttgatattactaaacctgacaagatctttgatttgctactccgagagaagcaaattcaacttcttgctggtcatacaatcccatcggctgaggaattaggcagaaagaggtattgcaaatgacataattctgggtcccattctactaacgattgcaaggtttttagatagcagattcaggtggccattgagggaggcaagattaggtttgatgattccaaaaagccgatgaaggtcgatggtaatccttttcctattaatgtggtgcatacagctggccaaacagccgatagggcccgtgcaatgggttttcaggtgaattcggctaagattatcaacaaatatcagaagaagtatgacaagcagcaggagaaggatcatgagaaatacgatgatggttttgatcctcattggtgttgtgagttctttagattctgctggaatgaaggtatgaggttgccatctatttaaaactgccctgggtgcagtgatagcgtcgagaactcaagccgatcatataataggggcaatcggttaaggcagacaagagtttctgttcatcaaagattgggtccagtaaatcaagatcatggccaagaagacaatgtaatcaggaagaatcaatggtgtccttttggtattttcacgaagaatcagaagagaagggttcagagattgaggaacagggagcgccttcaggaggttgaacaagaaattaatcatcggctgaagaaagcaaagccaaggcaggagtggcgtgttaagaattaggttactgtagccgattatatcgcagccgatgaggcaaagaggttggcaaaagggaagagtgttgtgacggcaccggttaacatggtctttaccctgccagccgaattcgggatagaccaagccgatgtcgacgaggtggaagaggaattggctaagttggttctgtcaccagaacaggcagtgttcgagaaacccgaggggacagagaatcggcatcttaaaccattgtatataaacggctacgtcaatgggaagccgatgtctaaactgatggttgatggtggggctgcggtaaatttgatgccctatgctacgttcaggaaattaggtaaaaatgccgaggatctcgtcaagacaaacttgctcaacgattttggtggcaatccatcagaaaccaaaggtgttctaaatgtggagctgacagttggcagtaagactattcctaccacgttttttgtcatcaatgggaaaggttcttacagcttgttgcttggaagggattggattcacgccaattgttgcattccttcaactatgcatgaatgtttgattcagtggcaaggcgacaaaatagagatcgtaccagccgacaggtcagttaatgttgccagtgccgatttagctctttgggaaatggatggccttgattgtttatctggaaaagtctgggatggagattttctaaaagtgtccgattctgatatacagccaattgaagatggagaacccaagctattattttgagggcgtcgtggagggttcaaatgtctacactacggacacggtagatgatctcgatgacaagcaaggtcaaggtttcatgtcggccgatgatttggaagaagtggacataggtctaggcgatcatctaaggccgacatttattagtaggaacttatctccagagtttagaaccaagctgatagagctcttaaaagagtttagagattgcttcgcttgggagtattacgagatgcctggactcagcggatcgattgttgaacatcggctacctatcaaaccagtggttaggccacttcaacaacctccgaggagatgcaaggccgacatgcttgaaccggtcaaggctgagattaaaagattgtatgatgctggttttattcgtccttgccaatatgctgagtaggtttctagtatagttcatgttatcaagaaaaacgacaaggtcagggtatgcattgatttccgaaatttgaataaggccaccccgaaagatgaatacccaatgccagtagccgatcaactagttgatgctgcttcgggacataagattttgagttttatggacagaaacgcatgatacaatcaaatttttatggccgaagaagacattcataagacagcttttaggtgtcctggtacaatcggcttatttgaatgggttgtcatgactttcggcttgaagagtgctggagctacatatcaaagagccatgaattacatatgtcacgatctaatcggctggttggttgaagtcgacattgatgatgtggttgttaagtctagagaaacaaaggaccatatagctgatttgaggaaggttttcgagagaaccagaaaatatggcctgaagatgaatccgacaaaatgtgcttttggtgtatcggctggccagtttttgggatttcttgttcatgagagggggatcgaggtaactcaaaggagtgttaatgcgatcaagaagattcagcctccagagaataagacagagttacaagagatgatcggcaagataaattgtgttagaaggtttatttctaatttgtctggaaggttagaaccttttacaccattgttgagattgaaagccgatcagcagtttacttagggggcagagtagcaaaaggctttggataatattaaggaatatcttagctctcctcttgttttgattcctccacagaaaggaatactgtttaggttatatttatcggccagtgagaagtcaatcggctcggttttgatttacgagttggaagggaaggaacgagttgtattctatctcagtcgtcggctcttggatgctgaaactagatattcccctgtggagaagttatgcttgtgtctgtatttttcgtgtacaaggttgaggcattatctactgtccaacgagtgtactgttatatgtaaggccgacgttgtcaagtacatgctatcggctccaatatttaaaggaagggttggaaagtggatattttccttaaccgagtttgatcttcggtatgagtcgccgaagttgattaagggacaagctatagctgattttattgtggaacatcgtgatgattcaatcggctcggttgaaatagtgccatggactttattctttgatggatcggtgtgtactcatggttgtggtatcagcgtagttataatttcccctaggggggcatgtttctagtttgcttatactattaaaccgtatgcgactaataatcaagctgagtatgaggcagtgctcaaagggttgcaattactcaaggaagttgaagccgataccattgaaatcatgggggattctttgctagtaatcagtcaattggcaggagagtatgaatgcaagaatgatacattgatggtttataatgagaagtgccaagaactaatgaaggagtttcggctggttactttaaagcatgtcactcgagaataaaatattgaagctaatgatttggcccaaggggcatcgggatataagccgatgatcaaagatgttaaggttgaaattgcagcaatgacagccgttgattggaggtatgatgtgcatcagtatttgcataatccgtctcaatcggcttctaggaaattgcgatataaggcattaaagtatactctgttggatgatgagctttattatcggatgattgatggagtgttacttaagtgtttgggtgccgatcaggctaaagttgcaatcagtgaagttcatgaaggaatttgtggtactcattaatcggctcataagatgaagtggttactttggcgtgcagggtatttttggccgacaatgctggaggattgtttcagatattatagggggtgtcaagattgtcagaagtttggggcaattcagcgagctccggcatcgactatgaatcctattattaagccatgaccattccgaggttggggaattgatatgatcggtatgataaacccaccatcgagtaaaggacataagtttatattggtggcgactgattatttcaccaagtgggtggaggcgattcctttgaagaaagttgattctggggatgcaattcaattcgttcaagaacatataatatatcgatttggtattcctcaaactattacaactgatcaggggtcattctttgtatctgacgagtttgttcagtttgtcgatagcatgggtatcaaattattgaattcttcacctaattatgcacaagctaatgggcaagccgaggcgtctaataaaagtttgatcaaattgattaagcggaaaatatctgattatcctcggcaatgccatactcagttggccgaagcgttgtagtgttataggatggcttgtcatggatcgatccaagtccctccttacaaacttgtttatgggcatgaagctggtttgccatgggaggttagaatcggctctcgaagaacagaattacaaaacgatttaacagctaatgagtattacaaccttatggccgatgagagggaggatctggttcagtcacgattgcgagcccttgcaaaggttaccaaggataaggaacgtatttctcggcattataataagaaagtggtacctaaggatttttcggaaggagaacttgtatggaaattgattttgccgattggcactcgtgatagtaaattcggcaagtggtcgccgaattgggaaggatcgttccaaatttataaggttgtgtctaagggagcatatatgttgcacgggcttgatggtgaagtctatgggcgagcgctcaatggcaagtatttgaagaaatattacccaagtatttgggttaacgcatgatcggctagtattgccgatgcatgacagccgatgtgtttgcatcaccttgagatggccgatatggttatatcgcccttagttgtttttcatggtgtaatcggttgtggtttgccgatgtacaatggccgatatggttatatcgcccttagttgtttttcatggtgtaatcggttgtggtttgccgatgtacaatggccgatatggttatattgcccttagttgtttttcatggtgtaatccgttgtggtttgccgatgtacaatggacgatattgttatatcgcccttagttgttttataattttatcaatgcttttgtcattgtaaaattaggggggcacatatatatcaaaatgcaatgcaaatttttgcaaattttttgaggcaaatttttgttggctgattacaaaaatttctgagtcctattacacaaaagttattgagacaagtatcgctggatagccaaaatagccctttgcctgatttgttctacttcttcaatagcttgggcatcttgagcatcagttccagagatgactttcagagacttggttaggtcagcaacattcttgatagccgatttgagccttgctttttgttcttcaattgattttgggagatcggctagctttttgtgttctatatctagctcggcattgcattcttcaagttgtgccaagagctcaattttgcgagcttcgagccgatcaatattggatttgatcggacttttagatagctgatcaagtttggttttttcttcatgcacaagctgccgattagcttggattgtggcctcaatctctttgcgatcacggcgttcggctagtcttagcttggctttttctagcttgaactgatgttgctcgagataagcggctggagttaggacatcggccaaatcttcgggaatcagagcttgaacttcatgcagccgcgtcctaattgacccacagtcaactaccaaactgtctaaagaagaggcttctagccgatgagagatgtcttcaagtgtttttctcacatcatcagataggggagctagggctttgcttgaagtgtcttcttctgcctcgtcaaggtaatctctgatgtcaaaagagaagagatcggctagagcctgcagagacaatttcggaaagaataagagctgagtaaattatagccgatctatttgttgagacaaagggaaacttactgggatagcaggagcagctgattgttcttcctcttcgacgtgatgactacccacaaccgatggagtctgatcacttgacgattgttgtacaggaggagaaggaggaggaggctgcgaaatagacaagtgttatatagaatcggttgagattgattaagtaaaagaattaaggacatcttactggtggagccgatttaacaattgttgctgctgtttttttcttcacagcagttttcttcttctgcaaccacaaagtctatgggtaattagccgaagagagaggtaatttcagaaaaagtcatagagaggtacttactcttataaaatgaacgggggcagaaggagttggaggcgtttgcttgggtgaagccgatggtgttctttttgtgtcacttatttcggctacagtttggtcaacatcttcaccaatttcctcttcatctaaagcttgttcaatagatggatccaagacgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggtgagttgaagtcttgggggcatggtaaccgatgaaagagggagatagtccacctccattcggaattagacctgaagcatattcaatgttcttgccactgttactttgatgaggaggggaggactctgttgtctgcaaaacaggagcaagaggttagtcaagtaatgaatcggctaactggttatgcaatttagtaatgacaaagtttacctggggcatgacgtcagggaatagatctgtcatatacattgaagccgattgatgaaataggtgcagcttccattcaccccaccatctgtcaaagtttttgcttctaaatcctgccaactcaatattatcaacgctgcccagagggggtcctggtaggtttagtagccgatccatcattagagtggaattgatttgtcctcggcactgaatctagtcggcaaagaataagccgattgggagttggcccaatccaagttgtctggccgagctcattgggtgataaaactcgtaggagacttgcatgtttcttccttggtgaatgccgacggggaggatgcatgggctgattgcagctataagaatttctctggatttttggaatttttcatggttaatgtcttcaaatctaaagtctgatggaagttcaaggtctgctgagtcttcgtagggaaaccagattcgtgcatctttcttaaaaccttcgtagaagctgcagaaccagtgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaactgcggaagactagggcgacgaccacaggcacttgacggaaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttctttagcaggttttaagaattaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaatcattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttgacttcttaaggagaaattagagacttgaacggtccaattccgagttcaaatggtcaagttatggccatttgaaggttatatgctctttaaatgaatatttgcgaatttcttcatttaaattttaatttaaaatcggatttattgcatcagccgaggggaggggcgcgcggaccgggtccacgggagtggggcccacgcggcagcctcacggtccacggtggaccgggtgcacgcggcttacgccggccggcgccgtgggtcccacgcgtcagccgcacacgagggcgcggcggctgactgccgggccccacatggcaaccgcggggcgcgctccgaagctgcctctccggcacagccgactggaggcgactcgcccgcgccccgatggtctgcggcggcgaccaccagcgcggcggagcggcgccccacagaggggaggaagggggaagtgaaacggcggtccacggctcaccccgggtcgacggcgacgacggaaacggcgaccggagcggaggaaggcggcggcgcggctcgggtcgacgaggacggcggtgttccggtgatcggcgggtgaaacggaggagtggacgaggtcggcgaggacgcggcgaagccgaaggaggcgatgccgaagcgggaggaggtccggggcgacggcggcggcgaaccggagctcggcggcgacggcggagaaagagggcgacggcccgagctcgattccgacgggga

SEQ ID NO: 78619 - DNA, 974 bp, Oryza sativa
ccagccatggcagtatctatctccaaatgattggcttgggtttatgagcgcaagcttctgtctcctgcagtccatactctaggttccaagaggcaatgcgacaagtgattggtggcatgaggtaaagagaacagcagtaaggtggtgtttggttggagggactaaagtggggctaaactttaatccctctcacaaaaacaaaaacagtagtaaggatggatggatgcaatgtgtgttcagaaatgacagcagttggactctgaaatttgctgcaaaggtagctagtaggggatactcctatataaagtggtcacagaaagatttgtgccatactactccagtcaatgcagtgcagtactcatcttgtcatggaagttgggacactgcgtagcagctgcaggagtgttcaggtaaaaaggatttgagtcagagttcaggaattgttctcctgctagtagtacagaaactagcaatcctctgaattcgtgtgaagcaataagccaagaaagatctgccaagacaccactgcatatcatgatatttaatctttgcagaaaagaattggagatgaaaacgagcttgcaaaacagaaaagaaaaaagttcttcaatctgaaatgacttgacattgtcacacttcgtcagaattactgtactcacagttccatacttccatggcgatccattggccgatagcccgatatatcttgtgttgcaccgggatgaacaatacattggatggattgttcatggctccttgtggtacggaagaatcgattcgtaaagcctatactcgagaaggctgatctgcagctaggcaaagcatcaaacattgtacagtagaaaacaaatgcagagaaacttgagaacgaatgggttgggttcagaggcagccaagccaaaaacaccttgtagaagcaagagagaatcatgcagtagcatttcaggctttgattaacgtggggctgcaggaat

SEQ ID NO: 78620 - DNA, 2212 bp, Oryza sativa
caccacatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctgctgctgctgctacttccaaaagagtacccccatggagggacgccggttgcagcagtcaaaaggcttgcaggtgtcgacctcccattggctcaccgtggctgctgcaaaatgctcgccgaatattgcactgctgccgcaccagccactacgtacgcagtataacgatcaagccaatcaaggagcacttgcctgtttgatagagctcccgctccaactctatccaaccaaacagtttcagctcaaacaggctaaaataatctgaaaaaaattagaatgaggcgaggtttcggctgttccacagcttcactttagctccgagttagatctagttgttggagatctgccaaacaggcttgcaacaggtagcttagctatacacttgtctccttttttctgctggtctctgatctatgctagctccagcatctcccgtgaccgggaggaattcatcgtgacgacagagagaagagacgcgtgcagttctgaagaaacgaaatggattgatgcatgcatagtagttgcagtacacatttgagcgctatagctggccagagaattaatggtggtgtacgtcgtgctccctatagctcgcttctcgctcgtcgtcgtctcatcttctctggaagttgaggtacttgatggccagggcgaagacgacggcgaagagcacgcagaagccggcgaccatgcaggggacgacgccgaggaagtcgtggtggaagcggaagtggtcccggaggaagtcgacggcggtggtggtggtgatgccgtcggcgagcagcagcggctgatccaggtcgccgaactgggaggttagcaggccgtacagggtccatgacaccgggttggcccagtaataccacctccaccacgcaggaatcctctgcattatgtttaagcccattaatcattagccactttaatcacgtcctaatttaaacaaaccattattgcttcccaattgctaaagtggttctagtacatgacaagtggtcactgtaggaaaaaaaagttactggtgggtttggtgaaattattaggggcactggtatatcagggcgggctgcaggaat

SEQ ID NO: 78621 - DNA, 1371 bp, Oryza sativa
tcattgaaattgaaacgatgtgacgaaaaaaagttgaaagtttgtgtgtgtagaaaagttcgatgtgacatatttgggttcaaactttgaatctaaaccaggcctaggagtatgatcttctctcttagtactctttggacactcgtttgctcggttgataaaattgaatgaaacaactaaaaataattaagtacaaatgtggttttttttgtttgttgaaacgcgcagctacagtaaaactgcttgttagtcactcgcaccaggacaaagcacaagtgttgatgagaacagcaggcagcaagctaagggacaagaaggatttgatatccacaaagcacctattcccatgtgtaaatacaggtaaacctttgttctttagcagtttggagctcacgtgatctcttccctacgctttgttcttaccctacttcatagaagtactccgagttacgatttatttttttttcagaaaaaaaaactacaagtgatttggctgaacaatcttcagatattagtaactttatagtttggacactacagtaaacaccaacagaacaaacacaaagaaggatcttaatggccttaatgagctattttagttttatatattagtgaagtgggagaagcaactactgatatcaatcattcagttcacaagctaacaagacaaaacaaacccaagggagaaaataacaggtcttatcagttgtcctgattctcctcctgttgatatacaatattacacaaattttgtttcttccaaagttccaagcctatatctaattggtttattttgattgtgcaccctacactaaactttatacttatacttgcaaaaaaccaaaaggatgtttagtgagtagatgacacacaagattctcttcgacagagaaaagtgagcacccgtactaccaaacggagtatgtagaatatgctatgctgttagtgcattgtccgatgcaatttcagtggtcaaacacaaaaacagatgcagtagacgcctcacaaattttcaggctgtctcgtggcgattgaccaaagaacaaaactccccatttggttcagtacatttatattgaacatgcatgatgcatccaacgttggcacatcggccaacacatttgcatggttgcatactttgcatatgctagctgctactagtgcaaacccaacacaccactagctaccatgtcagctggaatttaatttcttgtgaaagaaaaacaagaatttcaccataacagtcaaatcaaaatattctattttgcgagtaaaaaaattcaaaaccttctttttactaaatgttgtgcatattagttacatagttataaaatattctgaatgaaataattcgtgtttgctaaaattatg

SEQ ID NO: 78622 - DNA, 9072 bp, Oryza sativa
ccggcccaaaagggggaaggggggggcaaaggacttttagggttttttctttttataaaaccattttaactttgtttatttcttcttaattattatttgtgctctgaaaattccactaaaatttatttacgcattttaggcttttaggaaatgtacaaaaaccctccaagccttatttgacttttaaatttacacattttaattgttggaggctttcacatgaattttaattattctatgcataattttgagaatgtattttagagtcgatttgggacgcgacaaccagtccttgagtagctcagccgatagcttcgctccagcatcggttggtgtggatgcatattctccatatgacatgcatctgcgatgggtgcgctcttctccgtcatcttccacaatcagctctggcaattggaattcagcttctgtcacagagggccgattgacaaccttcatgactatcaggtttaaccaagtttgcagcagccaccatggtccacctgctccaactattgagtcgacggctattttagccgatgcattattcaacatctggtacagatagccgagaaggattttgcccaaaggaaattctttctttgattccaaggcttcggctacaaattgccagttggttgtagggccacaactggatccacagaagaggaatttttccagcaacatgagcaagaaagctacatgctctcgaggggtaaaagacccttggcccatatatgcctccacatagccagaccagccacctatgcttttggtcttgaagtcgaattggctcttggtgttcatgctcatagggttagccgatgaagttacatctaatccagtaatcatggtgatgtcgattaaagttggagtcattagcccttggttgaataagaaagcattgatggtgttggcccagaagtaggtggcggcagccatcagaggttcattcttagcagaattggctatggtgagagcgagtgcttggccgattccaatttcgtcctagtgaactttcttactagccgatacgcgttggtaccaggtggtccagctcttatcaggagtaggtttttcgagagatggccaagacttgaaggtattcttccagtgacccaggttagggtttgctagtctaaaggggatccagttagtttcaccgatgatgaaattagtggggtcgagattgtgggccaagaaaatagtggtttttgtgtgaaaggctgggaatcacgactaggctggaaaggtgctgcaaatccaaaggaattgggaagcagaaaacatgaggagaaaaggagaaatcgatttcatgcgaggaaaagggatctagctggtgaggacatacctcagggtacttgtcacgaccggaaataacccaacgggcgttccttacgtgcgtgtattattccttgtcccaggaggcaaggtacaccaaaagttgatacaatacagagtttaacaagcggaagcgtaaatagataatttattacatgggcggcgaaggcccagcacacatgaagacaaacgaaaaacagcggaagactagggcgacgaccacaggcgcttgacggcaggcacgagctagacaccaaagccttcatcttccaggaactcttcttctgggtttggaaaaaattgagcaagattgagtacaacaaccgtactcaacaagacacacccacaagtgcataataaatgcaagggagtacaagggggttataatataaggggttagggtttgcagtaaacagcgttaaaacacacttagttgctcaaatctattttgtaaaaacgatcctagagctctacaagattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaactctaacttgggtacattgctaggcttgcccataaccgagggcgcgactattcgaataggttatactctgatcagaggtgtacatctttacccacaagacacatcttccccacgtgtaaccacgtgccacataccaccacggtatacggacggaagacgtgacatagtttccaacccatcctagccatagacaagagtaccgacccaacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgagattgctagataaagatgaaggtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaagtagacttgataaactttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatcctccccttcttgcatttgagtcgtcctcgactcaagctcatcttcttctcccaaatacggcttcaaatctgcaacgttaaatgtgggactaaccccgaaatctgcaggcaaatcaatcttatatgcattctcattaatctttgctaacactttaaatggtccatcagctctaggcatcaatttatactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggataacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcaatatgagaagcatcatcagttttatgacatggtatgaaatgtgccattttagaaaatcgatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcaccaaaatgtcccatcaaaccgcctccaagcgcttcctgcaacaacaacaagcgaacggagctagctggaatgcatagcttgttagctctgaaaacaaacccatcattgatgacgaatttgttccatgttcttccatccttataatgcagcaacacatcattaaaatcagcatcatgcgcatattggtctttgattgtttctaggccaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcctcccctgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaaggaactcgatctatgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatttaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccccggtggcacttccttgggaaacacatcagagtactgctgcaaaatgttagcaacagcagggggcaaagaatgctgcatatcgtgaagtgaaatcaaagcatctttgcataccaaagcataggcaactgaaggtgatgcaatcaactcattaatatcagatttagtagcaagtaagaatttgggtttcaaattgattgtctcaggtttcttgccatcagatgggcttttttatcactctcacatttggatttggcagccttagcaacatcatcacgcaaaatatcttcaggagacatgggatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcgccttaccactgttgttcagccattggatgtattatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcggcctttgtcgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccttgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaatctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaggaaactcatggcatgcaaatttttggtcaacagcaatctcccaagagaggtacgcatcaggatcatattttccatcaaaaggaggaatcttaaatttaattttagaaaaagcatcatcattgttgcgtacctcgcgtcggcggtgaccacccatacctcgtcgattgttgtgtagccgtcgacgatcttgagcatctcgatcatcttgttcagtgtcagcaatatattcatcctctaaattatcctcgacgtactctccgtcaatatcatcgtcattacccccaccattgcctccagcattgagagcatcaaaatgcctcacaagagcagcaaggctagtgtcaatgcaggcgaccgctgtctccaaccctgtaagcttagtgttggtggagatctgcatggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctaccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagcgggacagcaacaccacaagttagcaaccgtggaacgaggtgtatcggtgctgtagcaacaagacctgtcaagctgtagtcgggtttgtggtggagctgttggtgggctgaaagcaatgctcaagagaaaactagaaaccacattagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtagaaggtggtgacaaagggggaatggtgtggtgtgctcgctggatactcctttttttttttttttttttttgcttgctctctctagtgctgaggagagaggcacaactttttttttttgatatttttttcacaaccaggagcacactagaaccaaccacagaaaatcttatctcaaacggacaaagtatgaagcttgtagaattttttttaaagttctatgcgaataggtcccgaagcttctcgccacaaaaacagaattttgcaagaggaatttggcgattttaaatttgccgaacccggcaagagaatcggatgtaacttttttttagatgtccgtggatatattataagcctaatttcgagtccgtatgaaaaagatatgactgttttaaggaaggtcactcgaatcagggttctatttcctttctagtggcggcaggatacaaggcaactaacaaaagctatcggcaacagatcaaacacaaatagaaagtgatttggtgggtgactgcgacggtggtgacggtggtgatgacggcaaaattgatgaaggtggcgatgtgcggtggtggcaagaacttgaaactctaatcgcctaacactaagaccagcaaattaacacaaccgatgcaatcgaaaactcaacaagccttaactaagcagtactagtgaaaaggcacaatggtctataggatcatggaaaaactaatctactatttttttttgttggtcttttctggactataggaaaaaaaaattaatgacgaagggaagggtaaattctctcaccgatgaaccacgctctgataccacctgatgcgaacccgctagggtttgtggcccaatctttcgatgagagg

SEQ ID NO: 78623 - DNA, 805 bp, Oryza sativa
  unsure (1)..(805): unsure at all n locations
gtcaaagcatatatccactttccaactcttcctttgagaattggagctaatagcatatatttgatcacatcggctttgcatacaacaatgcattcattggataacaaataatgccttaacttggtgcaaaagaagtataaacacaaacataatttttccactagagactaacttgtttctgtatccaatagcctatggcttaaatagaaaatagctctctccttgccctctagttcttgaatcaaaactgagccgattgacttctcatcggctgatagatataacctgaaaggcactctcttttgtggaggaattaaaactggacgagaactcaaatatgccttaatgttgtccaaagctttttgctgctccgccccccaagtgaattcctgatggnctttcaacgtttacaaaggtgtaaaaggttctaaccgtccagacaagttagatataaaccttcgaacaaaattaatcttgccgatcaacgattgtagttgcatcttatcctccggaggttgaattttcttgatggcattaatactcctttgagggacctcaattcctctctcatgaacaagaaaacatagcccccaagtnnnnnnnnnnnnnnnnnnnnacgtttacaaaggtgtaaaaggttctaaccttccagacaagttagatataaaccttcgaacaaaattaatcttgccgatcaacgattgtagttgcgtcttatcttccgaaggttgaattttcttgatggcattaatactcctttgagggacctcaattcctcttcatgaacaagaaaacacagcccccc

SEQ ID NO: 78624 - DNA, 1013 bp, Oryza sativa
tatggaatggttgcattattgtggaattgcattcacacctccccctctattcaaaatcctcaaaatgtttttaggctgggctcggggtgcatggttttgatagtagcacctcggccacataaggaccggtcttcaggcctctgttgcaaagcactaccgtacttccacatgtctagtgggtaaggtttagtttgtggctcagtctggttataaacaaaagtatacggatggagatggacgaagtcgggggtcgatggacatctctagggcaaatgaaggctacacgagctgcggcccagtagtcgagatgtcatggcacagggctggtgtcctgctgctaggggctcagtcctgcctacctgtcccggaggttccggccgtaggtggggttgtgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgtaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaacc

SEQ ID NO: 78625 - DNA, 2083 bp, Oryza sativa
tgattattccccccacttccatcccaaagccgcctcccacataggatcatgccatcagttaaatttaaccagagattctcagttttatcacacttgctgcacttccatcctgtaggtggcacaatgacaccattgtctagctgcttcagatccatagcatgtgcactgacttttttcttgtcagcaacccaagaagccaattgttgttttcgatcagcactttcggcaagtataactttgtcaactgcaatcctaacctgtggagttgtagagtagtaagtaactactatgtagtaagtaagtacaatctcttatgtcaagcacagttaccttctctggcaagtcaattgatggaaaagggagagaagtaaattcaggcaagataacaatttcaaaagcctcatcgtattcgggttcttgatcagtgaaacctccctccactcctataaattgtagaaaacccggattagtaaagatggtcaacgcattcatctatttgccatcatgggaatacagaacagagaaaatacaactatatagatctaaatccaggacataggcaactattctaattacaaataactagcatacagatatcacataacaaacaattcaccaacatggccaccatatgttggtctctgtttccagattagcaaacaaagcaatgcactagcatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatccaaacacaatcacataccctaacgcgattcatgcgttcacaattttaacagtatgaaatacacgatggtgatcagtgggaaagcgctgtcactcataccgatggcgagtagcgtgggcttcttcagcgggcgatccgcctcgtcgtcgggctccggcttccggcgctgcacgatgtggaggtacacggggttcccactcttctcgtagttccacgccacgtgctccctcccgaaccccaggaacgaggtcatgtcgacgtacagcccaccctccgacctctgcacggcgaaatcggcgtcaaaaccctaaccctaggaaaccagagcgaagggggggacaaggcgtgggtgggtgggtgggtggttggttggtttaccggggtgtcgaaggagacgcagcactcgtccttgtggatgcggctgccgggctccgggatgcggaccttgtggaggtgcgagcggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtg

SEQ ID NO: 78626 - DNA, 678 bp, Oryza sativa
tgtgtccttgtactttaaaaaaattaaatggaactaaacacggccaaagtcataaacatagggttgccctgagttgggaacctttccctccaacataaaaaaacgaaacagctcattagcatataattaattaaggattaactaaagctaacttaaaaaaaataaagtaatatgattttaaaagtagcttttctatagattttttcaaaaaaaaatacacaccttttaaccgattaaaaaactcgcacggggaaaacatgggtaaaagttgggaaagctcactgccaaaggcagcctaatttccagccttcgagtgttttgtgagtgctgaaatttcccaaaattcatcatcattacgggtgtgttcggacctccaggttcccaacccaaatcactagtttttcacatgcatgtttttcaaactgctaaacggtgtattttttacaaaaagtttctatacaaaagttgcttaaaaatcaaattaatttatttttaaaaaagaaattagctaatacttaattaattacgtgctaatagatcgctccgttttccgtgcggagacactatgttcccatcatccacatgcgaacacagccgtagaagtactagcaagtaccacactcctactagcagtagatttttgcagtcaaatggtgtactgtactttcttgggcgtgt

SEQ ID NO: 78627 - DNA, 1299 bp, Oryza sativa
tttggaaaagcgagcaaggcaaggtcccatcatccttgagcatattaaatccaagtttataaaattattttgatttaaatattgcattatcgctttacttaaatccccgcgttatcactgtttatttagccatgcctattaacctttgttatgaccttattattattgttattgatattatacccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggccggtgtcctcctgctaggggctcaatcctgcctacctgtcccgtgggttcctgtcacaccccgaagttctcctcccaagcctaaatttaatttacaaatgaccctaagaaaataccggtgcaaagcaagagtaaacccttttaaatcaatgcaaataataatcggaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctccctttttcgaatgggccgctggcccattctctcctttcctccccctcctccctgctgggccggccgcaggccgaggcccagccaggccgccccgccgccctcctctccctgggtcgccgacaggtggggcccacctgtcgggtccttccccaacctcccgccgctcccgccgcgccgccgtgcccgcaaccgtcgccgcgcccacgtctccgcctccttcgggccacgtcgaccacgcccgcgcgtgcgccgcgttccccgcgcccactcccctctctcacccgctcgcgcccgcgcccgagatg

SEQ ID NO: 78628 - DNA, 45611 bp, Oryza sativa
atcgtgctcatagtggaccaataaagtcaaacactctatgtattagacccaaatccacttatgccagaatataaaaataacccaaacatgagatacaccagaaaactgataactatttgtgaccactttaacaaagctatgaggaaggcatgccctggctctaggtggaatgaagacatcaacttgtggaggcaagtatttgtcaataatccggttttcgacaggtaagttatcttctaaaaactcgttcaaaccaataaatttaattctgtagtgcaagggtagctaactatcaaatttccttaggagtttatcgggttttgttgttcatctcttcatgtgtacatggaaaaataaagaaccacatttgtcggctattaatgtaagtcgtgataggcattgattatacatataatacattattttatatttaccaatatttaacttattataaatacatgtgcaggatagtgacgagctaaggaaacttttttttgctaaatctactgatgtaccaacaaaatgagtgtgaaagcaatattcctaacggcgcacaagattttctgaagtgtataaaaaatgcacaacattagggtagttatttaactatatggagtgatttaatttgaggtgatcatccattagaattaccgtatctagaaatgctggatgttccatattttttgcttgtgctttatttgtatgacatcatcaaattttcatagctgtcttctatctatgttgctttttataatttaataaacgccatgagattgttttatgcgccaaaaaggttgcactacacttctataatgataacatatatcttgctttcaaattaatctcaaaacaactatgacttgtagtttcttttcgatgccagattttatcccccgtgatcaacaaaattccctgtagcaacgcacgggcaccctactagttatatatgattattagaatttttaacaattttaaatcttgcatgtggtaattacatatgattattagaatttttaacaattttaaatcatgcatatgatatttatatatgcttataagagtttaaaaaaattttaaatcatgcgtttgttaactatatatgattattataatttttaacaatttaaaatctttcatatgctaattatatatgattattagaattttaatgcattataaatctagtatttgttaattatatgtcatccacataatttactacatattttaatctattttaaatgttttgtcattaattttgtgattttaaatcattttaatgcattatttactattacgttaaacccatatgtaatgaaaataaataagcactgttattatctttagtcccggttcttaaccctaaccggttcaaaaaagaacttggaaatagcgggaaaagatcttttcccggttggtggctataaccggttattaccaaccgggactaaagatcgtctctttagtcccggttggtgagaacaaccgggactaaagaaatctttagtcccggttggtgagaacaaccgggactaaagaaatctttactcctggttgtagctgttggtatttcttctttactcctggttgtagctgttggtatttcttctttactatataattcccagcaatagcactagaaataatcctggtatattacagttactgatgtgatccgcaagtacacgtatataccattgcaacatttcacccgggagtattccaaggtatcatatttattttatcccaaggaaaaatatgataagagagtactatgctaatagtttatactttacttgtatacatcaaggtctatgcacgggtaagttaagcttaagggtagagtgacagacagctgaggatttagctaactcctacatctcctaattatagctaagtggtagtagtttaaatatgttccatttctgtacttctagtatacaacatcttagtatactctaactagtatacactatgttgtataacccctttaacaatgcagcattgctaagccgtaactcagctatgccctcacgatgcatcgcaaagttaccccgggttgctgagttttttacaacaacctgacataaccctccaaccgaagtaggatacataggtgtatccaaccccagtaaattgtatgtagaaatataaacggcggggaagacgtccgtactaagctatcaccatcagcggcctgctactctcccggcgaacatacctctaaataatgatgagtgataacctaaaccctatgcttaagttactacttattactctacagccttgcaatcggtgcagagcatctgggtcctcgggccatagctctcgacctagccagagcagacttatgacccggtaatcagatattataccagcatcaatgcaaatcccagaaggtttaaccacacagattatactacttatgaataaactaagactgatactcatactctatgattggaataaagtaccaaacttgtataaagaagaatattatatttataaatggaagtcttacaaagaagaaaggaaaagctatagaacctttactgaactcctcgaggcctccgcggacttggaactattctaactctactccactaacactaatactaacattgtagagagctttgatccttgcttgagtgtgtgttgaaagtgaatgaggtgaggtccttttataggcaggtatgacggttgtagagcatggtaattgtcggaaataccccacaaccgccatcaggagttcgtccagagcgtccacaccaaaccccatcctgaacggctgtgatggggaaccatgatatggcctaaacggcccaatttttggcaggccgactccttgtttgctcctcaatccaaaacatggaattttgggcttaattgatcatgtcttttctgagttctcagcccatctatctataagtctgatcctcggcagcacctgattgatcgtttgtctattttctgtcgattctcctcatttatatgtgcttctcctgcatacatgttagtagcaaagtatatagtggaagtagatattttatttggaatttgtgcattgcaagcatagctagtcttcatactttggttaatattgatggtcgaaactggtcgataatgaccgtcaacaaggacattatggaagtcacagccgcgccacagccgccgccgccgctgccacaggccgccgccgccgccatcgataccgacgccgccacagccgccatgcccctgccgccgccctgtcgacgccgccatagccgcggccactgccgtcgcctctgctgatgccgccactgccgccgtgccactgcctctgccggcgggcaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacagatggctgatcgcgatgacgaacagatacaatacgacacgatcgtagagggaagcagccagtactagaacaaagaagaggggaacgaggatccgaaccagtaactaaacgaggaggggaacgaggaggaggagggtagtggaagtcaaccctccgctagacagaagagggcacgcggacaacgaggtgctgtgaagaagattgagggtcggcacatcataactgaagtggacaaagacagctgaccaagtgccccgtcagatgcagcctggaatttcgtacgacacagcggttgggttgtgagggataacatgcctgtcagcacggtgtactggcgcagaataaggacacacggggattttgaatgttttgtcccagattcagagaaagagatgctgtggaccataatgctcgagacgttcacgctccatgagggtacggaagacaaagtgaaagagtggactctgaagaaagtgactgaacagtttcagaactacaagggagacctctacaagaaatgcatcatgaaagggcagacaatgaacttcaactcattcccgaagctcagggatcattgggatgactttgttgcttacaagacagggtaacaagggcaagcgcagatcgaccgaaacaaagcaaatcccgctaagaagaagtaccatcaccacctggggtcaggcggctatagcatcacagtgccgaagtgggaggatatcgaagccggcttgattgagagaggtatcgaaccggccatctctaaatggctggaatgatcaaagcgctggtactatgctcacggtggaacgctgaaccccgctgatggctccctggtgttcagcaatcagatacgcgaggctgccaatcgactaacggaagcagtggaagcctcttctcagggcatgtttcgaccggacagagagaaggacgagcttacgctcgctctgcagactcccgaatatccaggacaaacgcgagggaaaggcgtggttccttggaagattggattcaaggaggacatccacatgtacaggagttggatgaggagcaagagagataccgaggcgaagattgcagatctcgaagatagggtatcgaactatgagctcagtatgcaagaggaggtggcaagaaaggtggatgaaagtatggccgcacagcggagccatgagccccagccgtacattcctcctgtcatggtcagcccctcaggcaatcatagcggctgcacctcaacggggtaggtaggataacagagcatcgacgcgatgcaagctcaggatgaaaccacctgcctcgtcgatgaaatcacgcaacggacgccatgtgagctacatattccctttatgaacttatcaatcaaggtatgctcgtagttttatgatttttgacatgtacattctgcaagttgctgcttaggttgattactaatagataacctctcatcacgtgaaggtggcgtcaggaatggccattccaatggacccttgagggacttacatctgcaggccgattccacctggatactcgagggtcggagttgagctagtggaagccgtgtacgaggacctcgagttggactaccttggaggagacggcgagacgcatctacgagacacaagccacgtcattatactatggcgcaagcgctacatcatatttcttgggcgacaagcggcgtctcgtgcaccatctcctccagctcctccgcctcgtgcaccgtctcttctgcctcctacaccatctcctcaggctcctgcaccgtgtccttcggcaccttccaagttaaggtcttgccaagctccaccgcttgtccgcacaagggcaacgaagaaggcgaaagttcaagaccagccgctcgccgaaaacaaagaggaccttgatgcttatgtggtaggagaagtgaagaggcaattcaagcctcggagtctagaaaagaagatacctatagacccgagtgtgaagtacttcttcaagaaaatgtccacaacaaacaaggaggtcttaaagataacggactatgagcgaacacttaagaaagcatattacaaaatgtccaaaccagtccctcagcttggagagcaaccaaaccaagagatcgagccgttggtgaccggccaagaaattggcataaaagaattcatttctgacactgtactagctagggatcaactgcttaaaggcgcaccaatcccaacggcggaaatgaaataccaatttgaactcggtaaaccgcttgtcaagcctgagcagctgaagtccctatcaacacagatgtaccgattccatgaacggtacatggaaatgagcgccaacggtaaacagatgttcggagcaagaatcagaaactcagacttcttccaaggagaagatgttctctggatcctgttcgaggatgtcttcgacctatactatctggatgcccacgatgtctctcttctaagcacatggattttgtaagtatcattgagttagatttatttcattccttaattagctccttgtatatatgtacaccataataattccttttatcgttgtagaatgttgatttaaagggcccgacggtgaggggtttactatactggattcatcgaccctcggaaagttaacatcgaaatgatcaacaagtattagcaagacacagaggacaatctcatccatctcctgacgcagcagcatttcaagatgttcatactactgtcgtacagcacagagtgagtttttactgacttttgaacaaatttcgttcccgtacatacatgtacagtttcatatatcatctcacgcaaattgcagattccattgggtccttttacttttcgacttggaggcatgcgagtcaatgtctatgactcaatgaataaagaggagtctacttttgaccaggtttttcaactgatagacaggtaatgtcatctattccactgtcattacgaattttgctattgctactatgcagatctcggataataattaatcatagcttgcaactgcatgtagggcttgggatcggttccgtcaattggtccatgggacttggaaagaaaaacttggccggaggtttaattttccagtgagtacataatctctaattaaaatataagtgtatattaaatctctcgtcgtttctcatgtagtgtgcaaagcagacccagggaactaacttgtgcggctactacgtatgcgagtatacccactgcctatcaacccaaatctacaccacaagagagctcaatgtacgtattcaaaatttcattgcgtatcgatttcttgtttattaatttcatatattcataggttattcacatgagggacaacctcatacacaaggaatttatcacgtctgttcaagaacaactgataggattcatcaacaaactagtccttttttcttctgacataacaccaacgtcgaagtcgtagctagcgagcacatcaatgaattgtaatacatgtatatatttatatatgtacacatttactttagtgtaaatatatatgttggtaatatatgcacataaactgttaagtgctttaaattatacttgggtaattcatatatgaatttatacatatacatatgcatttgactattttgtaacatcgttactgcggaaagtagttgtgttactacacattgaccgtcgagttactatgtcgttccagcgagacaggaactaaaaaatgtataaatctcaatatttagagagcaatatctctcacgttgtatattatttttctaatccgtctgcaccgtgatgttcgtaaaaaagtgcttaacaaaactagatccatcataactattttttaacgttgttactgcgagaaagcaaacgtgttactgtacaatggttgtcctgttactgcgcaattcttacgagacgaggacagtaatgaggtgggcgtggggggaaatgagtaggcgggtttgaccaacgtttgaacggcggggggcactttgactaccctttgactgaggtgggatgtaggttttgggccctaggaagggtggggaaagtggggttgacccatgggagggggtgtagaatagttattctaggggagggttgtagaatagatttgctatatatatatactagaaaaaaatacccgtgcgttgcaacgggtgaagtctattttaatcttatcattgttatatagtttagttaagaagaaatgcactgtgagttagaaatcatgagctgcagttaggagtccaatcgtctcaagttaacatgcgagtttttttaaaaaagatttcttatatgactccttctgtatttctaaaagcgaacaaacttaaaaccgatatatatatttttagaaaatcatgagctacagttaggagtcaatcgtctcaagttagcatgcgggttttttaaaaatgatttcttatacgactccttctgtattttggaaagcgagcaaacttaaaacccgacttaaatacggatctgtattttcaaaagcaaatgaacttaaaaactgactcatacacggatgatgtaccaaagtaccggtaaaaacatcttcaacttttataatagtagagatagagatagagatagagatagagatagagatagagaagagatagagatagagaagagatagagatatttgatggtttttcatcggatatattacggtggtgatggtggtgcccaacggccaaaagcggatagccatggtgaagcaaagtgacgagccaggtcccggggagattagatcaacttctggaaggcattccatgggctgatgaatagctggatgtgggaaatattcatgggccgatatggtaaagctcccgtccatatttattggatactcacgtttgcctttctttttttcgggaaggatactcacgtttacgttcgtgaaaaaaaaaattcgatggactcgtcgcggatatgaaacagaatcagatatagatgacagtacgaaaagtaggtaaaaacatctttaatttttataatagtactagaaaaaatacccgtgcgttgcaacgggaaaaaacatgagaaatttaagaaaaggttaagaaaaatttacattatgtaattaattaaaatataaaatcgtagctatacatgtatacgatgttgaagaaaagaaaggctcataaaaatcaaggtaaatgtggaaaataaaattttccaaataagctatggctggatttaatttttattaaactctccatgattaattacactatgtgaaatttttccagtattttcagagcaccattgctaattttaataatacaaacatcattctagcatttatttaaatggaaatctaaatgaaaaccctcctttctccttgggccattttgagcccattcttctttagcccatagctgagccggcccattaacctcacttctcctcccgtccaccttggcctgtaaccgcacatccgacccatcaagcaaccacaaagtctaataagcatcccttctcctcctctcactttagtgtggtcccagtgctacagggttgtccctacctccgtccgtatatacaacgcttctaccaggtccgcaacactattccgtgcattccggcccacgcggtcgtttatgcgtttcggaatagcgtgcggcacaaccgcatgctggagaagattgcctccaaggagctcaagaccaccgccaagctcttcgagctggaggacaaggtggctcgaaaggaggaggcgtgggcctggaactcccccggcaccggcgcggcggctgcagctccccccaagtccgttccccgctctaagcggcgagataggaggaggaaaaggaagtcggcccgctccgatgacgagggccacgtccttgcggccgatgggccctcacgggccccgcacaaggaaaaagccaccggcgacaagccgagctccactgctccctccggcgagggtcgatcggcagacaagtggtcctcggtgcacaacacctattggcatagcctcgctgactgctgctcggtcaaaaacttggccgagcggttccggaaagccgatgagaagcagcagagtcgacgggagggcaaagccctcgcgacccccgccaatgaccagcgagggaggccaagaagaaggcccccgccgatgacagcgaggatctggaattctagatacctcagggaaccgtcgccactctcgacaggggggcttgtgcttacacctcccgccgcggcttcaagaccatgaggcgtgagcttttggccgccgtcccaactcacgaggcggtacggaaggcgcactggttggaagtgaaactcaccttcgaccatagcgaccatccgatagtgctcgctcgggggggggggggaggggagttggccctcgtggtctcccctaccatccacaacgtcaagatgaagtatcctagtcgacgggggggccagcctcagcatcatctccccggctgcctttaacgcgctcaaagcctaggggatgaagctccagccgtcattgccgatcatcggcgtgatctcgggacacacgtggcctctaggtcatgttgagctcctggtgccctttggcgactccaccaacttccgcaccgagcggatcgacttcaacgtggcggacctcaatctgcccagggcaggcccgcgttggtgaagttcatggctgccacccactacgcctacctccagatgaagatgccgggccccagtggccccatcattgtctttggcgatgtgaaggtcgccctggcctgcgcggagcagcgcgccgacaacttggcggcagccaccgagccgcagcccccggaggcctccgtgtcccgcgcctccaagaggcgtcttgcctcggccgacgaggtgcccgtcaaggagattccccttggcgatgatccgtccaagaccgccaaaattggcggtacgttggacgccaaataggaaagcatgctcgtctccttcctacgggcgaactccgacgtcttcgtgtggaaaccgtcggatatgcccggggtccccagggaggtgatcgagcaccgccttgccgtgcggccgggtgcacgacccatccggcaccaagccccggagaggcaagccttcacccgagaggaggtgacgcggctcctggaggccggcttcatccgagaagtcatccacctagagtggccggcaaacccggtggtcatccagaaggccaacggcaagctccggatgtgcatcgactatatggaccacaacaaggcatgccttaaggatcccttccctttaccacgcatagatcagatagtcgactccactacggggtgcgaccttttggcttttttagatacctactccgggtatcattagatccgcatggctagggaagatgaggaaaaaaactgctttcattactcctgtaggcaccttttgttatacaactatgccttttggtctcaagaacgcaggtcctacttttcagcgcatgactcgcattactttgagtaatcaaatagagcgcaatgtagaggcgtatgtcgatgacctggtcgaaaagacgcgccaccaggacacgttgttgcaggacttggccgagactttcgacagttttaagtccacgcgcatgaaactgaaccccgaaaagtgtgttcggtgtgccagcgggcaaactccttggttttctagtcttctcccgaggcataaaagctaatcccgagaaaatacgcgtgatagagaggatgcgcccaccccccagcaaacttagggatgtgcagtgcgtcacgggatgcatggccgccctaagtcgattcatatcgaggctaggagagagggtgctgcccctattcaagctcctcaaacgccccgggccgtttgtgtggacggaggaagtggagcaagctctcaatcagctaaaagcttacctcactccccccatcctggtagccccggggccagaggaaccgttgctactctacttggccgcgaccccccacgcggtgagtgccgcccttatagttgagcgcgacgaaggcgacccgcgtcgcgagcccggccatgaaaagggaccaggggcccccttgattggcgatggcccctcgtcccccgacggcccggtgcctgaagccccgaacccctgggagggtcccgaggcccccgtgggaggaatagaggctctggcgggtggccccgaggcctataatcccgacatggcccgagatccccccggggctcctgagcacgggcgccccaggccagctgcccctgacaacaaggaccggccccaccgaaaggtgcagcggcccgtctgctttgtcagcgaggcacttcgagacgtgaaaacccaatacccacaggcccaaaagatgctttacgcagtcttaatggcctcaagaaaattggccactacttccaagcgcatcaggtttccgtcgtgacctcttaccctctcggccaaatcttgtacaaccgagagggtactggtcgggtcgaaaagtgggccatcgagctcgctgagttcgacctgcacttcgaaccacggcacgtggtcaaaagccaggttctagatgacttcatcgtggagtggaccccggtggacgaccctgttccgtccaatgttccctccctcctcggagatgcgcagaagctgagaagctcgcgcgtatctctaagcagtacgagctcgtagaaggagccctctaccggcgtgccgccaacgggatactcttgaagtgtatttctcgggagcagggcgtcgagctcattgctgacgctcatcatggtgagtgcggggcccattcggcctcacgcacattggttggtaaagccttccaacaaggtttttacttgccgaccgcgttgcaagatgcccaagaatgggtctggcgatgcaaggcgtgccagttccacgccaagcaaacccaccagccgccccaagccttgcaggtcatcccgctctcttggcctttcgcggtctgggggctggacatcctaggacccttcaaagcggcccgaggcgggtattagcacctgtacgtcgccatcgacaggttcaccaagtggcccgaggcttacccggtcgtcaagatcgacaagcattccgccctcaagttcatcaggggcatcacgtcccggttcggagtgcccaaccgtatcattacagataacggtacacagttcaccagtgagctatttggcgactattgcgacgacatgggcatcaagctgtgtttcgcctcgcccgcccaccccaagagcaacgaccaagtggagcgagctaacgccgaaatcctcaaaggcctcaagaccaagacgtacaacgtcctgaagaagcactgggattcgtggctcgaggaactgccgcagtgctgtgggcgaatcggaccactccgagttgcgccacaggggaaacaccctgtttcctagtgtatggcgccgaggcggtcctaccttccaagctttccctgggtttgcctcgcgtagcgctgtacgatgaggccaaccaggatgatcttcgccgcgacgatctcgactatttggaagagcgaagaaggcgcgcggccctgcgagcgacgtgctaccagcaaagcctgcggcgctaccatcagcgccacgtccgggcccggtcactgtaagtcagcgacctcgtcctacgccgcgtacagtcgcgcttggggctgagcaagctctcaccaatgtgggaagggccatacaaagtgatcggcgttcaccgagcgggctccatttggctaaccacggaggatggcacggagttgcctaacccctggaatatcgaacacctccgtcatttctatccatagggttgcgcgttttttgctttcctggagctcggccaacctccgcacatccttcggcttgtgcgggtttggccgggggctatcactattaaatatgttgtatcttttctcttccccagcaataaacttttccgcttaagcggaggccgttgagcgccctttcttactctttcctatggctcgtcctggttcaaaggataattcgcgcttactcttgaccctaagtggcgttgggtgacctgaaaaccgccgaaagggagcctaaacgcggggcgcaccctgggctgcggcgaaccctgggggctcggaagggcctacgcatggccatccccaacccccggtcgtcgtagcctcggtctggccagacccgctgggcagctccctcggggcgatggccttgcccctcgccacctaggtgccacagaccgagcgcgaatttcccttttcaccggaacgagcccggggggggggggggtataaagggggtaagaatggcaacttaatcacaagaaagtcaattgaatacgttcgctttggttttttttttctttacttgccgcagacattcaaaggacaaagcaagaacgtaaaggtgcgaaggggaagctttatttacaaacaggatggcacgatggcctaaagtttgaagcattcactgcgagcacataacaaaataaaagaaaaaaggcggggatagtcacggagtgcccgggcccccgaggccggcgccgctgaccacctcgtcctagtcctcgctgccgtcatcgccaccaccgtcctcgctcccgctctcctcatccgaggcaagcgcgaggttgaaccgaggggccgacccctcgaagctggagacgatcgcgtcggccgcctcccggacttgctcccgagcccttgcctcggtccccgggggaaagtcctcgagcgcgcgtcacgggaagaagtcggggtcgcgagcttgatggctcgcgagaaccagctccaccgcagcccgtgccaaggaagccgacgacgacttcacggcctcgccgacctcctcctccagcctctccaaatctgcagccatcccatccagccgaagtgcatggagatgcctacccggcgccccgcgcgctccagccgttcgatggcataggagagttggccaggcccaatctcgttggtgaggcggagggccgcaatctcctcggcttggtgctgcaccaggcgtcccaggtcggcgagagtgtcttgagccgcgacgagctggctgaccaactccgcgccgccgggctacccgcctgccatcaactccttctcccgagcctccagctcggaagccctcgccgccatcgctgcgcgctcagcgcgggcgctctccagatgccgggcctcgcgcccagcgatgacctcctcacgcttggtgagttgctcgcccagccaccgcgccgccacctcgcgacggttcacctcggcctcatgtacggcaagcgcggcgtcctgttcccggcacgcctcctctcgaagccacagctcctccgcgcgacgagccaccaaagctctgcggtgagggtggtccggttgtgctcagctgcggtctcctcacggaggcgaagggaggattccgcctcggtggccgttctctcgtgggtggccaaggtggtctcgcgctggtctagcatgcgtgcccgctcctccagtgcccgggtacgctcctccagcgcccgagcatgctcctccaactcccgggctcgcagcccctgttcccggctacgcccgtcctgttcgcgctggttacggtcgaggacctcgatccgtcgacggatcatggcctcgaactcctgcatggagcgggcacgctcgtctaaggccttgcgctcggcctcgagcgccgcagtccgagcccgcagcgaggcgtcgacctccgatgcccgccgctcttaggcggccgccgcgtcgaggactccacgggcgtcttcccagatcctcggcgtgggcctcgtactgcaagcggatgtcgcccagcgtctcatccaggacgcttgaagcgatgagcgccgcctggcactcctcctgtctcccgcatgaccgagtctagcgtttcctcgcgcgcctggatctccgccagttgggcttggtgcattttgcgccccacctccaccatgtcgtccatggcgcggcgcccctcgtcaacccgcgtgcggtccgccgcgagctgtgcccactccgcctccagggccgcccgctcgtccgctagggcttgaacttgggcattgagcccctcccggacggtggaatcggcggcggcgagcacctgcaggagtggctccatgctcgcgggagttggagaagaaaaagtcgcggtccgcccccgggatgacggagtgctgctagaccccccgcgatattgggggctgctctcggccccccttccgcacggccagccctgaggacgccccagatgcagaggggaacggttgcccccgtcaccccccgccttgggccctcaggaagactcggcctcccgagtagcgctcctcgtgggtcgcgccctcgggatcgccctgggggggcgcctgtaacgtcccgccttcccccaggccaccccaggccgggtccacttacatctgatagctttcataggtcatagactgccctcacagaccaacacgccttcccccaggccaccccaggccgggtccacttacatctgatagctttcataggtcatagactgccctcacagaccaacacatgtcttttctgcacactttgtcctcactcgtgtgcacccggtaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacaccctcaccaatgttacagcgccgccgctgccatcacccgcggctggttgcacctcggctgtggcgaactcggagccagacccgccgtgtggcccgtgggccccgccagggtgctgcgaaggctccgtggcaccgggtcggccgggtcccggtcgatccggtcgcttgaattttgacccctgtgagggatcggacgccgagaccccctaggaaggaatcccgctacaggagaaccccgatcacgttaagaagaaaaagaagggggaggagcaagaggccaaggtggatagagagcaccgagtcgggcgctagcgatcctacctgcgagggggcgtttgaaggtctacttcgggggctcgatgaaactcccccggcacggctccgtttgccctatcttccggagccgcttcttcttccgtccagcctcggacgtggcggggcgtttgtggcccgctggtggatggtccgccgttcgcttagcgcgccctatgcgcgggggagaacgcggccgagattcggacacctttcgcttccctttcgggtcgcaggcccctgaggcgatccgtcactgcgtcgtactcctcgccctgcgtcatactcctcgcccagttccaaaaccgccaaccacgcggcggatcgtttgggagggccggcggggagccgaagtcgcggatgatccggcagcgcggtgtaaaaccaatccgtcttccaatcctcccacttcttgcgaaggtggctctcaatgtactgccccgccgttcctggccggggctagaagtagcatcctcccaccaccacgccttgcagtagctgtgggacgaagaaggacaggaacagccgcatcgtctgcgcaccccgacgaacatctcgcagaagtgcgcgaagatggccagcgtcatcacagcgttgggtgcgagatgctaggcatgaatttcgtagaaatccaaaacctcatggaagaacctggaaaatggcgggatcagccccaccatggcgaaggacaggaggtgcacggatcgctctgggtactgcggccgcggccgcgactcctccaccctcacgacggcgtcctctggcatgatcttgcggatgaggctaaggtgcctctctgccatgatgagcgacgccgggggcacagcgtcaccagcgtcttgggccatggtgaccggcggggaaacggcgaggagtttggtgtacggaatagcgtggagtgagagaagcgttagggcttgaggagcgagtatgcgggtgagcagtcggcgagaggaaggagacgaactctccacctccctatccttttatccccgcctcgcccgcgctcgcctccttgtttcacgcccccgcggttgccccctcgattcctgcacctgcggtttcctcctcgactctcgcacccactcatcacgccgccccactgaacccgcgccccgcgtttggtgcacctgtcagcggcacattcggcgcgggccatgcgatgttcacgggcatggttaggcgggcccgctgtcggtcccgtcgcgtgcctggcaggcgggggagtcgaggcggcgtgggtgatgattctgggcgtggtctggccgaccccccgattttcgcgccctaagcgcctccatcatcggcgcagttagtggcggtcaaatcgccgttatgggcacagttagtggcggtcaaatagccgttatgactaatgcgccagcctggccgcccggcggcaaccgtctggattcctcgtcgggcccacaactcggcacgggaagtcgtgaggcgccacgtcggactgccctcggggggccaatgtccgacgcggtgccgggggctactgtcggagatatgggcccgggggtaggcaaagtgaggggaagttaccttcccatccagtcacgtggctctacagcctggccctccccccgcgcctcgcgagtcgcagaagtagccagggggcctcggggtgccacgtcacgcccctcgggctctcgcgctgcctcccccgaggccctcgtgtcacgtcccaaaacgaccctaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaggttttataaaaagaaaaaaccctaaaaagtcccccttccctcccttgggccgacccggcccatctctcccccctctctctctcctctccccgcggcccatccggcctctccccgcgcgcgcgccgctgacgggcgcgcccgcccgccaccctcgctgacaggtggggcccacccgtcatccccttcctcccgccgcctcccccgcgccctagcgccgccgccgccgcgaatcccgccgcctcccgccgtccccgcgtgcaataaagtggggggaattactccccgtgatcccctctccctttccccccatttttccctctctctctcgcgttcaaacgggcggatttgcccccgcaaatctcgccggcgccattgatgacggccggacctcccgcgccggtttccttcccctccggccgctctctcccccttccaaccctatttaaaccctccccgcacctcctccgtccgttttcgcctctcgccgccgtcgccgccgagctctggtccgccgccgtcgtcgccccggaccgcctcccacctcggcgccgcctccttcgccttcgccacatcctcgccgacctcgtccacctctctgtttcggtcgccgaccgccgaaacaccgtcgaccccgtcgacccgagccgtgccgccgcctccctcctctctgaccgccccctccgtcgccgccgtcgccccggggtaagccgtggaccgtcgcctcctttcccccttccctcccctctctcgatcgccgctccgccgcgccggtggttgccggcggcgaccatcggggcgcgggcgcgccgcctcccaccgaccacgccggcgtggccgccctcgtgcgcgccgagtggctgccgcgtggggcccggccgtcagccgcccacgccctcgggtgcggctgacgtgtggggcccacggcgccggtcggtgcgagccgggtgcgcccggtccaccgtggaccgtgaggctgccgcatgggccccactcccgtggacccggtccgcgcgcccctctccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggccggtgtcctgctgctaggggctcaatcctgcctacctgtcccgggggttccggccgtaggtggggttgggtcggtactcttgtctatggctaggatgggttggaaactatgtcacgtcttccgtccgtataccgtggtggtatgtggcacatggttacatgtgaggaagatgtgtcttgtgggtaaagatgtacacctctgatcagagtataatctattcgaatagccgcgccatcggttatgggcaagccgagcaatgtacccaagttagtgtttttaattcttaaaacctgcttaacaactaaaatgtggaatggttggcctgggttagcttgggacgagctgggacccagggtcgggttgccagttcgatctgaatcatcgtaggccttgggttaaggcaggttcatgtgggttcacggccttgattaataatattatttagctctagaatcgtgtttacaaaatagctttgagcaactaagtgtcttttaatgctgtttactgcaaaccctaaccctttatattttaacccccttgtactcccttgcatttattctacacttgtgggtgtgtcttgttgagtacggtggttgtactcagtcttgctcaattttgcccaaacccagaagaggagcccctggaagatgaaggctttggtgtctagctcgtgcctgccgtcaagcgcctgtggtcgtcgtcctagtcttccgctgtttttcgttatcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacacctcgcccaaccgccatgtggcgggggagcgaccgggaagaagaccaagccgaaccgccatcaatgcgcgcggcgcccgaattgtccctcaccgcgtttaatgcggtaagggcagacgtgcggtgccgcccgactgacccacgtcaatcgggtgtgaccagtctgtgaccggcctgttgccggtcacgtccaattggacgggcaggcgtgcccccacgttgcctctgtatccggcagagtggaggtaggtatgtcccgtcccattggagcgttatccggagttccctccacgtgaggaggaccgctacaagtcttcactcatttaagagggaatgacagggctgtcccccgtgtcaggcggggggcggcgccgggtcccactcaaggacggactgcttgtttagattccgggcgaaggcacggatcgtggtccggtcaaagtaaagtgggtccctctcccgtgaaagagtaggtagaagcggcgcatgtggtatccccttgaactataaaaggaggaccttgcccgccgaaaaaggagaacgacactgagtaggcctgaactctaggaagcgaagagcaagagcgctctccggagtttaggaacccttgtaacattcaaccactaatcccacacacaggagtagggtattacgcttcatagcggcccgaacctatataatcttgttgcccatacgcgatttagaaaccctgagggcggatacacgatctcgagaggcgaaccctttcccccggccgaactcacaaaagggggatctcacgatctcccgctagagaggatcactcctcgacaattggacttacgaagaaattaacgctgaccaaacttattaagattgaattatatttttatcctatgaactgaagcaaattttcttaggtaatcatatagattgattacctgcctaagatctttaggtacctgaatgctatcagatgaggttcactccacctgaaccaatctatatacaattagccaaaattcagtattcagagtaggtttcacacttctggaatatttgcattaaatatttgacttacctaaattatttatgattagcaaaacttattctgagccgcttaaacatcaaatgttcaactgatgttattgttgctttatcttgattcaaattgttctatctaatgccttgtgccctttgactaaattgctctggtctttaccatttgttgatccatccaagcatgtcattagactgcgaaatagaacagtcaacctcttgattgaacaagtattatatttttctctctgatgggatgtatttaccaagttgatgataccaattttccagtagtcatttacgattttttttggctcatttgattattatttttcgatgctatatcacagaaagcactgtggaaaatacaagttctgaacatgctgacaaagcttcacctgctgatctgttgtgcatatggtattcctaccccactaataagaatcggtaaattcaatcatatcacagcataataggtgttaaaaagttaattggaagtctttctaactgcaatctggatgcttttgttactatagtctatttatatttgtcaactgatgctctactatcggtgcttcagagtataaggtgggagtgctgatataatgataagctgaaattgattgtatattgtatgttgcagactatatatcaagaaaatagtatggacatatggttaacctgccccaatttacttgccaaatttataatttgttcagcccaatcaatattttgtaagctagcctatgccatatcatggcttatagagaaggttcttaaaccggcatcaaagtcgtgcaaagcacgactgtatgtggctagttatatatggggtagattagattttgcacctataaatgtccggtgcttcttatgacgtcagaacacgcaaacgtccatgcgagacatttaaaaaaggaggtaaaacaagtatttttcgctttgttgtttgttctctcaaaaaaaaaatcttcgttgttttgcctttattctttttatccaccgacacccccaaacacctcccggagcatccggcggagcgctgggccctcaaggtcgggcacaagttagcagcagcatggtaaacaagcccttgtgagctggcgcgaaacatgcgggatatggagcctttcataacgccaagcacaagcacgccctccacatgtgcctgcccgtacatctcattctgctgttttaagcccaagtgtcatctcgattttagtattgctggccgctgctctgctcctggatccgatcgcattttgcatcgtgctcatgttttcgtcaatagcaaggaattgctgcttgtgtctgggctaggaggttactaggagatagtagatgggaaaggcaccaccattgcatgtgcggcaagtgattgtctctcaagtcttaattgagggagttttttttttttttctttagagcgcaattgagtgaggcatgctgttacagcatggattaccccaaccattgatgacgatagcatattccctatattaaaaaaaaactactagtaacatattccctatattagaaaacaaccaacttccggttatgaatgtgaaaataaactttgttcagatttacgattcatagtttaaagttcattttttagggacgaagcgggtacttgcgtgtctacatgtagaacaaaatagatgggcgaaaataaactgacaaaaaaataatgtggtacaggtacatcagacctaagattaattcccgaatgccaaactatactgatttcttggggttttttattttttgaactttttaattttaaaataatccatcctaaaacttatttcaaatttaaaacttttgcccgcatcacccagtttaacatgacaaaacaatactgtcactctacctcacagcaggtgtgccattgttactaatagttggcgtggccaaaaagattatttagaaataagttttgaagtgtttgtgtttaaaaataaaaatttaaaacgtttaagaaacagtaaaaatttgatttcttgctcctgctatcctactgcgacttattttgccacctactcctacctatatagttttatttactttatacaatgtatttagaaggaccaaaaatatgtcttctaatgtgcaggttcaagaggttggtcagcttagcttctaccataccacctgacacctaattacaccaaccttaccccttccagcttgcgcacgtactactcattagaggaggtacaaacatattttaagaagataaatgaggagagagaaaagcagcgagctatagatttatagccagctgtagcacgaactccaagacctagtgtgtatgataggtgggaccaagtattaatagtgtaatatataactattatattaataagctattagattggctatatataaattggaggtagtagttggctatactattaaacttgctcttagaagtggagaatcataatgaatcacacagcacaaaaaaatgatggtctctacttactcatttccaatttcttcagctatccttgctgtcaggcctggaacattcattatactttcctcaaatcatgctgtcggtagcagcttatcgatcactaatgttcatgtggatgatatttttgatagttaatacagcaatgcagaagccagatggacaaaaatttacaagtaaaaaataaattattttctatttccaatcgagaaatatgatctagatgacacatcatggatatctgagtttaaatccatgtggcagcataattttctacacattagacaaataaattaattcctgccttgctcatgtaatcagaagatggccaacaaattttactaaataaagaacggtgaaaccaaaaatttgtggacaaaaacagtgccccagcttgcaatatattagtggtttctattgattcaattgatcaagaacctccaagagtacaggcttgaatcggttgcaatcaagcttgacgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatggcaagcttagtatatttggtccaaacgagatcttaaagtaaagggcaggcttagcatatcaagtaaacatatatgaaacgagataactaagtcaggtaagaccggctaaaaccccgatgctatctctattaacaaccatagaacatgctacttaacagatcaaactaaactgatgcaacattaagcacatggagaaacataggatctaaacaagtctaagaaagccttttcgagatggtagatatgctatataatctaatccgacacagctatctagccctatcggctattttcgatgatagagactagccgacacggtaatatagcaagatcgatctagattatatagcatatatgataactcagcggtttgtatagacagggctagagtgtcatgaagatataagcactagccccgagaacgcaagccgccgtaacaagctttacctcttcatcgaagatcaaaaccgatgcagcccaactcgaaagcaagaactcgttgaaaacaaagaaaaggaaaaaagggtggcgatgcgccgagagtgtattgaacttgatgttgtttgtttacatggtctcgggtcatatttatacccaaaatacatgatatgtctttgccagacacgactctatctctattacaactcaaaaatatgaacaagtcccttaggtggactcttaccgaaaatatctataaggaaactatgaaaatatcctaattaatagatacaattgtcttctccgagctccatccacatttggcaatacttgtgtagcacctcaacagatcctgacaacgatcccatgattgtcttgccgggattggctacattggcttctccctatcaggttcagtaccagccgatgcagacgacagccgatgcaacccatagctgatgcgggttctgtttccatgattattgatttcctccaaatccgcctcggttctgacttcggatccaatatacgatttaccaattttagccgttaacacatgctccccaagtccgcgatatttgggatgttgcggatttgatcgatcctgtttccactggtatctagggttcattttccatttcggccattaccgcacccttttaaaatagtgatcaccatcctcggatcccacttacaccgtatcgcttccgtttttaccactttcgctcattattccccacgcagcctctactgtagcaatccctaatctcttggcgatctttccagcgatcgcccctcaatcggcaaactcctccgctccgtcaactttgttcggacctatggcgatagtgcacgtggctgagatccccgaggtaagctccttgttactttttagcaattccctcagtcatctttggctctttggtgatccgattccttcttcccttctgccagcattctagggatcatcttttgattcccacctcccagaactccacatgctttttccttgggccgatgggtgatccggatcccaccgagtttatcaatgtgaaacagagaggatccctttcaagtagatcaaactagacttagctcaatggaaatcgactttcaggtcttggctgtctaggttgaaagggtacaagtcatggtacaagaggatggtggctgctaagcgatctcattgggaggaagtaggaatagcgcaatgcctggctttatctatagcaaacctgaaaaaggatgagcccctactttctgctatcggctacttctggtctgatacactgaatgctttcatcttgaggcagggacctatggctcccactttgcttgatgtgaagatgttaataggcctagacatcctttcatccattaatccttttgacgtggacattaaatgctcttatcaactgaacacgaagaagaagaacaatggctggtgaggcttcatcgtcgaccatcggaaaactggtccaatttcggatgaggaacatgctgccttcctctccctatggctcgagaggtttgctttctgtgggtctacttgagcactgactgcgaacttccttcattttgctgaagccctggtgagaaaggaaaaagttcctcttggccgatacctcctaggggcagcttattggatgttacatgtttccttagccaatattcttatagacaagccggtcagttacgggggcccttggtggttggttcattcagctgtggttgacaattcacaccaacaccgtggccaacagaccttctctgcttgaatcggccttccccacatatgactccattgatgatcaatcagattcccagccgtgcaagtcttatggggaagcagctttagtttaccctggtgtcaagccatctattgaaggctttaagacatggttcgacatattttacaacaacgatgctgccgatgttctctttgcctatgacgcctacaccgagtttgatcttccaatggatttagatctgagcaagctaaatgatgaagaagacctgttattgaggggcaattacttggcagcaatctctccttgcgttcttcctacagatgtgtctcagggaagaaaatctttctcttatgagttttatcacccaacatcggctgcaagacaactggggcttggccagcttcccatcaatcttcccttactaaaagttgtagactcaagatgtgaagtatcatcagtcgataccatgaagaaattgttagaatgcaaattcccagtctcagccgatatcggcgacttcaccctttatcagtttaagcatgtcaccttctacagttgatagtcggattggtcaaaacatctcttctctgctccatccgactattgtcttaccaagattgataaccgcatcaaggtaggccgcaatttacttctaactagattatgcccccctccccacgacctaacttgttttgctcccttttttctctctgcagatcttaaaaccactggcaccgaaacacagcctgagtgatcggccaatttgctatgcccaggttctcaagcattccagagggactaccaagatattgccctccccgatcatttcttctgctccgtcaattgaaacattcatgaagactcctactggggttttggctaccgatcgcctagattttggcaaacacaaggatccctcttcaggaattaccgggtcatcacccaagagggccaaggctgatggttttgctgggataagtgccgaagcgttagttgacaatattccgccttctctctcgttgtctccaccaaccagagttcattacgccattcgcaaggttgcattgcatattcgcaaaaaaacgtttatctccctcatggcctttttgtaatccgtctctttcccttttgtaggtgaaagcgtcatcgttgatagacctatcggcctcagcagcgcaagagctgtccccatcggctcgagctgctccgtctgtcgaagccgttaccgaggaaattgcgtctacttcctctaaggctaaggctaagctgcttccccacttctaagcttgatcatcggctaatctttatccgtgcctaatccatcccttcctacaggacctgtccaacatgttttcctttgacgtcaaataatttttgaatgaagatgaaggaaatagccccggggcaggatgaagttagggccctatcagtggagatcgccgatccgcttaatgcctcttaggacacccttgtaaccaactgtgggccaatcaaacaagcgggctttaggggggaaagcagtttcattcttctctctcaccctcttcccctcaatcccaaaggggtggccagagttgagatcaatgatcgactgtcagggcttggttttgggcggtttcggttgtaacttcctttgttggtctagtagtagccagtcatatttagcggtgaccgtagaggtggcaatttccccattagggccgggatttggggaaaattctcatgcgtgggtgagcggggtgagggcagggatgggagttgaccgcgggtgacccatggggccctgaaggtattagttataagttaaaagacccatttgacccattaagtgaaggactatataagcgaaaccttaatttttcccaaatccatacctagccgccctctctcctgtctgagtcccacgtctctccaacctagcaccccccagccaacctacctctttgtgcgctatccccagctgtcaccaccccgagccggcgctgctagacggtggtgcatctttgctgccatgcccagctggcgtctcgttttcgccgccgccctcaagcgatgccgcctcactgcagcgcgtcgcccccaaccgccaccgcttcctcacagtccaccgcccctagctggtctcgcctcctcacagcgcgctagccctacccgatgtagcctcttcgttgccacccctggacggtgctgcctcatcaccaccgtcctcagccgtagacaccttgtcgccgcccccaaccgtcaccacgttgcggtgcgccgcctcttgctgccacaataggtgccctgcagttgctatccattcgggtagtggaggaccccgctcacccgttgggtcctctgtgggggtgagggcaagtgaggttttccacccggtggccaatgcggggccgtggacagggaaaaagggaaaaagcaaggagcggtggctggccgggggcattcttgtccaacccaaccccgccccgctgccacccctatgtggtggatttggtgctggcctcttcttggctctgtgtaggtggtgttgttgtgtggtggtggtgccacccctatatgaccgattcggtgctagccttttttttcttggctttgtgtaagtgttgttgttgtgtggcggtggtttttttttctggctattgactttcggggttttagcgttgtagtttttttctgttatattaaataaattatcgcgttgtctggtgctgatggttcagaaggaatcattaaaattgtagtggtcgtgtgacagtataaaataaataagctataccactgcattggcgtaattttattgttgggttggggggttgaggacactgtatttgcgtcaaagctgagctacttcctccgtttcataatgtaggtcattttagtattttctacattcattaacatcaatataaaatgtgagaaatgttagaatgatttgtgaaacggagggagtagatgttaccgacgcaaaggtttgccggaagagacggttgccagcgctacaagaaattaatcggagatgaaacagacaaaaatgtcagcgtgtgttttgtcggtgtgttccgatctgggcaacgggcctacacggtcccatgtttgacgggaggaggatgatagaaaaaggcactgcatgcaaacctgattttgtttgactcttttcttggcttttgctctctttgtttacgtatacgttgcttcacaaatcaagtaggcagactggtcatatttcagttctcatcacaggatcgtttggtaatataaatatatataaataaataaataaataaatatatatatatatatatatatatatatatatatatatatatatatatatatatatatacgtcctgcctaactttagtagatctgtaatacataaatgtaatttgttaggctggttatttagctgatgatcaatgtggcatggactcatgtctaagatcgaagtcacaatgctgatgttagggcatgtacaatggtctttattagcggttactttttattgtcatgcaagaatatttggtgacgtgaaagagagaaaaagaaagaaagagaaatatggttgctacgcatgacaacagcatagagttgactcttagcatttattaggaaattttttgttgcattgagtctagtaaaggaaagatgactagtaagaaagtggagtattttggtatattaatggttagagaccgtattgtcttaactattataacgtgatagcctttaattaatgtagaaaccataccgatctctacctttgtacttgcacttactagctggcgaacagcgcggaagaaggaaggaaagttgctttgcctcctagccaagatggaaaaggttggcacatgggaacatcgggacagcgtgaaccgggcggtgcggcggtggttgggtcctctgtcgatcgaggtggtgctgttctcatcatgcgttcttgcatgcatccaagggattagcaggattaggcctgtgggataactaattaacatttctccgtgaattaaatttgcaccctcgatttcgtctctcggggcagacgattgaggagccgtatagccggtccatatgcgttgcaatgtcacctcaggtaatgtttgtccgcgtcgaacttcgctggtgtggacgtgtggtgccatgcggctgaactcgttcaattcggttgcactttagagttggaacaggtagattggatgtttctcaaatctcaacgttgtcccaatgccacaggtgcaagcacagtattacctctatcccattaatctagtacgggatatatataacatataactagtactagattaacttattttaggcagaattagtatgtaaggaatgtattttcattccctgattggcaatcaacggctcaccttatttcttatatattatgtaaataattataaaaatgttaaaaaataaaacggtactactccatgaaaatgcaaattcaaatttgactctataaattataaaagataataaatataagcatgaatgcacatgctagtttgagtataatttgtttttttaattaacttatagaaggtgaatttgactttgcatattctttttaagttactcgtcattttagctttgttttagtcaaacatttttaacttggaccctcaatttcttaaattttatatattttcacatcataatatttgtgtttttaaattcaccatgagaaaaactttcataatatgtaattcacatgtaattaaactatatgtataaagttaataatgtttgagttcaaacaaaactaaaacgataaagtaatttgaaacggatgatgtacactctttgtcactacataactactgtagcatcgatggcaaagggcaccctttcctttcctttctttctttctctttttttcttcctttctataaaggaaaaagtacgaattacccttcgaactatgacgatagtatgaattacccctctgaaccataaaaccggacattttataccctgaactatctataccggacgaataaccccctcgacccaatccaaagcggtattgtcctacgtggcaatgtagtcagcattttttttaaaaatggtggggcccacctttcatactctcccacctctctctctcttcctctcaatctctctgtctcatatgtggagccgcgagttggtggccggcgatgggcgtggcgggggcgcagtgggcgtggtggagagtcgggcggcgtccggcggccggcggccagaaagccactgcgggcggcgggcgccatcgccctcgctcaccactgggagcagctccagctccacgcgccgtcgtgctccagctctacgcgtgccacgggcaccatgggcacggcggggcgcgaggcagcgttggcagcgtcgtcgtccacctccttgcgtggtcgagctccagctccatgcgcgccctcgcggacaccgtctcgaccacctccagcgcgctctccagctccgccacgtcgcccagccgcgcccgccgccgccgctgcagccgcctccgattctcagtccacattatgaagaaagtctgttcactactagaattacattatccattaacttcttcagaatacgaaacacaggtgatttgaagaagtaaatcagtgcaaatctgaagccaataaaatggaaaaacattcagcaaacagtgcaacttttggattcaaatgtgcttttgtttgcacctccactattctactgttctacagcgtttttggctccttgcagggtgaagctgtgtatcagctgcgtcaggctttcatacgaggagcctcctttctccatggctctgcaagctttctccccgtactccttcgccttcctcctcctctcgccgccgtccatcagttgtatcaccacccacgcgacgtcaccccgggtgaccgccatggcctcgtcgccgaacaacagcacaggcgtcatcacgccgacgccgagcacgtcgacggcgaaccgctcgttcaggaactggtcggagaagtgtggccacgtcacgaccagcacgccatgggcgatggactccagcatcgagttccagctgcagtgggtgacgaagcctagccgcgcccgcctccgctcgcctagccacgcccgcagccgcctccactcgcttgagtgagagagagaggaggaagaggagaaataggaggggagagagtaagtgggccccaccattaaaaaaatgctaactagagtgccacgcatacgccgccacgtaggataaaactgccatgtattgagttgagggggggtaattcgtccggtattgaaagtttaggtgagcgatgtctggttttcaggtttagggataattcggtcgaccgcgataatttgaagggtaattcgtactttttccaactttaaaggtggggaagtgcactcaatgttgaacgctcccatggcaattacagaacactagtggttgggctattttattttcaggggcagaaccagacctgattgggctatagcccagaggactataatttctatagtacatggtttatccagcacagcagacttgagctgtttcctggcccatagtaggccgtagctcaagttccccgcgaccagcgtatatgttaggcccaagggcaaggagtcatctactccttctatttcaggatataaaacgttttgactttattcaaggtcaagctattctaagtttgactaattttatagaaaaaaatagtaatatttttaaccaagattattatattataaaaatttattcaattatagatttaatgaaactatgctggtgttgtgaatattaatatttttttctatagagttagtcaaacatagagtagtttgactttggcgaaagtcaaaacgtcttgtaacctgaaacggagagagtagacaaaaggaccctgtcaagccgcaggtaccagataagacaaccgcagcacaagactaaggccctgtttgttgcaagtaaggattattgatttagattacttaaactggattataataagctatagtagaataagctattagttgtttttttctctcgattattagagtatggattattcggtttgaaaagctaatgtttataatggcccagttattgtagaatgggaggaggataagacggcggtggcggcttggggaaggatccggggtatagggtgtgggcttggggaagggtttgcgtgcggctagggagagaggaagcgaatgcacgcgctgccgggggaggcgctggattcacgtacgacctgggagagaggaagcggatgcacgcgcgatcaggggaggcgccggattcacgcgcggctagggagtgaggaaggagatgcgctggatctgttgggtttgatggcagtggtaggtaatttacatacaatttataaaagtagtgggtctttagccacccaataatccttaaaaaacaagtttagaggatattaccagattatattattcttacttatagattataataatatatcataataatctgtctgtttgtttcagattagtaattaaccaaattaaaataattctaagctaaaacaaacatgacctaaatcatctcactagttgcaacaaggtaataaataacgggaaatgaaaatcgagagcgctcccggttttgtgttatcatacgacgtgttcgacagccatccatccatgtcttcgttctatgggagcaacaggcttgactctacagcaatggcattaaagcgagaaacctgcacaccaccaaccatcaaaactaaagattttggtttcactggcctattctttttttaagcaatagaattgatgacttatatattttaaaccactagaaaaaatacccgtgcgttacaacgggtgaagtttattttaatcttattatttttatatggtttagttaagatgaaattcatcgtgggaggtcgcttggatatatatatttttagaaaatcatgagatgcagttaggagtccgatcatcttaagttagcatgcgagcttttttaaataaatttcttatatggttccttctgtattaccaaatgtgaacgatcttaaaaccgactcaaatatggatatgcattttcaaaagtaaacgaacttaaaaaccgactcatacacagataacgtaccaaaataccggtaaaaatattttcaatttttataatagtagagatacgaaatttattgtgagaattcgcttggatatatatttttttgaaaaatcatttaggaatccgatcatctcaagttagcaggcgagtttttttaaaagagatttcttatacgactcatgtatttttaaaagcagacgaacttaaaacctatctcaaatacggatatgtatttccaaaagcaaacgaacttaaaaactgaatcatacactgatgacgtaccaaaataccagcaaaaacatctttaatttttataatagtagagatatattatttctcactttcctttttaccatcaagctgtactcaaaatacacgataaaacgagtccaatattgaatatattcaaacatttaaagtaattaacttaatctaaaagtaatttgcttaaatcgtagaagtaacttagctctgcaatagaagtaactacctatgtagcattggaagtagttatcctatgtagcattggaagtagttatcctgaccaatcagttgatgatgactgagatacgaaaacgtggatattgtacttaccaagatacagagaaacgataccacttgcccttgcccaggaaaagaggaccacatgatttgctagttgtcatctcgattcatgtgcatgttactgaggctaacaacactagtatattttcttttctatagaatctttgatgacctatatattttagacgtatattatttttaagatccatttgaaccgtcagactctacttaaaatatgtgacaaaatgagtcaaatattgaatatattcaaattatattttttctcaactcctccagaagtgtagttacttatagaagtgtagttactactaatgccgtgacgagttaattctccttagctgtacagtcacttctaatacctttaagagttatttctatttttttcatagttacttgtctataggattttatttacttctaatattacgaagagttacttatatttctttaaaagttactttgctccagtaatggagttacttttaatatcgcaaagagttactttctatatgacgcaatattttatttaaaaaacatagtgattactttaaataaagaatatatgtatttacttgaaaatcttctctacactttgcttttcctgtcgatttactccacatagctttcttatttcaattcactcataatgtaactacttctaatgctataaagagttacatctattgcatagctacttttgcaatttaaataaattacttttagattaataaaaattttaaatatattcaacaatgaattcgtttcatcacatattttgagcggagtacaatggtgcaaaaagatcttaaaaataatatacggtttaaaagatataagtcatcgaagaggtttaaaagaaagatacgctagtgaccaatctatataaatggttgttgccatttttagatggtaaaggaggatttatatgtcacatgggataaactggtcgctggtttggataaaccagcgaccgtgcattgtgtagtcatgtccaataaataagtaaattatccttataccttgaaagctcacacaatatctctcatacctttaaaatttacccgattccttctatactcatgaaatttcaacttatccattccatactccatccatcagttaactgtctaatttgtataaaaatgaccattctacccttacacttgggtgaacaaagaaatttatgaattacattattgaaaatataaaattttttcgcatgagactattatatttatgatttcctgtgcaacacattattttaatttattgcatttggtttatttaaaaaaattatgttaaatttttttattaattatttaatcttattagtttcataaaatgcacatactgtgcacccaaagaattttttttagttttccaagcctatattgaaatttacatcatcaagggcattaaagacatttgtaatcaaatagtgaaatgaaggaaaatgtaacggcaggggcatggaatggatcaaattgaaatttcgggggtatagaagggatcggttaaatttcacgggtatgagacggattgagtgagttttcaaggatatagaaggaatttacttggggtgattatacctgttagtaccagattctaaaaatttgtgcaccaaatgtttttttaagatgattagtaaatagtaagatgaagaaaaaatcgatatactaggtgcaatagtacctaagagtcccgaatgataaccagattcagtattcttcaatgaaacattctatgattgtgattgattgtggttatggtacaaagatactggatatttgcttgaaatacaaggatgagtcttcttacgagatgagtatctggtaccgttcctataaaagtgccagtactaactgacctacatgttttatgattcaagttgtagaaaaccatacatattttcacacttgacacttaagtacatatatattttggtagtttagtttcacaaaaccacactatcgaataatggatttacccgtgtgatgacgtgattgttccatctaggatgatgacgtggcatatcctattaatttcgtgcgatggctgataataggatcacacgtcctcgtcctatgtgaaacagccacgtcatcccgcgggtgaatccattcattgatagtgtggttttgtgaaactacactaccaaaatatatgtacttaagtgctaagtgttaaagtgtatgtggttttctacaacttggatcataaaatgtgtagttttatgaaatttactcttttattaactgaacacttggtttttttcttcttaaagaaatcactcgcctcgagctagttgattttattcatcacgtaagtccttccacgagcgagttggctagttgtagttgttaacgtgcctttcctttcatcttgaatattaatactccctctgtcacttaatataagagattttgatattttgcttacattatttgaccactcgtcttattcaaaaaatttatgcaaatataaaaaacaaaaatttgtgcttaaagaactttagataataaagtaagttataaataaaataaataataattttaaattttttttgaataagacgaatggtcaaacagtgcaagcaaaatatcaaaatcccttatattaggggacggagggagtaaatatttggatgtaataaatagtgtttatagcatgtgctagagctgtaccaagtgatagagctgtaccgctacaagatagcagcctggatgtagacttaggctgtgtttaagaagaggagatagagaagattgggaagatacgcaaaacgaggtgagccattagcacatgattaattgactattaagtattttaaacttcaaaaatagattaatatgatttttttaaagcatcttttctatagaatttttttgcaaaaaatacaccgtttagtatttcgggaagcgtgcgcgcggaaaacgaagcaaaactcactaacaatcacccagatcacctaggaaagaacacagccttagcgactgctattttaacttagccggttgctatcgcatctgcagttcaatttagcaggctgttatagcatgagcctattttgttagttgattttctgccaaaacattatatgatgtaacatccaatgactagaacatcatgtctgcttttaatttaagttggaacaagacatcaactcttcgagtgctactaaatctcaacttatcttcataggttatacatatattgatctatcattaatttatttctcagttgctttgttaatattttataaagtcattactcataattagggctagacaaaaagctcgtgactcattagctcgctcatctcgtcactagcttggcatgactctgttaacagtgaaatttggtaagcccggactagtcattggcttagagccagcatcggctttgaagtcctgagattagccgatgagagttatcaagtcgtcagttgtcggattcttgctatattcggttaaggaaattgatctactaaagg

SEQ ID NO: 78629 - DNA, 1227 bp, Oryza sativa
tagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctt

SEQ ID NO: 78630 - DNA, 1715 bp, Oryza sativa
cggcgcgcgtcgtcagcgtcagcgtcttggggtagcggagcacgaggaggatgttgccgtccttggtgatcggcggctggaacctgtcgcggtcggagtgcttggcccagccccacgggttggcggcgtcgccgccgcgcgccggcaggacggcgtcgccgaccatgcacagcacgctctcgccgtcgtcgttctcggtgtacaccccctcgagcagcaccttcagctcggtgttcccgggccacaccttgaactccggcgacacgtacggccccatctccggcccggtgccgttgcgggagatggcgacgccgagcacgccgctcacgttcagcgccgtcctcccgcgccgcgccgcgtcgacgtgcgtgagcgagaacgacgcgagcggcagcgggtcgcgcgccgccccggcggcggcgtcctccgccacgtcggtgccgtcgaatggcagcagcggcgcgccgccgccgccgtcgccgtcgccgtcgtgcttccagtcacccttgacgaaggacagctccggcatgaggccgttggcgcggttggcgtcgaacgtgagctccgccgcggaggagagcacggacttgcactgccgcttcacgtcggcgaagcggacgtactcgtgggggatgaaggggccctgcccggcgccgccgcccatggggttcgcatcacggtggaacggatcaaacgacgacacgacggcgagcagcggcagcagcaacgcgccgacaagctgcagacttcttgacaccattgctgcgcaaaaccaaacccaatgtcacaaactcgcaatctgaactcagatgaatttagcaacgctgctttggatcaaatttgaccaagtgagtgattgacatcaaaatcttcacacttcttggcaacttggatgaacacaacaatgcagtaaaactaatccttttcagcttgcatgatcagatcagtatcaacttggatgaacacaactatgcagtaacacttgcagaagaatgcaaaaaatctaataaaatttctgcagcatatctaactaatcctgttcagcttgcatgatcagatgatcagatcactgacctcaacatagaaatttcttcagtgctcctcaagctgggagacctcgatgagagtgaggtgagtgtcgaagaactgttcaccaaggacggctctagtacagactagagcagcatggatctctgaatttgaccagaatgtggtgtcagatctagaaaaaattcccggaccagattggatcagctggaatctaatctaccaccactgaacaacactgatggatggatgcttcccccgcattatctttttccacaccttaattccccttctgcatcatcgaatcaatcaagggttctagtatagtattgggggttgactttgcgacgaagtgacccagaaacagagggttacacccttgatcaccgagaatgcccctgatcagagtgacttatcacaggattgccactgtgagaggatcgtctcggtacaaacgagcagtggcatttcggagattatctcgcaactgtgagggttacagcgaggtgaggatgggggagttgacgaagcgacgcaggtggcgcgcgcggccgccgcggcgggcatcgcggccggccggccgctcgccgcacggggaagcccgtgccatgtcagggcggctgaggccacgagagggacgtcgcgccgtcacatggccgcacgtggcc

SEQ ID NO: 78631 - DNA, 846 bp, Oryza sativa
tttagcttaggttacatacaattactcaccatgattgagaagctgcatgcagagagggagctcacgcttgaaggcgtcgatcttgagcctctcttcctcgagacgtgacaagaactcctgaagcttctgcgtcgcctgccccgacgccgcagccaccgccgtcagatggtggtggtcgtctagggttaggtcagaagacgaagaagccatggctatcgatctcctccctccaagtatacaagctctacaaaccaagctagctcacgctagctagctacagcaaatagccgaccgatctagctagtatattactactactacttgagatgaagtagctgtgcaaactgcgagtgtaagtgtgagtgatcgagatcgaatgtgagaagggttttgatgagggatcagatggggaatcagcttctttttaagggagagttttgggagaaggaagaggagaataaagttggatttagaggaaaaggaaaagctagctttgtatgatcttgcacatatacacttagctaaacagctatagctagctagcaacagtagtgagagatcagagagagagagagagagagatagggggataaagcaaaggcatggtaacttcttgcaaagatcaaaggcaaacaaaaacaaaaagaaaaaggttaattctgctcctcctctgcatgcaggaggtttcatgtactacgtaccaacaggggaatcaacatatctcctaacattacgaccagatgggtccatattgcatatattgcaccatgcattgcattctctctctagatctctctctctctctctctctctctctatatatatatatatatatatatatatata

SEQ ID NO: 78632 - DNA, 7311 bp, Oryza sativa
attcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaactgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggctttgtccgtgccgtcgaggatgcctgtggagtggtggtcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcaggaatttctgggcgtgacaagttggtatcagagccgaacttgaccgtaggacaagccaaatggaaaaacctaagagccctccgaatccttttcattgcatatgttctttgcaattggatttgttccgggaaaattgggatctgttcttgtggttcaaggggaaaaatcttgatcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgcatgacgctggtggtgggctaccccaacgcgccagagtacacgactgttccaccactcagtggcgagcttcctcaccgtgttcgcctggaggtccacggctacgtgggtacctgtctagctaatatggtggttgaggcatccggaggcacagcagatcacgcctgtcaggaggcaccatacctgatgatggccagactacgggagcgccacaactacatcttccacgacacggcgtaccgatttcacccttgtcgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagagtcttcccgcgccaggaggagtccggatccgcactacaccccgcaagacgacgacggcacctgtgcgcatccagcctgcgcccaggaacccacctccgcccgcagttcccgcacctccagttccgcccgcagctccgacagttcctgcagctccagcaccagctccagctcctgttcacgtgtcagctcccacgtccgctctctccttcgctccagcatcagctgccaggggtccagccagtggcaacggaggttggttgtctgctactcccagtggcagccgcgatctcagcagcaacagctccagtagctcagagtcgggcagcggcgagacttatctgccaggctccaggagtcgctcagagggacctggtgacgagcaggaggacgccttcgactccaccgaccgcaggagctgttccgagcattaggctcgttttccattagtttatcgactgtctagcttctgcttgttagtttgtgtgtttaggttgcttgtttgggatcagttgacggtcgatatcatgtgcctctgatatggctgtctaaataaggatttttgcttgctctttaagtgttttaattcagatcagaacaattgcagtttaaattcctatgtaataaagcttagttcctgagcatctgtttttcttctttcccccgtctgcttttccctccagatggtctacaccaggaatggtagccgcgcaacaggcgagggcagcaacggcgaagagcgcactgatggggcgcatccccacagcgattccggcaatggtccgccaccacttcccgagaatccgacgctagcccatgtaatggcacatcagacccagatgatggcagccatgatgcaacagatgcagcagcaccagcagatgcaccagcggatgctgcagcacgccgaacagcagcatcagcagtttggtccccctccccctcagtccaagttgccagagtttctacgtgtcaggccacccaccttctccagcaccaccaaccatatggaggcgaatgactggctccatgccatagagaagaaactgaatctcctgcagtgcaatgaccaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacgggactgtgacggagtacctccatgagttcaatcgtctcgcgcgatatgcacccgaggatgtccataccgacgccgagaagcaggaaaagttcatggcaggtctggatgatgagctgaccaaccaactgatatctggagactacgccgactttgagaggctagttgacaaggcaatccgtcaggaggatcaacgcaacaagatggacaggaagaggaaggccgctcagttcagggcacctcaggggagtcaccagaggccgcgcttcgcttccgggcagcagggtggacctaccaccatgatcgtccgccagtaccgcccgttcaaccctagcaactttccccagggcgccagaggcagtcagaaccaccatggaggtcagcccagccgcggtgcagctccacgcccaccaacggcaccggcacagtcaggcccgtccgcgcaagccaagaaggagactggaacaaaaccagggtcttgcttcaactgtggcgagcttggccacttcgctgacaaatgcccaaagcctaggcgtgccgggacaaggtttatccaggctcgtgtcaaccacgcgtccgcggaggaggctcaagcagcaccagaggttgtactgggtacgtttcctgttaactcaatccctgcaacagtactttttgattctggtgcaacgcattcgttcatttcaaagaagtttgtcgagatgcatgggttaataagagaggaacttagcacaccgatgcgggttcataccccagggaatagctccacttcggttcaattcagcccttctataacaatagaaattcaaggatcaccatttctagccaacctcattcttctcgaatccaaagacctagatgtcattcttgggatggattggctgaccaagtttaagggagtcatcgattgtgcgaatcgtaccgtcaccttgaccaacgagaagggagaaacggtagtgtacgaatcaccagacgcaccaaagcgaggggtctctttgaatcagattgaagcggaaatcccagtggacactgtggagaagaacttgaggaaattggaagatatacccatagtctgcgagtatccagaagtattccccgaagacctcactaccattgcacccaagagagagattgaattccggattgacttggcaccgggaaccgctccaatttataagagaccgtacagaatggcggctaacgaattagccgaggtcaagaagcaggttgatgagcagctgtagaaagggtacattcgaccaagtacttcaccttggggtgctccggtcatttttgtggagaaaaaggataagacgaagaggatgtgcgttgattatcgtgcactcaacgaggtcacaatcaagaacaaatatcctttgccgcgaatcgatgatttgtttgatcaactgaaaggagctaaagtgttttctaagatagacctgcgatcaagctaccaccagttgagaattcgggaggaggatattccaaagacggccttcaccactcggtacggattatatgagtgcacggttatgtcgttcggacttaccaacgcacccgcattcttcatgaatctgatgaacaaagtgttcatgaaatttctggacaagtttgttgtggtattcatcgacgacatacttatctattcaaagtccaaagaagaacatgagcaacatctccgcctggtactcgagaagttgaaggagcaccagctatacgccaagttcagcaagtgtgacttctggttgacggaagtcaaatttttgggccatgtcattacagctcagggtgtggcagttgacccatcaaacgtagagtcagttaccaaatggaccccaccgaagaccgtgtcgcagattcgaagttttctaggactggcaggttattaccgccgattcatcgaaaacttctccagaatcgcccgacccatgactcagttgcttaagaaagatgagaagtttaaatggacagttgagtgcgataagagttttgaggagctcaagaagaaattagtatccgcaccagttttaattctgcccgaccagatgaaagacttccaagtctattgcgatgcatcccgtcacggacttggatgtgtcctaatgcaagagggcaaagtggttgcgtatgcctcgcggcagttgcgtccacatgaagggaattatccaactcatgacctggaattggcagcagtggttcatgctttgaagatctggaggcactatctgattggcaaccgctgcaaagtatatacggaccataagagtctgaaatacatcttcacccaaccggacctaaatctccgacaacgaagatggttggaactaatcaaagactatgacatgagcattcactaccacccgggtaaagccaatgtggtggcagacgcgttaagcaggaaaagttactgcactgccctatgcatcgagagcatgtgtgaagaattgcggcaggagtttgagcatctcaacgtgggaattgttgaacacgggttcgtagccgctctggaggcacggcctatgctcgtggatcaagtcagagcagctcaagtaaatgattctgaaatagcagagctgaaaaagaacatgagggtcggaaaagcccgagatttccacgaagatgagcatggcacaatctggttgggagaaagattgtgtgtacctgacgacaaggaactgaaggatctaatactcaccgaggctcatcaggcccagtactccattcatccaggcagcaccaaaatgtatcaagacctcaaagaaaagttttggtgggtcagcatgagcaaagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctatctctcgagaatcatgtgtctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatacggaattctcgtacaacaacagctaccaggccagtctacaggtggcaccgtttgaagctttatacggccggaagtgccgcacacctctcttctgggagcagacaggcgagcgtcaactgttcgggacagaggtattagcggaagcagaagagaaagtcagaacaatcagggaaaggttgaggattgcccagtctcgacagaaaagttacgcggataaccgccgaagggagctcatttttgaagcaggggattacgtgtatcttcgtgtcactccgctctggggagtacaccgttttcagacgaaaggcaagttggtaccacgcttcgtgggaccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgtatacttgataccagcgaaagaagaaccagaaacaaggtcaccaagttttgccgaattcagtggagtcatcactcaaaagaggaagcaacctgggaaagggaggatgagttgaaagccgcccatctgcacctcttcaccagctcctccgaatctcggggccgagattccgtttaaagggggtaggtttgtcacaccccgaagttctcctcccaagcctaaatttaatttacaaatgaccctaagaaaataccggtgcaaagcaagagtaaacccttttaaatcaatgcaaataataatcgaaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctccctttttcgaatgggccggtggcccattctttccttttcttcccctcctccctgctgggccggccgcaggccgaggcccagacaggcccgcccggcgccttcttttcctgggtcgccgacaggtggggcccacctgtcgggt

SEQ ID NO: 78633 - DNA, 1586 bp, Oryza sativa
  unsure (1)..(1586): unsure at all n locations
acaagttgttcatcatcgcatcgagttgcaattgctcattgtcattaccaaccatttcaatcaccaattcactatcctccccgtctaagcaagcctgcatcgacctcaaagcctcgtcatcccccatcagtccagccccagcccccaactcatcgccatcggcatcagcctccccggaagtgcctccggcgaaaacaacctcttctacaccctccacccgctcgaccccagcgactctaccctcctccgtcccctgcggcaccacgccgggatcggtggtagggttcacggcggcgtccggggacgccgaagtcgaaggcgtctcgtgcggagcatggtttcccagagccacctccacctctaagttcttcccccgatcgcctcccacgtctgcaggaggcggcgaatccccatggggaagcccgccggagccgccgggagggatggcggcggcggcggcaggctcgacctccgcgtcggggcgtgccgcgtgccgcggagggtgcaggtggaggcagtgcgagaagagccgggagagcgcgcggtaggaggcgctgtcgagatgggctctccggcgagagaggacatcggtggtgggcggcgcggcggcgagggaggcaggagccgccgcgggcgggacgggcgagggttcctccatggcggaagggactggatgagtgggtcggagctagggtttagggttcgcagctgtgagctgtgcgtcgcctcgccgcggctgctcgtcggcggcggcggcggcgacgtggcggcgagacgagaggaggaaaacccatcgcagggaaaggcagaggcggcggcaaacgagggcgcggccagaagcccagaatataggcctagtaattgggcctaatgggccttgctacagctggttgagtaaaggaaaaagaccacttagactctcttaatagttcaccgaatctaattcgtgacccttaactagaaaaccgggtaggacgactccccgaattattgaaaccagtgcaatttgactcctctagcggttttggagggcggtttcgctaacgtggcactgacgtagctttacaattaaaaaaatatctgtgggaccaatctatcattcacacacaaaatatattgtgggacccactgacatctggagcccacgtgtcatcctttccctttcttcttcctcctccctctctctctctcccttctctctctcttctctcccccttcggacgcacgcgaggagcgggagccagatcggcgacggcggcggccacgggctggtacggggacggatcgcgcgcgcggcggtgacgagngacgtaagggacatcggcagtcaggacgcacgngttgggcgctggccagggctgaacggcgcggcgtccatccgaccttgctccgcgatcatccaaggcgcggacccagccgactggctacccactctaccttaaagtcccagagctgcagcctctgctctcccccattggtcgtcgccgccggagcagtagcagcagcgccgcacgacggctgcaaggaagaacgagaggccggcgaccgcagccggagcggcggcgaacctctgcagcaggcagggg

SEQ ID NO: 78634 - DNA, 4988 bp, Oryza sativa
tcaactattcttcagttagcctctaccatgtgcgagtagagtttcttctacgctggtttgcatggttacgagttgaaatttattttaaaaatacttttgagaatttgttgtggccatgtaatattattggattaattagctgtagtgtttcttttaggcgtagtagctagccacctcaagtaaattcggataaagcagaccttacttaggtccgtcatagggtagggttcacgtttttttctttttgacgaaaatcgactgaagaaccgtgaaatttcgaggtttcgatgtgggaagaaagtatatcccgagtgaaagtttgaatgggttttgagaattcaaatttcataatccaccaatccctatgcatcatctggcaagtgataggttttgaaatctcctgtgatataccaagcgaacttgcgggtggcgcagctgagtccccgtctcggacgctgcgagttcgcatatttcctttccatatggcgacagtcagtggggcaatgactgtctagttaaaaataaaaaaaaattacaatgagaccgcacaccagcgcagttggcacgacaacggtgaagccagtgacggccccacgatgtcttgcgaatgaccagcggccaccaagaggatggtcgaggatgtacagcaacctctatgatggcgccctcgccgatgcgtgtccccttcttttgccccttgccggtggatgacggtggccgggccgctttggttgttttctgccatggactccccgatttcctccttcgacatggcccctgacgcgtcctatataaaatacgcttccttggtttcctccttcgacatgatcggagcgttccccttttccattccagtcaacacagcacccaccatgttcttgatcactgatggcagcgccgccttcgttttgacgatgactggctcgatcacgaattctctcagcggaggagatgggcatattggggaggagacatgagttccaccgtatttttttatttttaaccggacagtcactgtctcattcatatgtgggttccacggcaattaggggatttcaactaatcctttccggagaattagacggcctacccgaacaagttttttatttggtgggtaacatcaatgaagctagcacgaaagctataaacttagaagaggaaaacaaattgaagaaatgaaattaatctttatgtactgactcctaagcgaattatttgggattgtgaagtgaaagaaatcattttttctactaatagtggccaaattggcgtattaccaaaccacgcccccattaacacagctgtagatatgggtcccttgagaatacgcctcctcaacgatcaatggttaacggcggttctgtggagcggttgtcagctgaaaccaccatcgaaatcgtcttaggacattatttgtattggttttggaagttgagggatacatcatatcagtctggtattgcagttcagggaggaattcagacttagcgacaaattgaaggacctaaagtgaacttattctttcttcatcacccactcagttttgttaggctatgtatggatcttggtgggggctaaaatagcctaattccaattcaggcccagattacagatcacgcagaatggcattccctaaactttcttataaagagttgcgtattattagaatccaggcatgcacttattagaatcctcgagacaaacatagttacatgggagggaaattctcatatctcaagtgtccaaattcatcagcaaaatgtaaacaaaaacaaaaacaaaacgaaatctcatctttttggactgaaaatttcaaacattttgaagccgtacgtcgtcttgctcagagcatgctgtccgcccgcgacggcaggcggcggaagaagttgctgggcaccgccggcaggcggctgcggaaccgcgggtggcggagcaggtagaggccggcgacgagcgccaccaccctgaacggcgtcacgtagagcacgacggcggcgacgaggcagaagacgacgaagaggcacgtcgccctcgggtcccgccaccccagcagcgactgcagcctctccccctgcgtcgccatgtcgccgaccaccgtctgtatcctcccggcgacgctcctcagccggtcgtacctcatgtacaccacgtcctgctgcctcgacgtcgggaacgtgtcgaactcctcgtccagctcgtcggggtgcaccgcctccgcccacgacatcttcgtgtccatgtgcggcgggtggcgcgcccgcccccggtagttccacagcccgatcatgaacatgtagaggaacaccgtggggaggatcagctccgggtaccacacgaggatgaggaggaggacgtgcaccagcgccgtcgtcgcaacgttcttccagtggcacacgtcggcgaaccaccgcgccgccgcggcggcccccgagaagagcgagacggcgcggaagaagttggccttgctccgccgcatgctccacatgtgggactccacgtcgagcatgtactccaccacctcgcgccgcagcggcggctccgcgcgccccagcctcgccgccacgatccccatcgcctggtaccggagcgcgtccagctgcgtcaccgtgaacgggtggaggtagtgcatccgcggcagcagtggctgcgtgtacaggtgcaccatgttcatcagcgacagacaggtgaaccgcacggcgaggcggagctcgcccatcttcttcacccccgacggctgcagcacgatcagcgggtacgcgtgcgtgtacacgcggtcggtctccagcgtcgagaggcggatgcggatcttgccgacgcgggcgtccctcgccggcgggcttcatcctccgccgccgcgggcgttgttgccgttgccgttgccgttgccgaggtggttgttgtcgaagacgccgatggtgatgacggtgcacgggtcgaacacctcccaggtgtactgctcgttccaggtcgggctgaaggtgccgagcatggtgcgcgtgcggacccacttctggccgtacttggcgacgcagtaggcgtcggtggtgccacggccgtcgcgattcttcatcggctggaggccggcggcgccgaggatgccgacctcgagcacgccgacgggcggcttccagagctgcctcgccgtggggcgggtgtcgctaatgtacatggtggactcgtccatgacgtggtaggcgccctccaggcacgccctgacgtgcacgcggctcgcgaaccggagctcccgccgcgtctccccctcgatggcgccgccgatcccgaacttctcgaggtcgaaccaccgcgactggacgaacggccggtggtccagccgcttctcgaacagcgcgagcggcagcgcggcgcggccgaggaggtcgtccttgcgcggcgtcacccggtcctccaccgtcagcaacagctgctcctcgaacggctcggcgacgacgaacaccaggtcctcgttccaccgcgggttcagcgtcggcgccgccaccaccgacgtcttaaggatctggttcccgacctgcgccttgacgaacacctccggcgcgcgcccgcgcgcctgcggatgcacgtcatgcgcctcgatcacgttgacgcggaggtaccacagcttgggcgacacgtacgccttggaccgcacgctcgccacgccctcgcagcgtacggtggcggcgtcgaagtgccacgcctccgggaacgcctcgtcggcctgggtaccaatccacacggcgagcatcagctcccccctcaccttcaacccgccgccgtcgccgccgccgcaacgcgccgctcctcgaggcggtaccactgcggcgcgagggggctgtcggggggcaccctggtgggcacctcggcgaggtcgaacaccacgcggccgacatagtcgtcgcggccgagcatctccttgtccttgaggtacacctcgaggacgttggactgcaccctcgacttggagaaggcgaacacctggtcccactccgggttggctcgccggtcgtagtgcttcgtcgtgcccttgtagttcccgagcttgacctcgacgtacggatccatgggggacccggtgatggggttgggcgggaggtccttcgccttgacgacgcgcacgtacaggaagaacatctgctcgacgaggtcgtaggtgctcgacggcttctccaaccccagccaaccggcgatgccgccgccgacggccggccgcgccggccccgccgcgcccttcggccattgctcccccagcagcgggttcgtgtccttcagctggaagtcctcgtggtgcgcgtcatggtggtgccctccggtcatcgtcatcgtcgccgtcgttgccggccgtcgtcttcaaccttgtacctgcaaccaaaccacaccatcgaattaaaacaccggaaaactccatgaaaattcgcagataactcggcatcaataatctcacctaaatgttccaagatcgagatttcactagacggtaacaatggcgcgagacatttatacctagaactctacaaggagaaagtgatgagcaggcatatgcgtggtcactgcacggccatggaggggcatccgggaggtggcctcgccggcaagcaaagcggcgacgccggtgtcggcgtcgacgtcgcctcgccgcggtgaacccggcgacaaggaaggtatacgtagctaattaagctagggctttttgctgtgcatccatgtacatggaggacggacaatgtcagtgtgtgacagtagtgtagacttggtgggagagcaagcagctatagctaagccaataaacactttctagggttctgaactttaagctgagcaagaagaggcagaagccatgtatggcaaggagaaaattacagagaagggatcgattcaaattcagagaaaaaaagggacagatggtgatcgatcatgtgttgatcaaaggggattaaaagatgtttgtgggtggtaaataaagagagctagctcatcgattgattgattgatca

SEQ ID NO: 78635 - DNA, 7168 bp, Oryza sativa
ttaggcagctccacaactctactccagactcaactcctgaagttatatttaggagttggagctgtaacaaacagggcccttccttatcgctctctctcaccctttcttttctaaataaaaatagataggcagccccctgtcgtcatgtagtcgatcttgggcaaattgctttcgaattccgatatataaacgtggaaatatttgcaaggcatgggggccctggtcaaccaggagctcggcggctcgcgcacggtgcaagttcaacagcagcagcagcagccggcgttggacttccaggagaacatcctcctcctcgtcggcgacctcaacgcgcgcgaatgccggccaaagaggaaaccatcgtgtacgaggcggatccggacgcactcaccgtggaccttgtcgacgatccgttggttaaagagttccgtgacaagttagtggatgaggtcctcaccatcgatgccggagatatggaggcactattcgaggaacaccaggagaatccggagctggagaggacgctgatgctgatctctcagtccgaccaagacgctgatgccgccgatggcgacaccccatgagactcttattacctttctttgacgtgatttgtctcggactttcattttttcggcccagcatgtgttgggctgtgattgtttcttttctttgacctttgtcaagttttctttcagccttagtaactcttctatttttttttctagatcacagccgaattccttccttggataccctacacgtactactactactacttctgcggccgtggataaggcggcggagacggaccaccacctggccacacgtgcctgcaggcgctgcgtcttgataattctgccaacggagaaaacccatgaggaggagtttatatttataggacgtgactaatactcgtagagactatactctatactgtattaactatagaccagggtttcccaaaccgccggggccggggttaccgcgcaccggcagtaagcacggttaccgcgcggtaaccgcggtaaccgtgtaaaaccgtacaaaaccgtgcaaaatttataaaaaaaattaaattattttttaaatttatttgaatttaaggatgttatcgcggtatttatattactatacccccgcggtaagcctggtaaccgcggtaaccgtgtggttaccggcggtaggggaaaccttgctagagactcatttcaaaccttgttgcctaactagtacaccaaatgtatacatgtgtacaaatttaatatttcagaaaagattatatgtacaaaatatatctattataaagtttctatgcgtaaacttttctacgtataaatatttatttttctagaccggagtaacacgctgataaattcattctaaatttaaacgtacaggtttcataggtacaaaaattacatttaaattactcgtacagggtatctgaaatttgtataagtatagatcggtgtaaaaatatgtatataatctctatattcttttaaaaaagtagtggtggtgataatgaatttgccaccccacctacctacttctattatgaattctgcaaattatctcttcaacttgctaatatttaaaacaatcaaaatctggatataaagccacatataaatcaaatggatagccacatgccacacattttctatagcaaaacgatgggtaacatgtttcatgggaattttttttgtttattttattttatagcaaatatgcccatgtgtttcaacgggagatggctcttttggttgaccatatcgtccatgtagaatgtagcatcgttagtttttactcttggttaaaaagacaataggcaattatgttcttaactctgttttcgttctatgattttgtccttgcttattaactaaaggtcaagtttgcctccatttcattaagatgacttagcggtgttgtaaatttagccctattattttctgaagaatttatgattttggtcttgatttgacaaaagtgtgttttgacacgattttttcccaacctgaattttcatattctgatcagctaattattaaattttcatattctgatacatgactactcattcatatttaaaatatatatatgaaaatagtactctgataagctagagtactataatttgatagtactccgaatatgagtgagtgtcggatcgccattgcagtgatcaaccttctcaccgttggccatgcacaacatgcagctgaattttcccttcagcgtgtgctagcatgtgtggtggactcgctccgcgctgacgaaccttgtcttgaggcacacccacacttgtttcgccgtcttcttctttgccacccgcatgaagagatcctttggaagcgcatggagcaagtgcgacctcaccttcttgtcaaatgccctaatcttccatcatcgcctgcagccctgcacccggatcacctagctggtataggtggttgcagtgaccagtgagctgcgggtagaggaaagcgctccccgtgctacgccgtgccgcgtctgccgtcgtgacgatagacatagctctgttatctttttttgaaacctaaggcggaacttagttccacttttatatttagaagaagagaattggcccagtctataaggaaaatcgggcccaaaaaccatacaactgcacggttaattacaaacccaccgctacacaactaacaatgacggcggagcccaatcgcaggacgtcgccacaaagctaaacacaaaagcgacacaacagcttccacatcgcagaagaggtgttatcgttgccgagctagccgccccagcgacccagcagcgccaaagcgaaagtcgccaaagccactgaagacgaaagtcgccaaagcgaaaagcggctccggcatccaacaatagacatcagccaagccaccgaggagccacttccttcacacggccagcaccagaactccttggaagagactgcaacatgtcatcgttgctaagcgtcgctgcaccccatcagcgagcagcttcgacttcatcagcagaaacaaccgaagagcatgtcgcccaccacaaaaaagaagcagacccaagaaggcgaagcctcaccgaacacaagatatgaaagcttttgaaccgaaaaggaccatcaacagtcatcgatgcattggaacttctccgaagcgacgcccctaaggaggatacgacgtgtgacgccgccgccgctcgtccaaaaatcggaacaaggttttcacctggagagatttgtgaggatatgaaagagtgccatgacaacgcctccaaggagggaaacgacacccacgggcgcgccattgtcgaaccggccaaaagcacggtaaggctttcgccagcatcttcacaacacccacacaagcacccccacatcgatggccgcagaatagttcatgacgtctcagaagcaatcataccttgattgtaaccaacggcaaagacgggcccttggccatcctcgaaatgccatccatccgccgcaaacttctacagcaagccggagcctccgccctccccatagcattccccatgaccagaaaagggtccggccaaggggggaaaccaaagagagggagaacactcggccgacaatgaggaagtcaccgtcacggacatcaagcaccattcctgcttcacgccagcacaagccgtcgtcccgccatttccacatccgcacatcgctgcccatcaacaacaacgagacccaccaccggcagaagccccctgccgagtaggaggctggctgccagcgagccgccgccgcgcttgccgtccacacgcagccgtcccaccgaccagctgccatctggcgtggaggcgacgaatctagccgcggacggccagatccagccaggtacaggggatgaccagctagggcgcgccgccgcagcattaccgaagccaacaccgacgcttgacagacgccgacgacaacgccgcgaccatgacgggagcgagccgccactgccgtcgcccgtccaccgcgacgccgcccctgcctgccggtttccgcgcctccccggcgccgaccactctcccccagcccggattggagaggcgacgcgagggagcgccgttgccgctgctccacctttcccgccgcctgcatctcccttccccgcctccttgggtgccgccgtcgtcccgggaggaggccggaccgccggatttggcgagggacgccaaatctggcgtcgtcgccgccgcccccgttccgcacccagccgccttcgcccagctgttccgcacccggtcgcctctgcgcgcctagcccgacgccccgacgccgacgccgatgccaccgcaccgtcgccgcccccaactggtcggggtcgtgggcaccgacccgcgccctcgagggagaaggaaggccccaccgccgacttcctcgcagccgcgcggtttccggcagtctgctcgggcggcggcgaggtggaggagggagcaaggcggcggtggggagaaagacggcggtggtcgccacccgtgtcgcccctgcccctggaacgacacgggggcagttctcatagctctgttatcgatcactggttgcctagaacctcaatcgaacaccttgcgggcagggactctagttgctcggcaatgccaaagaacaaagaacttaatttgtgacctatctttgtgactttgtgtgtcttctattgaatggaacaagttgggatacaatttgtgaggaatgtttcctttctttttgtagcaaagtctaaaaacagaatccggccagcacacatgcgtacactagcgcgattaacccaaacaattttgctatatatttgtcgataaattttctcctaaaaatttgacaaatataattacagtataatcgtagtgtaattacattgtaactacaatgtaacttatatgtaactttcaaaaatctctccgtaacatgttatttgggtaaaatggaggtcgtgggaacaaatcctttcacatatgtgtgtgctgtgattttttttctttctcaccagaacaaatctggtaatagatctaacgattcaaaattacatgaaatttacatacaagttacactattgttacatgcaagttgcagtgtaattacatataagttacaatataattacactataattatactataattacatctatcaaatttttagaaaaaaatttgtcgacaaatagaaatagatataggtgttctcaatccgaaaattcggaacgccacgcgcacacacgccctgatcgcgctcccggcatctagctggctccaatccgttgcacggccgttggcacccaccgagccctgacaccgccgccggcgaaacagcaagacgacacgcatgatcaggtccggtcagctaacgaaatgctgccagacgacacgcatgaggccttcgcgccgtacgaagcatgcatggtttctgttttctgtaaaaaaataaataaataaaagtcttctgcattttcctggtatatattccgatccgttccctggtttcttaacagtgtatccgactcggacttgttgatcgatcgtcttttttctcgacgtgcgcacgcacgtacacagaccgaatcggattatttgtgggcgagcagtgtctatatatttgctccggtggccgaagcgagcgagccgacaagccacagatcgatctctagctcgatttttcaacgagaacccctcgctgatcgaccgcacgccgcgcgcagtcgtcgtcgtacgtcgtcgtactcgatcgtcttcgacgacggcaatggccgacccgacgccgccgccaccgtgcgccgcgtgcgcgcaccaggggcggcccagctgcccggcgggctgcccgctggcgccctacttcccggccgaccggccggagcgcttcgagtacgctaacctcctctacggcgtggacggcatcctccgccgcctggaggcggccgggccggacccggggacccggcgcgccaccatggcgtccatcgtcttcgtgtcggacgcgagggccgccgaccccgtgcacggcgcctacggcgtgatacggaacctccagcaggagctcgccagcgtcaaggccgagatcgccgccatccggcagaagcagcagcaagcccagccgccgccgccgccggaggacggccactaactaagcctacgcaccgccatccgcatttatatatgcatgctgtggagacggttcaattagattatgtttttcttagtaactcattagattgctgcaatattaattatctgaattcagagtttagctccatgtttcggaaataactaggattagcacccccacacgttgccgtgcagtgggtgcgacggtatttccaaaggatgtcaaattactcctctatttactgtatgtcatatatgattatatttgtatttaaaagtgtcttataataatattattatgttgaagggcgtgtagaaaactttgcacacttctctgtctttatctctatatctaactctacgtgtggcgtttcggttcagaccagaagttccagattcagaccggaagtttcagattatttacttccctgcaaagtatgaatttcaaggaacgcctattcacctcctagatctatatctatatctatatctataataactaatataaatattcggatttttccggtcgtcgcatctcttttcgtccgtattttcgtccgtccgtcgtatttcaatctcaatcccaatccgactatgttagcgatggaaaaattgcaaaaaaaaaaaaaacaattcatcacagattcacaccaacggattctcaatcccacccacggattcgcagccaattcatcacagattaaaatccacaagaaaggagaaaaacgaaaagacgaaaaaccgcaaaaaagggcgccgccgctgggaaaccaggccaccaccacctcccctggatccaggacgccggatctgggataccgagccgccgccgcctgccaccgtcgagccctcccgcggccccatggcaagggagaggaggcgaggggcggagaggcgctgccgcccgttgccacccgcggaaggagagctccgggctcaagacgtcgactggagaggaggaggtgcggggtcgcaggtagagggagaaggagagaggaggcggagagaaagagtcgccggaggcggagaggcggagagaacgagagagaggag

SEQ ID NO: 78636 - DNA, 4905 bp, Oryza sativa
attggcagtatatgacaatagtttcgccgcgcgaatcacgaggtgatattttgccacgacgcacccacacagtccaatatgtccaaaaatcatgttttggtgatttttgaactttttcattccgggtgaaaaacatcgcacccacgtgtgccaagatatggcaatatgggcattaattgacaaaagttcgccgcgcgaatcacgaagtgattttttgccacgaatgcacccaacacactccaatatgtccaaaaatcatgttttggtgctttttgaaatttttcattccggtgaaaaacatcgcacccacctatgccaatattggcagtaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgattttttgccacgaacgcacccaacacactccaatatgtccaaaaatcatgttttggtgctttttgaactttttcattccggtgaaaaacatcgcacccactctatggcaatattggcattaattgacaaaagttcgccgcgcgaatcacgaagtgattttttgccacgaatgcacccaacacactccaatatgtccaaaaatcatgttttggtgctttttgaacttttttattccggtcaaaaacatcgcacccacctatgccaatattggtagtaattgacaaaagttcagcgcgcgaatcacgaagtgatattttgccacgaatgcacccaacacactccaatatgtccaaaaatcatgttttggtgctttttgaactttttcattccggtctaaaacatcgcacccatatatggcaatattggcattaattcacaaaagttcgccgcgcgagtcacgaagtgattttttgccacgaacgcacccaacacactccaatatgtccaaaaatcatgttttggtgcttttcgaactttttcattctggtgaaaaacatcgcacccacctatgcattggcagtaattgacaatagttcgccgcgcgatacacgaagtgatttttttccacgaatgcacccaacacactccaatatgtccaaaaatcatgttttggtgctttttgaactttttcattccggtgaaaaacatcgaacccacctatgccaatattggcagtaattcacaaaagttcgccgcgcgaatcacgaagtgattttttggaacgaacgcacccaacacactccaatatgtccaaaaatcatgttttggtgctttttgaactttttcattccggtgaaaaacatcgcacccacctatgccaatattggcagtaattgacaaaagttcgccgcgcgaatcgcgaagtgatttttttccacgaatgcaccaaccacactccaatatctccaaaaatcttgttttggtgctttttgaactttttcattacggtcaaaaacatcgcacccacatgtgccaatatcggcattatcggcaaaagttcgcccgcgcgaatcacgaagtgatattttgccacgaatgcacccaacacactccaatatgtccaaaaatcatgttttggtgcttgttgaactttttcattccggtgaaaaacatcgcacccacatatgccaatattggcagtaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattctggtgaaaaacatcgcacccacctatgccaataatggcagtaattgacaaaagttcgccgcgcgaatcacgaagtgattttcattccggtgaaaaacatcgcacccacctatgccaatattggcagtaattgacaaaagttcgccgcgcgaatcacgaagtgatttttttccacgaatgcaccaaccacactccaatatgtccaaaaatcatgttttggtgctttttgaactttttcataccggtgaaaaacatcgcacccacgtgtgccaatatatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtccagaaatcaagttttggtgctttttgaactttttcattccggtgaaaaacatcgcacccacctatgccaatattggcagtaattgacaaaagttcgccgcgcgaatcacgaagtgattttttgccacgaacgcacccaacacagtccaatatgtccaaaaatcatgttttggtgctttttgaactttttcattccggtgaaaaacatcgcacccacgtgtgccaagatatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgattttttgccacgaacgcacccaacacactccaatatgtccaaaaatcatgttttggtgctttttgaactttttcattccggtgaaaaacatcgcacccacctatgccaatattggcagtaattgacaaaagttcgccgcgcgaatcgcgaagtgattttttgccacgaatgcacccaaaacactccaatatgtccaaaaatcatgttttggtgctttttgaactttttcattccggtgaaaaacatcgcacccaccgatgccaatattggcagtaattgacaaaagttcgccgcgcgaatcacgaagtgatattttgccacgaacgcacccaacacactccaatatgtccaaaaatcatgttttggtgctttatgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttgatggtttttgaactttttcattccggtgaaaaacatcgcacccacgtgtgccaatatatggcaatattggcattaattgacaaaagttcgccgcgcgaatcacgaagtgattttttgccacgaacgcacccaacacactccaatatgtccaaaaatcatgttttggtgcttttcgaactttttcattcgggtgaaaatcatcgcacccacctatgcattggcagtaattgacaatagttcgccgcgcgaatcacgaagtgatttttttccacgaatgcacccaacacactccaatatgtccaaaaatcatgttttggtgctttttgaactttttcattccggtgaaaaacatcgaacccacctatgccaatattggcagtaattgacaaaagttcgtcgcgcgaatcacgaagtgatattttgccacgaatgcacccaacacactccaatatgtccaaaaatcatgttttggtgcttgttgaactttttcatttcggtgaaaaacatcgcacccacctatgccaatattggcagtaattgacaaaagttcgccgcgcgaatcgcgaagtgattttttccacgaatgcaccaaccacactccaatatctccaaaaatcttgttttggtgctttttgaactttttcattacggtcaaaaacatcgcacccacatgtgccaatatcggcattatcggcaaaagttcgcccgcgcgaatcacgaagtgatattttgccacgaatgctcccaacacactccaatatgtccaaaaatcatgtcttggtgcttgttgaactttttcattccggtgaaaaacatcgcacccacctatggcaatattggcattaattgacaaaagttcgccgcgcgaatcacgaagtgattttttgccacgaacgcacccaacacactgcaatatgtccaaaaatcatgttttggtgctttttgaactttttcattccggtgaaaaacatcgcacccacctatgccaatattggcagtaattgacaaaagttcgctgcgcgaatcatgaagtgatattttgccacgaatgcacccaacacactccaatatgtccaaaaatcatgttttggtgctttttgaactttttcattccggtcaaaaacatcgcaaccacgtgtgccaatattggtagtaattgacaaaaattcagcgcgcgaatcacgaagtgattttttggcacgaatgcacccaacacactctaatatgtccaaaaatcatggtttgatgcttttgaactttttcattccggtgaaaaacatcg

SEQ ID NO: 78637 - DNA, 1444 bp, Oryza sativa
  unsure (1)..(1444): unsure at all n locations
atgcagtgacgatgcatatgcacacacactgtgattagtttaattaagcttagcttcgatcttgctctctagaacaagttgacagtgcatgcatgtgatgcatcgatctgcgcaggtactggcggacaggttattcccggcgatggcgacgccgacgacgcgtggccccgacgacgacgacgacgtgtggacgcacgtcacgccggcccaccggcacgggtcgtcggcagcgcccccgacgggtcgtcggtcaccgccgtcttgaacgccagcgccaccaccgcctccacccgcgcgcctcgagtcgtcgtgggcggcggcgcgtcgccgtcgacccacgccgcaccgcctccaaagcctacagacaacagatcgatcggccgtggtgcgccggcacaatgccgtcgccttttcggtacgatgatgacgagtaggagagtggcggcctggtccgggcatggacgtccgaggagaggaagttggcgtcgccgtcctacccgctgcggccgcgtcaccggtcgatgagnagnaggtcggagagcgcctttccccccccccgggggcccctcttnncccgccccttcccaccaaccggctgnccgggcgagctccgcctcccgctgccggccgcccgctccgcctccgtctcagccgcccgccgccctccgccttccgccgctggcagcgacgcctgctcctgctctcgcgcggtcgccaccgtgctggtgaggagagagaggagagattgggatagagtagcgagggacagagaggggaggggaactgacacaggtggggcacactaattttttttaaaaaaaaattgctgtctggaggatccaaaaccactccggattaagtcgggggttatttatccgatattaataattgagggtgtagaatgtctggtttttaagttcgggggtataattcggtcgagctcgatagttaggggtaattcgtacttttttttttccttaattaaatcaataaactgcgtttgtgctcacttaatttatctcaacttttatgagcgtgaagacacaagcaacagccatgcccatgcacgctcctaaccacccaccattaaccaaccgtaaattagctcctaaccacgctcctaacctctcgttctcgacaccctcctccccttataaactcccctcctcttcaccctcttctcctccaacaacgacgcgcagaagagattggccacccgcctctcgattcgctccccaataatccagagctaccactaataatccccctccgttccagcgcgcgcggcggcgggagctcgtcggagaagaagaagaagaccaaaccaggccggccggtcgtcgtcgtcgtcgtcgatcccctcccgccaccgcacccgccggctgtgatactatggagatgaagaagatcgccgtcgcattcgccgtcctcgccatcgccttcg

SEQ ID NO: 78638 - DNA, 1353 bp, Oryza sativa
  unsure (1)..(1353): unsure at all n locations
gcaaaaactcaattcgtgttcgcacagcgactttgtgcaatcattgacattattggcacacgtgggtgcgatgtttttgacggnaataaaaaagtcaaaaaagcacaaaacatgtagtgtnttggtgcgttcggccaaaaaatgacttcgtgtccgcgcgccgaagttgggtcaattaatgccattattggcacacggtgggtgcgatgtttttggccggaatgaaaatattcaaaaggcaccaaaacatgatttttgaacatattgaagtgtatggggtgcgctcgtagtaaaaactcacttcgtattcggcgcggcgaccttttgtcatttaatgccactattggcacacgtgggtgcgatgtttttgcccggaatgaaaataattcataaagcgccanaccatgatctttggacatattggagtgtatgggggcgttcgtggcaaaaactcacttcgtattcgcgcggcgaagttttgtcaattaatgccaatatgagcgttcaaagagcaccaaaacatgatttttggacatattggagtgtattgggtgcgttcgtggcaaaaactgacttcgtgattcgcgcggcgaacttttgtcaattaatggcatttttggcacacgtggggggtgatgtttttgaccggaatgaaaaagttcaaaaagcaccaaaacatgatttttggacatattggagtgtattgagtgcgttcgtggcaaaaactcaattcgtgattcgcacggcgaacttttgtcaattaatgccattattggcacacgtgggtgcgatgtttttgaccggaatgaaaaagttcaaaaaagcaccaaaacatgtttagtgtattgggtgcgttcgtggcaaaaactcacttcgtgattcgcgcggcgaacttttgtcaattaatgccattattggcacacgtgggtgcgatgtttttgaccggaatgaaaaaattcaaaaagcaccaaaacatgatttttggacatattggagtgtattgggtgcgctcgtggtaaaaactcacttcgtgattcgcgcgacgaacttttgtcaattaatgccattattggcacacgtgggtgcgatgtttttgaccggaatgaaaaaattcaaaaagcaccaaaacatgatttttggacatattggagtgtattgggtgcgttcgtggcaaaaactcacttcgtgattcgcgcggcgaacttttgtcaattaatgccattattgggacacgtgggtgcgatgtttttgaccggaatgaaaaaggtcaaagagcaccaaaacatgatttttggacatattagagtgtattgggtacgttcttggcaaaaactcacttcgtgattcgcgcgg

SEQ ID NO: 78639 - DNA, 1287 bp, Oryza sativa
  unsure (1)..(1287): unsure at all n locations
atctggtggcagaaggaggtgtctgctaggttttcttttgttactgcctgctagtaaaaaatgacagaaaatgattacatatgaatagaaacatagatagaaagatttaaatcacttgtccagcatgtgcaattttgcaggaggcaatatagcacagtgttttttagccaatgtaagttggaggagtatctggctgatttaattgtatatcttctattacccggcgaaaacagaatagacatgttaatgggtagtgtaagttgaaaaaatgtgatgaggcaaactttgtacctgttccattcctcagaaatggaacgcttttgctaggagatgcatggtcaaatgtgcttgctctggttaattgacctgatggatcaaggggccttttgttcgctgatgagctgttggatggggtcttcactggacatctaataaggccttgtctgttcagtatcataacacacgctttagactgtgatggcatccagaaaagaatcgtttctccagtttctaatccagttgcctctacaaattatttccatcatgtcgtcatgtacagtgtgctagctacttccttgattttgatctttatcttcaagccatgggaagtttttaacttcagattatctccacgctgcatcttatatgctgtcgcaagtgtgattggcacaggatgtagaaagaaaatatcatatccgcactggtgctaacagcatattgtacatagaaagttttgtttgactttgagcttaccaagtagctttgatttgttgcattcagcctcattgatgcgaaaactgcggaagacatgattgtggctacaatatatatacacatgtagttagatgtatttgataaataaaaaaagttatgagaggctcagctagttattagagtttttattataatttttttattttcaaacagggtgagtattttgggatatgtagaaatgcaatgaagtatgtgatctataacttgatgtatgtaagtatttatgtgatgtaaatcttagttgtagctggaaagatatatatggtaagaacataatgtgctgggttaagtggctatactacggtaagatataagataattatgatgcaagaataggactaaatagctgtgaaaaagcttaataatttacagttgatgtaagtatttttttcnagtatagtagctaaaggatttatgtgaaagagtattaattatttattgtaatttcgtgtaatggtattgttctacatgtattgaaaaagggaaatttttatattagaaatattaggaact

SEQ ID NO: 78640 - DNA, 672 bp, Oryza sativa
agccatggtttgtatctcatgagcctgttcgactacagaacgtttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaagtgcacaccggtgaatttatccggcctcagtgcatcgacaaaaccagccatagtaaaatcacagtgcctataataaggtttttggattgttgagattataggcatataatgatttaatatattctataaataaatcatgacattgcagatgtatactagcattaacgcatcattagatctacacatgtaaactaagcagtaaaacataaacagatcaaatatgcgcaacatattgaacacgtaccgaggtggtagaaagaacggctgctcggtaggaacttttcgcgattgcaggcatctacgaaggcgcgcagcacgcgagcgaagagg

SEQ ID NO: 78641 - DNA, 6627 bp, Oryza sativa
ttctgttccttgtcgtcaggtacacacaatctttcccccatccagattgtgccacgctcatcctcaaggaaatcccgagccttttcgactctcatgttctttttcagctctactatttcaggatcatttacttgagcggctctaacttgatcgacgagcgtaggccgtgattctagagcggctacgaacccgtgttccacaattcccacattgagacgctcaaactcctgctgcaattcctcatacatgccctcgatgcatagggcattgcaatagcttttcctgcttaacgcatctgccaccacattggccttccccgggtggtagtgaatgctcatgtcatagtctttgattaattccagccgtcttcgtggtcggagatttagatccggttgggtgaagatgtatttcagactcttgtgatccgtatatacttcacagtggttgccaatcagattgtgcctccagatcttcaaagcatgaaccactgctgccaattccagatcatgggttgggtaattcccttcatgtggacgcaactgtcgcgaggcatacgcaaccactctgccttcttgcattagaacacacccaagcccgtggcgggatgcatcgcaatagacttgaaagtccttcatctggtcgggcagaatcaaaactggtgcggatactaatttcttttagagctcttcgaagctcttatcgcactcagctgtccatttaaacttctcatctttcttaagtaactgagtcatgggtcgggcaatcctggagaagttttcgatgaatcggcggtaataacccgcaagtccaagaaaacttcgaatctgcgacacggtcttcggtggggtccatttggtaactgactccacgttcgatgggtcgactgccatgccttgagctgtaacaacatggcccagaaatttgacttccgtcaaccagaagtcacacttgctgaacttagcatataactggtgctccttcaacttctcaagtaccagtcgaaggtgctgctcatgttcttcttcggattttgaatagataagtatatcgtcgatgaataccacaacaaacttgtccagaaattccatgaacactttgttcatcagattcataaagaatgcgggtgcgttggtaagtccgaaagacataatcgtgcactcatacagcccgtaccgagtggtaaagccgtctttggaatatcctcttcccgaattcttaactggtgatagcctgatcgcaggtctatcttagagaacaccttagctcccttcagttggtcaaacaagtcatcgatccgtggtaaaggatatttattcttgattgtgacctcattgagtgcgcgataatcgacgcacatcctcttcgtcttattctttttctccgcaaaaatgaccggagcaccccaaggtgaagtacttggtcgaatgtaccctttctgcagctgctcatcaacctgcttcttgacctctgcatcctgtacggtctcttgtaaattggagcggttcccggtgccaaatcaatccggaattcaatctctcgcttgggtggcatggtagtgaggtcttcgggaaacacttctggatagtcgcaaactatgggagtctcttccaatttcctcgaattcttctcctcggtgaccactgggatttccgcctcaatctgattcaaggagatcccttgctttggtgagactagtgatttgtacactacggtttctcccttctcgttggtcaaggtgactgtgcgattcgcacaatcaatgactcccttgaacttggtcagccaatccatcccaagaatgacatctaggtctttggattcaagaagaatgaggttggctagaaatggtgatctttgaatttctattagcactgaagggataaaactgaccgaggttgaactatttcctggggtatgaaccctcattggtgtactaagctcttctttccttaacccatgcatccccacaaatttcattgaaatgaaagaatgcgttgcaccagaatcaaaaagtactgttgcagggattgagttaacaggaaacgtacccagtatgacctctggtgctgcttgcgcctcctctgcagacgcgtggttgacacgagcctggacaaacctttggccggcacgcctaggctacgggcatttgtcagcgaagtggccaagctcgccacagttgaagcaagaccctggttttgttccagtctccttcttggcttgcgcggacgggcctgattgtgctggtgccactggtgggcgtggagctgcaccgcggttgggctgacctccatggtggttctgactgtcactggcgcccaggtggaagttgcttgacttgaacgggcggtgctggcggacgatcatggtggtaggtccaccctgctgccggtagtgaaacgcggtcgctgctggttaccttggttggaccggagctgtgccgccattctcttcctgtccattttgttgcgctgatcctcctgacagattgccttgtcaaccagcctttcaaaatcagcgtagtccccagatatcagttggttggtcagctcgtcatccagacctgccataaacttttcgtgcttctcggcatcagtgcggacatcctccggtgcatatcacgcgaggcgattgaactcatgaagatactctgtcactgtcctgttgccctgatggagtgcctggaattccctcttcttttgtgccacgaccccatctggcacctgcgccttcctgaagctacgacagaactccgcccaagtgacttcagcgcctggcgggcgggtggccatgtgattgtcccaccaagctgacgcgggaccttgaagttggtgtgtggcgaaagcaaccttctcctgatcattgcactgcaggaggttcaatttcttttctatggcatggagccagtcattcgtctccatggggttggtagtgctagagaaagtgggtggcctgacgcgtagaaacttgggcaatttggattgagggggagggggaccaaactgctggtgatgctgttcggcgtgctgctgcatcctctggtgcatctgctggtgctgctgctgcatctgctgcatcatggctgccatcatctgagtctgatgtgccattacttgggccagcgtcggattctcgggaaatggtggcggaccattgccggaatcactgttggggtgcacaccatcagtgcgctcttcgccgttgctgccctcgcctgtcgtgcgggtgccattcctggtgtagaccatctggaggaatagcagacggggaaacggagaaaaacagatactcaggaactaagctttattacatagaaatttaaactgcaattgttctgatctgaattaaaacactttaaacagcaagcaaaaaatccttattaaggcagccatattataggcacatgatatcgaccgccgactgacccacaagcaagcaacctaaacacacaaactaacaagcagaagctagacagtcgataagctaatggaaaacgagcctaatgctcggaacggctcctgcggtcggtggagtcaatggcgtcctcctgctcgtcaccaggtccctctaagcgactcctggagcctggcagatatgtctcaccgctgcccggctctgagccactggagctgctgctgctgcggtcgcggctgccactgggtgtagcaggcaaccaaccccctttgccactggcggggcccctaacggctgatgctggcgtgaaggagagagcggatgcaggagctgacacgggaataggagctggagctggcgctggagctgcaggaactgctggagctgcgggtggaactggaggagctgcgggagctgctgacggaggtgggttcttgggctcaagctggacgcgcacgggtgccgttgtcgacttgcggggagtagtgcggatccggactcctcctagcgcgggaagacccttcaactgagcattctccctcttcaggcgcgctatctcgtccttcagagcgatgatcctcacaagcttcccatcattcaaggccttggacgccttgtgcaggtctgagtgcatcctgtccatccccctcatcacagcgcacatgtgaccaaaggtgctgtcgttctcgccggctgtcggacggaaggaactgacatcgctgccgctggcttgacgagggtggaaccggtacgccgtgtcgtggaagatgtaggtgtggcgctcccgtagtctggccatcatcagatatgctgcctcctgacatgcgtgatctgctgtgcctccagacgcctcaaccaccatgttagcgaggcaagtacccacgtagccatggacctccaggcggacacggtgaggaagctcgccactaagtggtggaacagtcgtgtactctggcgtgttggggtagcccaccaccagtgtcatgcgtgccaactctgccacgaaatcatccatgccttctccgcggtggttgggtgggtgctcggccatctagagaagacaaaggggtaggatcaatgcatgctcaaatccaatttaaataaagcaataaaggactcaaataagagaatcgaataagagcgaaattttatgcatagatcattttgcatgagagcgaataaataagacggacttacatagcgataaaataatggggaaattagatacatacttataataacaataaaagcataaataccttacaacccatattcctgagctaagacctaatgcatttcgcccatcaaatcccaactgatggtcaaaacatctcaaataattttactaaaaccctagaccgacttgttttggcaaatctcacttaaacgagcgacaagatttttcccttgaaccacaagaacagatcccaaattttcccggaacaattccaactgcaaagaacttatgcaatgaaaggattcagagggctcttaggtttccatttggcttgtcctacggtcaaggacgatctgataccaacttgtcacgcccaaaaattcccgaatagaattccaagcagaatgtgcattaaaacccccgtccaggaccggctggggtacacaaacgacaatgttgacataaagatccacgtcttacaaacattataaaagtcttacataaatgcagcggaaaacgaaagataacaggagctaagcctagacttgaactgcagcgggaacaccactccgacggcacggacgaagcctactcctcagagaacccgccatcggacacatactcatactctggggttgggggaaaataaagtaagactgagtactatccactgtactcagcaagtcacaccggaataggggtatgatgcagggattaacaagggatagctatacaggttcatttgcataatactggcatttataaacagaagttgaatgcggaaacagttgtaataattaatcaatattaatcatccactgtccaatgttacaccacgttgcaacaggcccaaccatccacccgtactatccaatttcattacactaaactaggatgagactaatcacggtgaatctggttgaccgcccataaccgcgggcacggctatttgaatagttttactctggtcagaggtgtacaactgtacccacgagacacagccccacgacacgtttccgtgcgccgacatgccaccacgacataccggaaagaagccgtgacaggacccttcgcgcaaccccctctagccaagcacaccacacctcaggtttcacccccgtccccagcgggcgacaggaagtcccctctcgtgcctaggtgaatccggaagccgcataggccgtcacagggcccatccaaactccatcacgcccacccttgcctggatgcgtcagctagagaaaagctacactataagcccagccgttgcccacgctggcttgtggtaagcacgataaattcttctagggtttcccgcgaaccggtccttaattgctatgggtgcgactagcaaaaccatgtacccacagcccaccatgtgagttattttaattaaccaacaccaaagcggtggtactattccaatattttaaatgttatttccccattgtgtgctagtggaactaagcatggctaagcaattcctagtccaaagtctattcatgttataacccgaactaacaaaggagcatggtatcaaaatagcatggctgtaacaataggtaaacatcccatagtattattgcaaaacaaatgcagtatttgaaagaaaacattagaacatttgcaatataggatcaacatgatcaagtgacaagcatgacttgccttgctctgctgctggaggaacctcggcgactatttcgaagtacaccggagcgtcggaagagccggaatctaacgacatacaaggcaaacaatgcaaacaggctataagactattgaaacagagaacaaaaccatttttaatggattctacacatttttcttgatttacggagacttgaatgggcttaaacggagctcggatgaattagttatgatttttagaagattcactgtgcttattactataaaaaaaactttaatgaattattgcgcaataaagccttccagggctgacgtcaacaaggggttgggcggcgccgacaggcgggtcccactggtcagcggctcgggacagaggggaagggggcgcc

SEQ ID NO: 78642 - DNA, 3859 bp, Oryza sativa
caaaagcgatagcaggtccgactttcatattgaaagcatgtcatcgttgttaagcttgcaaaagcaaagcacctccgacttcaccacaaacttgtatcgttgttgtcgagctcatcatagaaacgaccaagcagctccgacttcccacggcggacatcagccaaaaccatcatattaccacttcctgcttattgctagcaccagcacacctagaaagagactgcaccgtgttaccgttgctgaggttcatcgcgcctcaacaataaagcaacttcgacaccaccttgcaaactgaaacaaaggcattggctgccagccgcaagcaagaagcggatccaggaaagcgaaggcctcgccgaacatttcgggcctatttagcgttggtgtggaagtagaaatccctagagctaacgccaactccacgaccagagatgcgcatgaaaaggttctccaaacggtacccacagcagggacgcgacgtgaatcgtcgctgccgttcacctggaaactggggcaaggctttcacctggagcacaatggtgaaagaataagagggaacacaccataacgatgtctccaaggagagggacggtgccaaagggtgtccccatcgtcaagccggccaaaaggcacggcaagactttcgcctacagttccctgtccgctcctacacacctaaccaatccgcacacacgactgttgcaagaatgccgcactagccctgactaaccgaccctccggcgagcaagaacctcggagctccccgcgggcacggcctcaccgaaggcgcaactatcaaaccacctccaccacacaccaacacgcacggtccccgagagccgccgacctcaccaacgccgttcccagccgtgagggcgatctgggtaccggcgccacatgaccaccacggctccttgcccgacaaccgccagcctcaccgtcggccgcaccggccagccgcgccatcgcccgcgtcttctgccgccattagctcgctgaccagatccggcggcgacgggtcggttccagccgcaagggaggggccgagtggggggggggttggatccggtggcggcgaggcgggggagaggaggggagggttcgcccgcacctggctacgacgataggtgcattgtgatggttcaatttgaagattgccgacgccctagtaatttactattaatgcaatctggagataacctacaataaactaaactctgaattcaggggctacttgctactaatgctgaaacaagagactactttaacgacgcactagtaatctatttccaaaacataggagccaaactgtatttccaaaacctaggagccacactgttaatgcaatctggacataaacctacaataaactaaactctgatgaattcagaggctaataattgtagcagcacgtctgaatttaagattttcttcgttggcacaaggccggcgaagcatcaagcatctgatctgatcaaagcgcggccctcctcaggccgctccgtcgacgtcgccgcagcatccatggcagaagtagttaagggctcgagctcgatcgagtgcgtcgggtggcggcggcggcggctgggcgtattggcggtgccgcgcgagcgcgctctgcgcggttgcgagttcggccttcaggcagtcgagctcccgctcgaggtccatcaccacgccgtgggcgccgcgcacggggtcgtcggcccgcgcgtcggcctcgtaggcgacggacaccgcggcgtcgcgccgtttccccgggtccccgccggccgccagcaggaagccgacgacgttgccgacgccgaagaggcggaacgcgttccggaatagccggccgtccgctggctggtccccggccgccgggaagcagcgcgccagcgggcatcccgtcgggcacgcgcgccccaggtgggcgcacgcggcgcacgccgccggtgggtcgtcgtcgtcggccactgcgaccggcgagatgtcggcgacgaacgggcgccaaggttgggccatggagatcggcggcgagacgagagctgggtctccgtcggattggtaagttggggcaccggaacggagagttcgcggcgaaatatgcggccgcgtgcacctgcatgcgtcgggatatatatacagataacacaggacgtgcttgaggtgaatttgggccaaattaaatggagaaatttaatgggatcgatttttttttttacacatacaaggccgcacccgttatttgtataacttagctatatagaatttttttaaaaaaatggtaaattgattgggacaggattaataagtccattctggtgaaattaagatacatatgttatcttgatttggatatttttcaaactactaaatgatatattttgtgtgaaaattatatatatgtattaaagttgatttaaaatataaaataaatctaatttttaagtttatagtaattaaaactaaattaatgttaatggttttcttgttttttgtgccctagcttaatctttgtctaatcaacttcaaacggggtaaacatgaaggataaattcagtctacaatgaaaggaacaaaaataataaaaccaagcaacaaaaataataatagtactgtgcatgcacacaaatagaatttattttttaatgtcgattaaatttttatttgttgtttttatgtagattaaatttatattaatttgcatgtttgtataatagtgattttggatctgtcataatttatatcagcattgcgtaatgttgatgtggatcggagtagagttagcgcaaaactctcacaaccctaataccctaaaataaaacaaaaatccgtacaacatcaaaattctgcctctatattttacgctacataagacttgccattaacctgagtcaagttattcactgtttcagtgtttcatccccaatcggccggtacttttacatattttcccattataaagggtaattataagctgtgtttccttgatggcgtcaacaacggtcagcactcctccactgctccacaaggagtcaagcaacgcaaggaccgcaacctgcattcggtgaatactgatcagcaatatatgtcggccttattcattattattatttgttcaactttttttttaaaaaaatatttttttcaaaaaactttgttctactgtattttaaccacttattttaagctatttattaattatattatatatcaatatttagtttatgatatacttaataatctaaaccaaacatgttgtcaataacaaagtataaagaataaagaaaaatgtggaactatgcgggaattaacacacaactttggtgcgacaagccaacaaataaaaaaatgaaggtacaaaactaaacattagagatatgaaaccattttttttcttgaataatttggacaccactgcataacaattatcattacaaattttcctaaaagaaagggatcagaggcggctgtggcaattcggctggctaaaccgatcgagtagactggtgtttgctaattacgcgtgggtctacaaaagtaacttaaaatttcaccacaattattgtttagaacatagattttgagcatatatatgaaaataataaatttgatttgttaaaataaaaaaattttacttattttggatttatgtaaaaggattttaggtggtcaagcttgttgacttaaaaaaaagtctaaagacgaccgcttttatgactagcaagagagcaagtgtgttactaataaaggatattctcgtttgaaaatatagactttgacataagagatgacccgtgaactatccggtgactacttttttttctccaaaacatagattcggtccggcgactactctttttttgtcagaaca

SEQ ID NO: 78643 - DNA, 786 bp, Oryza sativa
ataaaaaaggctctattcatgcatttgtcaaggacggtgcacacacattgattcattttctttggaactccaatcaagcattgttcttaactatttgcatcaaagaattacttgcttactcttccaaaataacaattgcgcgattctgtatttccgctgatcatatgtttgtcaactaggatggcctctgatggagagaccccctccatcaaattctttccctaccttccatcaattccttttcctatcttcatcctttgatgatactattaggcagttctttgaaattaaaatacttgctggacacatgaattctttgattttttggaatcattttggcagattagtgccgttcatcaaagaattgattgttaactcttacaaaaaaaagggctctattcatgcatttgtcaactaggacggcgcacatggagtggtgccctctccttcatcaatttcttttcttattatcatcattagataataagcatttctttgaaattatttatacttgttggaatcatgaattatttgccttttatgaagcattgtcatcaatgtaaataccttgcatcaaagaattgctttactcataaaaggttgctctgctaatgcatttctgaaactaggctgactcacatggagagatgtcctctatcagtttattttcatattatcacgctttgataataagtaattatttgaaattatttatagttgctgaccacatgaattcattcccttttatgaagcattattgtaaaatgcagtatcatgcatcaaaga

SEQ ID NO: 78644 - DNA, 3698 bp, Oryza sativa
  unsure (1)..(3698): unsure at all n locations
acgaaaaagatcaaaaagcaccaaaacatgatttttggacatattggagtgtattgggtgcgttcgtgaaaaactcccttcgtcattcgcgcggcgaacttttgtcacttaatgccattattggcacacgtgggtgcaatgtttttgaccgaaatgaaaaagttcaaaaagctccaaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgatttttggacatattggaccgttcgtggcaaaaactcactttgtgattcgcgcggcgaacttttgtcaattaatgctattattggcacacgtgggtgcgatgtgtttgaccggaacgaaaaagatcaaaaagcaccaaaacgtgatttttggacatattggagtgtattgggtgcgttcgtggaaaaaactcccttcgtgattcgcgcggcgaacttttgtcacttaatgccattattggcacacgtgggtgcaatgtttttgaccgaaatgaaaaagttcaaaaagctccaaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgattttttgacatattggagcgttcgtggcaaaaactcactttgtgattcgcgcggcgaacttttgtcaattaatgctattattggcacacgtgggtgcgatgtgtttgaccggaatgaaaaagatcaaaaagcaccaaaacgtgatttttggacatattggagtgtattgggtgcgttcgtggaaaaaactcacttcgtgattcgcgcggcgaacttttgtcaattaatggcattattggcacacgtgggtgcgatgtttttgaccaaaatgaaaaagttcaaaaagcaccaaaatatgatttttggacatattggagtgtattgggtgcgtttgtggcaaaaactcacttcgtgattcgcgcggcgaacttttgtcaattaatgccataattggcacacgtgggtgcgatgtttttgaccggaagaaaaagttcaaaaagcaccaaaacatgatttttggacatattggagtagtgtattgggtgcgttcgtggcaaaaactgacttcgtgattcgcgcggcgaactttggtcaattaatgccattattggcacacgtgtgtgcgatgtttttgaccggaatgaaaaagatcaaaaagcaccaaaacatgatttttggacatattggagtgtattggcacgctcgtggtaaaaactcacttcgtgattcgcgcggcgaacttttgtcaattaatgccattattggcacacgtgggtgcgatgtttttgaccggaatgaaaaaattcaaaaagcaccaaaacatgatttttggacatattggagtgtattgggtgcgttcgtggcaaaaactgacttcgtgattcgcgcggcgaacttttgtcaattaatggcatttttggcacacgtggggggtgatgtttttgaccggaatgaaaaagttcaaaaagcaccaaaacatgatttttggacatattggagtgtattgagtgcgttcgtggcaaaaactcaattcgtgattcgcacagcgaacttttgtcaattaatggcattattggcacacgtgggtgcgatgtttttgaccggaatgaaaaagttcaaaaagcaccaaaacatgtagtgtattgggtgcgttcgtggcaaaaactgacttcgtgattcgcgcggcgaactttggtcaattaatgccattattggcacacgtgggtgcgatgtttttgaccggaatgaaaaaattcaaaaagcaccaaaacatgatttttggacatattggagtgtattgggtgcgctcgtagtaaaaactcacttcgtgattcgcgcggcgaacttttgtcaattaatgccactattggcacacgtgggtgcgatgtttttgaccggaatgaaaaaaattcaaaaagcaccaaaacatgatttttggacatattggagtgtattgggtgcgttcgtggcaaaaactcacttcgtgattcgcgcggcgaagttttgtcaattaatgccaatatgggcgttcaaaaagcaccaaaacatgatttttagacatattggagtgtattgggtgggttcgtggcaaaaactcacttcgtgattcgcgcggcgaacttttgtcaattaatgccattattggcacacgtgggtgcgatgcttttgaccggaatgaaaaagttcaaaaagcaccaaaacatgattttggatatattgcagtgtattgggtgggttcgtggcaaaaactcactttgtgattcgcgcggcgaacttttgtcaattaatgctattattggcacacgtgggtgcgatgtgtttgaccggaatgaaaaagatcaaaaagcaccaaaacatgatttttggacatattggagtgtattgggtgcgttcgtggaaaaaactcacttcgtgattcgcgcggagaacttttgtcacttaatgccattattggcacacgtgggtgcgatgtttttgacccaaatgaaaaagttcaaaaagcaccaaaatatgatttttggacatattggagtgtattgggtgcgcttgtggcaaaaactcacttcgtgattcgcgcggcgaacttttgtcaattaatgccattactggcacacgtgggtgcgatgtttttgaccggaatgaaaaagttcaaaaagcaccaaaacatgattttttgacatattggagcgttcgtggcaaaaactcactttgtgattcgcacggcgaacttttgtcaattaatgccatcattggcacacgtgggtgcgatgtttttgaccagaataaaaaaagttcaaaaagcactaaaacatgatttttggacatattggaccgttcgtggcaaaaactcactttgtgattcgcgtggcgaacttttgtcaattaatgccattattggcacacgtgggtgcgatgtgtttgaccggaacgaaaaagatcaaaaagcaccaaaacatgatttttggacatattggagtgtattgggtgcgttcgtggaaaaaactcacttcgtgattcgcgcggcgaacttttgtcacttaatgccattattggcacacgtgggtgcgatgtttttgaccgaaatgaaaaagttcaaaaagctccaaaacatgatttttggacatattggagtgtattgggtgcgtttgtgccaaaaactcacttcgtgattcgcgcggcgaacttttgtcagttaatgccattattggcacacgtgggtgcgatgtttttgaccggaatgaaaaagttcaaaaagcaccaaaacatgattttttgacatattggagcgttcgtggcaaaaactcactttgtgattcgcacgacgaacttntngtcaataatgccatcattggcacacgtgggtgcgaatgttttgacccggataaaaaaagttcaaaaagcactaaaacatgatttttggacatattgcagcgttcgtgcaaaaactcactttgtgattcgcg

SEQ ID NO: 78645 - DNA, 878 bp, Oryza sativa
tacataaagtatagggactaaaaatagacatataaatgtaacagtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggctcggcaaggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgtgccgggcggcccacatggccaactatacgtataggctcattcttgaatgaagtctctttattatcttattatggctaaagtatcgtgaatgcccgaattataaatcggggcagcctaggctggggcgcccgatcaattcggagtaaaatcgggcgctgacgttagcgtccgatttacgtgcaaaactattttaaactgatttttctcttaaattacttatcaaaatcataatccgattgtaccattaaattcgttataattaaatcttcaaaacaagaccatatatggatatattccgatgaaaaaaaatattagcttattattgaattattttttagtgttgtacgatgttccactagttatatcggaattgtttcactaagtagatcgaaaatatttcactcgtttaaatcaggtgttgtttcaccttatataaaaacaatgtttcggcaaatagcgaaagaatgtttcagttcactgcaacatttgatccacacatagtgaaaca

SEQ ID NO: 78646 - DNA, 1859 bp, Oryza sativa
accaaccgaataacagttccataaatcaaacggcttcaaagttcaaactaatataattatcgtgtaaaaaaatgcatacataccagctttccttgtctgagctgtaaaaaacaataatacattccttgatcttcaccacaaagtttgtgtctgtattcaaagcaaagtgtaaaaaaaagaatgtattgtgcacaacttgtgctaaatgaaagagagaacttttttttagagggagcttgcacaagcagtactaaacctgatagtatatacttaaataataatacctgtattttttaatttatttctttataaaatgtcacataggattccatccacttgataacatggtgcatttctatcaaattaatttatccgagataaaaaaaataaaagcaaaacaaataccgccgcccacccaacatacatacgtgtacgtaagccaagcttaattagccttccgtgtcttccaaacccctataattaattaagaaaaaaaacccaaagattcgccaggagcctagtgcgaaaagttaaccgctaattaattaaaaagttaatcctgattaatttatcttaatgcttgatctctcaggcaaactagcagctaggccggattagagattagattaggaactttttggagctatcatgtcgccggccggttgcatcagtgtggggcccacgcgtcatcccctcaatggtgataactaatgggattaattagccatggaaaataaatattaattaatcttaaccaatggtgattagcgtgaggaggagctgcctaatcaggggccactggagcagagtggagcaggggttaacactggtgattagcagagatagagagagagagagagctgtggtcgctgtctgattctgctgtattatattcccctgatggcatccggacaagcgtcaagaggggacggacataccatgtgccacctcatcctcgtgatccatgggcataattgctaggtgcacacggcggggttctggttccggcctcgatgggtggctgacgggtggggccgtctcacaaaccgtgtgcggccaacgtgtcggctttgcggaattcttgctagtatttcttttttttttcaaaaaaagtttttattcaacacgcaaggaaaaaaacgatatagagatatgattgttgtaaacagctcaaacacgctggctacatgaaaccctagcggtctgagtttatacccgacagtcccataaacccttagttagcatacggactcgaacatgtgatctccccttcccgaattcaagtggttttaaccgctgggatgtcatttgacttgtgaatagtatctcatatgtcattttccccttgtaaattgagctttcgtacttaggtctcaggtagtaagtatttcccgaatatatttatcctatatcccaaaataactgatcactttattacttatgagtcaattatgagaaaaggtaaatgacctagatgccctatactaatagagatgtcactagtgggctgtagttgagggtataataaatatatataatttttaaattagaggttggaagaaattttggattggcaaacaatattcacttatttagggataatttttgaattttgaaatttgagatggattgacaaatagtactacttgttttcccgttgaaactggtagggtaaatactaacagtttgtgtcataaaactgctacaccttcacatgatgtcttgtcagaggttttgtttaaatctctcaccctttttgtggaacaataaaaaagcattactcctgaagcaatggaacactcccaaatcccaattcaccttttgatcagaagcacatgtacatgtacatttgtacacag

SEQ ID NO: 78647 - DNA, 5076 bp, Oryza sativa
  unsure (1)..(5076): unsure at all n locations
gcagcccgattntttgacatattggagcgttcgtggcaaaaactcactttgtgattcgcacgacgaacttttgtcaattaatgccatcattggcacacgtgggtgcgatgtttttgaccggaataaaaaaagttcaaaaagcactaaaacatgatttttggacatattgcagcgttcgtggcaaaaactcactttgtgattcgcgcggagaacttttgtcaattaatgccattatttgcacacgtgggtgcgatgtttttgaccggaatgaaaaagttcaaaaagcaccaaaacatgatttttggacatataggagtgtattgggtgcgttcgtggcaaaaactcacttcgtgattcgcgcggcaaacttttgtcaattaatgccattattggcacacgtggctgcgatgtttttgaccggaatgaaaaagttcaaaaagcacgaaaacgtgaattttggacataatggagtgtattgggtgcgttcatggcaaaaactcactttgtgattcgtgcggcgaacttttctcaattaatgccattattggcacacgtgggtgcgatgtttttgaccggaatgaaaaggttcaaaaaagagcaaaacatgatttttggacatattggagtgtattgggcgcgttcgtggcaaaaactcacttcgtgattcgcgcggcaatgtgaagttgaccctttgagggtgctgacacaaggaagggcaatgttggtgtcagaattatgcgaaatgaaagagaagacacaagatcagggagaaggaggacatgcttacctctggaatttcagatgagagtgccattgcaagctcggagaagctggaagaacaaagggtgaaactgcttggagttggcccctagaggggttgatggctaggaattgctacagtagaaggctgtggcggaaatccggtgggaaggcgaaagagctcagagcaacgggttaatatttgtgggtctaacggttaagatttggaaagcctcaatagtccgcagggtcagtcgaagcaaattctattgtactttcccaagtacagcggaattggggggcatgtgtgaatagaaaaatctggcagcagaagtcagatggacgaaaggaaatcaagacagattcggtgcgaaaacatgttgggttcaagattgaatcatgcatcggctaggaaccatatcggccagcaaccaggaccgaccaagtcgacagatggttaagcccgccatcacaatacgactcgggctcagcatgggcctaaatttggaacgaccgtcaatgccaattagagatgaaagctcaatgagtcagtttggttagttttggcaagagaccgccatatatggtcttgtctgtatcttagagtttgtccgtgatattggcccgggggcctgtggtatagggggaaagaaagcccttcccgtgtggcgcgtatgggcgagccccctccccacaaaggggtcgtgcccacgcatagggagcagcggcctgaaccccccccccccttcgggctcagggtacctcgtcatacctctcgggcccgaggggttgaaccgtccccgaggcccttgctcggccgccacatggcgtccatgtgggagccttgagcgggcgtgagcaccatccgccaggcgcacttatgagtggtgcggaaaccacccccgtcacatctaatgcaacgtggcgtggcatgcggcgcaggccgaccgacgtgcgcctgcgaccaccctgtgaccggtctatgaccaggcgatggatggatgggacaggcggaattgcaccgacgcgctgacttgtgtcaggcggtgaggggctaggtatgccctgtcccgtcatgtgcagtaggaagcccagcgtccctcgcccagttgacagtggctttaaccggtgatgcatgtccggatcggtcctcccaatgcgcgtgagcccacgaagtcaccaaacatttaataaggaatgatgggggatgtcccccgtgttagccggagggattcagtgggggccacccgagattagccatgtggatcgcttccggcccaaggcataagatgtattttaatatagacaatgtcggccctctcccgatgggagaggacaggagcgacgcgtgtggtatccccttcatctataaaaggaggtccctgccccacgagtagagagaggttctttgaaaaaccggattctggacggaaggctggcctagccctagcttgttcacccagaatctagagtccttgtaaccatatgaagatcatcacacacataggagtagggtattacgctcgatagcggcccgaacctgtataacccctctctctctctctctatctctctctttctctctctctctctctctctctctcgccttccaccacgtgagcccgatttccgcagatccatcgcgattgcgagaaaggatactcctcagcattgctgtcacgccctaaaaatcgcttaatttaaaaatacattgtttaagtcatctttagaaattaaattaaaagcctacaagctaaaccctaataatttaggaaaaatttcaacataaaaataagctagataaaattttattaaataatttgcttgttcctctattttctagaattttctgggaattatttgagcaagggaagtatttttaataattgaaacaatatttcacaaattattttcattcaaaaagtccaaaaatcccttccttaaagccgttgggccaattttggcccaactcctcccgtcagccgcgcggccgagccggcccagccaactcagccggcccagccagcccgccagccctccccctcctgtggagaccgacaggtgggccccacctgtcgggagctccttcaacctccggccggccatggagccgagcccgagccgccccaccgcgccactttgccgcttcgaatccgcctcaatccggcctcgattctttcggatttttgaggggtttttatcctctcgttctcctctatctttacccccaaaaatcggagcaaatcgttgagtattttatccgagtcgactcgttttcgagtttatctctaaaaccgagtttttgattacccgagtcgatttcttgcgggaggagtccgatctcttccatccaaggctatatataggaccccctagttcccctctttcgtttgcccctattaccaagccttcccgtgctccgtagcttcgtcgccaccgccggcaagcaaaccggcgcagcggtccatctccggtgccgcgcgccgacgtcttcatcgtcgtcgccggtcggcgtcaccaccgttgggtgtgccgtggtgaggggaaagctcggcaaccttccttttccgtcaccggtcaccggagctccgctggcccgtgcaagccgagcccgccgccgccgcccctttgtcgccgccgtcgtcgtttgtcgtttgactcgagggtgagtaccgtcgggttcgtctcgtcgccctctacgtgtccgtgtcctccaaattcgcagccgaccatccaatctccggcgagcttgtcatcctagccggccaccattgatgatgtcatcatgacatcatcggtttttctttttcccgattttctaatagattaaatcttcagaaaatcataactaaataaccgtagatccgtttcaggtggttcaagttgctaaatttttctaaaatcaagatctacatgttaaaaatatccacatgtactgtttatgcttgtttttgtactgctttgttgatttttgtttaattgctttagtttccgacgttccggaggagagtgtttccgttgaggaaggttccgaatcgtttgcggaagctcaaggcaagtcacatagatcccaaacaaccctttgagcatgttgaacccgtttaaagctattattttatttcaactatgcattattttcgaatgtcatcgggtggtgaacctttcccagttaattattggccgaagatgactttattttcctatgggttataatttgattagcgtgaaccttatatattggattggttcaggtaaatgctatatgtatgtttgcttagccatgcctagaaacattagctaactaaaggggttaaatataaattatattatactgtgattattaatgatggttataataaatggtagctcacgatggtgaatcgtgtgatgttaattaattgataattaaaacctggttaaggtgggttgtgagcatatggtgttgatggttgtgctcatgacaattaaggactggttcacgagctactgttgtgaaacatttatcgtgccaaccacaagccagcgtgggcaacggctttatcttttgtatagcatgattcattatagtgtgccagactgtgaagcggcgagaagtccgtgggggtcgctggggagtccattgcctctggttttgagggggagattatgatccaggaacggtgcattgtggtgagttgtgttgtgcgaggggtattgtcacagctcttttccgaggtaccgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtcccatattattaatcaatggtaattgtgataattaatttgactcctggtttggaatggtatattcctggtgtggaggttgggtttgttcaaccggggttagttgttcaaatgaggttgggcctatgcaacacgggtgtgttgtatggtgtttatttaatattgattaattatacaactgttttactattctcttgaatatttattaaatgttgtttatgcaaatgagctatattatgccatcctttgttatcctgtgcacttgcatatttgctgtgtggcttgttgagtatgtcatatgctcattcttgcaatattcaatcatcagaggaggagtatctcagcgaaggtgatgacctggaggattaagcttgttcttggttaagatgcctgtggagtggagtagccatagctgttccgtagtttgttttagttttattttttccgctgcgtagaat

SEQ ID NO: 78648 - DNA, 2894 bp, Oryza sativa
cgtcctatcgtttggttcagaattgcttgtgaaactatccgtggaggccgtggggcacaagtgcagaagataaggggccccagttatgagctggaacgtgtgatcgttgcttgctacatctcaaacatggtttggatctgtccgtgcctagttgctgtcaaaatcccgggtgttgttgcatcggttcagagttacatttcacatgatcgctgggagggctcacatggccgtttcatcagtccgggcttgccatgcgaagcaatcacctgaactacatgtccctctctactgctgctatcacatgcccaagtgacagcgactgtctactatctcactaaacagtcaaatctttttgctcctgatgaaaatgaattgatcttagcaaccgtccgttcattccgatggccttttcattagaggtagttaagatggaactgtcagttttttttttacctggttttaccaccgtatatgagagagtcgtggctgtgttggcttgttatctcggtggtcagttgctcgaatatttgtgtcagtggtgaaagcaaccgactagaaaagacctgaacgacctgtatgcgttgggtgacactggagatggataagcaagttccttggcatgtcaattcaggcgaaaacggaaggccccaaagaaatggagctgtggagggtagctacttggtcgctttccttgatattatcattgtgtctgcgttggagataaagcaaatccttgagtatttatccggcccgaactgtgcaactagatataatagaaaaaaaggaagggtaaattttgcaaaactatagatatctcaaatcaaactattgtaaatttataaggcgttgtatgtatatcacaaagttatcatagatttttaccaaatttgttatgaaactatacatttataagatgaagtattgcaaaactatagtttcaatgattaaattatcttgaaattatagactttagagtttaaacccttagcattaatgttttgatttatttaccttggtactaatgttttgttggagcaacaaaagatatagttttgttacaaatttagtgtcaaatatgtattttgtgatactctgtcaagtgtatatataattttacaatagtttaaaattttataaaatttagttccatctattttttataaaatttactctactcaaaactgaaattgaagaatatggataaaaaaagaaagaaatttactctcatttgttttagtttttttcttaaaaaaacgctttttcctattagtacgcgcaataaatggaaatcaatcaagaataaatactcaacctcactaaattctccacatgtgtgtaatattcgtcggtatctctctaaagtgaaaacaataacatctttatgcgtaatagcatctaccttatttttttttcatggtagttagtgactagcaaattgaaaatcacacaggatatgaagaagttaaaaaaaaaaagttcaaataccccctaagcttgaaaacccaaattaacccaaaggaaaacaaaacgagtgaaaaagaataaaataggaaattactgcccatttccaccgctgactgtcctactaccctgaagcctcttccgatcacctccgccggatttgagcacgccggccggcgaggcccgcctcatcaccgccagggcggcggcgctcccctctctgccttctcgccgtcgaggtattgagaactatggcccctgcaacctacaatcctccggcatcagcaggtcagttttttttatcattcaagaatctctctcgctcccctaacaatggcgaacgtcaagtaagcaaaatgcatttctttttctccctctttttctctctttctttttttccatttgtttacatgctggtggccagtaattgcaattcaactctgccctcgacaaaatatgcaacactgacaaccgaattcatttcaccggacaaaggaaaataaatatctccattctgtagctcacatgcatgcttggcttcaaaaacagtttcagttcaagaaaacctgcttcacacaataaatcccttggctcctttcaagattgctgctagtgtgtgtgtgtggcaggttacccttttgtcatcttgagcagcagatgtcagagaagatttctgctgtttttattcagtcaacgatttgactcattaaaacagaccaatgcatgttaggatgatcatagcaaaagctctcttcttgtcctagttcttttggaaaagggaaatgacttgttgagtcatttctgcctttgctcaccatttatattcatgatgaatctctgcctcagcttccttcttgttttgtcctccttcagaatcatgacatttgacactttctgctttctagctatattatgaattgtcatttctttcacacaaaagaacaaggaaaaaagaagaagaagatatggtatgcctccactcaaaatgaaaaaggctagaaattaggaaacaatgagcttgcgtccttcttcctggatataaattgtttcatatgacatgatttgtctgctgagtgctgacctgaacttcgcggcattatctagtactacaagcttttggacctaaccacttatcagaaaattccagagtccatttatgtcttgatcagttctacttcaataactatatggtatgtgcaaactttttctcttttttgacctttttctgctgacctgtttttgtctcatgggaccaaaccaaactgaatattcagaatgttttcattctagttttcaaaaaagagctgaattttgactgcgcctacattcgttgatcggcgatcgctgtcccgacaccgttttatttcttgtctttctcacttgcactgcacttgaattaatcctccacaggggctggctgacaaacacagatc

SEQ ID NO: 78649 - DNA, 615 bp, Oryza sativa
acacaccgggtacccaaggagaggcctttgggccgtacgacataggtgggcaaagagccgtaggcacatgcggcatacttgtaaataaagaaagagaaatttccagaataagatataaatctgggggatcatacatatctttatagatagaatagggagatctagttacaatcaactagatactttacttgtaacccccctcatcctatataagagggggcaggggtcccgagagggggaggtcggattatctccacaacctaggcatacatcatctccactccataccggacatagatccgatacacatacaactggattagggtattacctcacatcaagacagttggatcatcgagacaactggatttgggtattacctcacatcaagacagttggatcatcgagacaactggatttgggtattacctcacatcgagacaactggattagggtattacctcacatcgagacaactggattagggtattacctcacatcgaggacctgaaccaatataaagctttcatcgagtcatggtgctcgatcgagtagtagaaataaatcgtcatatgtagtagggattatgtgttaggataacagtagcttatcatg

SEQ ID NO: 78650 - DNA, 1647 bp, Oryza sativa
tattggtaaattaatatgataagctcctaatgaatctcttggggcttataataataagcatgtactccctccgtcctaaaatataagtgattttagatggatttaatacatcttagtatgataaatctggacaagctccaggatatgtcacatccatttaaaatcccttatattttaggatggaggagtaactgtcaccctattttttaaaatatttaatttatccctagaccacttgtttaagctaatattatgtttattttttaaaatatttaatttatctgtgtaatcagctaggttatctgtaaaaataatctatgcttagatctcctcatcctagaaagcattgctactatggcgcatgtatcgtaagcgaaattaatcttaaccccactttctactactatataaactctcttcgttttaaaatagttatccacatggggattcataatttatcccaaaatagttgttacaactactacttctctcatcaatcactttccacttaaatttctcctcattctactcacttttcttccaccattttcaaccataggcatttaatatggggtttttctttctcaaaccttaacctatgctagcctaaaacaacaactatttcatcaatccacgtatgatgtttgtcacattggacaatcctaaaaccggtagttaacatcaggacgggaagaagatgtgaggcgtggagaagaggacgagccaagctagtgatctcagcagccggcacggagaagacaagccaggtgatctcacacagcctgagacgattgctccctgcaggcggcagcgactgctttgtcactgaccgtttgcactcctcttccaagtgtgtgtgtgtgtgttttgaagggtgaaacaacatattctccgcagcagggatgcgacaaagaaccgcctgttaacctggccccgtttgctctctggccactttggcttgtaggatattatgatcttacttcctccgtctcaaaatgaagccatttatgaggttggcacgagtattaagaaagtaggtgagaatgattggagaaagtgtgcgattggttgaaaagagaaagtatgtgaagaagaatggttgtgattggttgagaggaggaggtaggtgaagaaatagcttcattttaggacaagacactgtgctagaaatagctatattttgggacggagggagtatatgagagcagtttaggtacaatgggggatgcatgcacctaaggaatgctatatggctttcgagtttgaagtgaacgaagaacatgaatattgtttccgaaagagtgcagcactacttaaaaaaagcttttccctagcggccatttcatatttttgctggcggctagtcactactacgaaaaccatttttcgtggcggccattttagatttttgctggcggaatttacagccgccacaaaacaaaggccagtgaagatcaaaatcttcgctagcggttattgaccgccagcaaaaatagatttttgctagcggtcatcttaagccaatcgccagcaaaaatctattttcactggcgttggcttaggacggccggctgagttatatcagccgccatcgaaaaaggatttggggaacaaaaaaaaccggtgcgcagctgcccagccgccagt

SEQ ID NO: 78651 - DNA, 38831 bp, Oryza sativa
  unsure (1)..(38831): unsure at all n locations
tgtcagagaggattttcgtggtgtcgacattctttcagtgtacaaaaatagtccaaacaaagaaacattacatctagggcattaggcttggctctgtcttgttcaaactgacccttcccgatcaccacatgctccaacctcaacttgccaaatgctttcttgatgatccggccctgcaacatcattaagatgagcaactatccaacaggtttagccgacgtctgaagataaaggatcatctaacatacctcaacagaatgtgatgttgctaaccgatagacgtgaactgggcgtgtttgaccaatccggtgacatcgatccatggcctgcaaatccatctgaggattctgcagaatgatggcaaaagtttaacaaatcacaactaaaccagctaatagaaagtaaagttacagtaggcaggagcgaagaagtcactacatgcctacattccacccattcaaacaggcagttagctaattttaagtaaagttacagtatgcaggagcgaagaagtcgctacgtgcctacattccacccattcaaacaggcaggcggcgtgcaaaaacatcttgtaatgttcttgctgtaatatgaatatttagcctgaagaaatacaataatatcaatagggaattacccagtcactatcatataggatacaggtatccgctgaagtaagattgataccaagcccgccagcccgtgtgcttagaataaagatattcatgctgctgttcaagtcattaaattctgctatctgcaagagtagtgcacaaaatggtgagaacagtattagactaaaaatggatgttaaaaggtaacatggcgaaaaatgagaatcctaattgtattttaggatagtatagtcaacgtatatgcgtctagaactttacacgccaagtagtaatcagtaatgcactggcacagcctgctttacctgcctcctcctctcttccaacttaacactcccatcaattcggcaaacctgaaggccttttgtttccaagtagtactcgataatgtccaaaacttttgtccactgtgaaaatattagaacctacacaaaataccggttgaggtctagtttttttccttaaagagttcgagctagcatttgcattaatgtaatccctgaattaaacagaataggagagaacaatataccttgtgcttccgtgcaagcagcaaacttagcaatctgttcaagagctgaaatttgccgcactgttccaagagcttctcaacaggtggatacagacctacagaaagacaataaagcaaataagtgttaggaaacgagcatgtgaatcaattgataacagatgtccaatgtggaacaacctgatgagtcatacgcagactccagaagatcaggatggttgcaatttttcctcaactgaattaacagattatttagctttgccttaatgccaggtttccgcagaactgcaatattcctcagcacttgtcagattaacttgtcaagcctacaggaatgtgtgtgtaggagactaggtgtacaagcatccataccaatttctgatttttcatgcaggtattgatcaaatgtttgttcaaccaagtgattctggatttgtttctgatggtcagtcatgttagcgtaaatgattatctctttctttcgtggaagcatatgctctacatcctccttcatccgccttagaaagaacgggcgcaatatggcatgaagctttgaaacaacatcgacttttctcttctcttcactatcctcttggtcttcttcacctcctttcgcagaaaagtcaaacctgtatggcactcgtaaggccaatgcaggcaaaacaaatcaattttaatgcatagggtacctaaaatgcattagtatattctttgtagcaaagaatgatcaaacatgttaatcgcagcaaaatccatctaaatagtcaatggtagacgcaaaagtaaaatatcatgtcagtacaccatagaaatcagtaggtgtacagcataaatttctgctaatattcaaaagacacattagcagacaccacatacaaaataatatgcatactcacaacaacacatagggcattcaactttacacttcataagtaaaggcaatgagaaaaattaaagcaatgtcttaagagtagcaacaaactaatggaataacatatatatagacagggttagttgatgggaatataattgaaattgctgttaagcagtttaagaggttcttttacattgttttgaccaaattgctagccctcaaggacccagacagatgctgacaaatgtctcgacttgagaaaaagaatatctgctctgctcaatgcatacacaaatgaacaagttgacaataaacagtcaggaaatgattcaaacgtgagactaacaattatttgccggaaaggttaagatggttataggaatgattgcatggtatgaaaatcttcagttactatcatatttgtatttcagtgctgagacgtgagactataaaagcacaaaccgcactagtgaaggtatatatggggaaagggtggtactattatcagcaaaatgaataataccatgactcaaattcttgtgtgaagagaatatatcaggcaaaatgaagttcagcagggaccacagttctgctagattattctgaagaggagttccagtcaaaaggagcttattatccattggcaggcgctttagctcccttaataataaacacttggaattctttagccgatgcccctggaaaaagccatcgaagtaaacatgtaaatacaaaactaaaacagaaaaccagaaggatgataactaattgcaaggtttctccatgtacctcatccacaataacatacttccacttatagtgagcaagatgctttgcatctgacatagccatctcataggaagttacgattaatggaaaatctgggccagtggttttgggcatgaattttctccttatctctgcccgggctgctttgtccccatgataaatcagaccagtcatagatggaacaaacctgaaagcaagcagcttcacttaagaatatcaatcaaggataatgaaagaataatatggatatgttaccttgagatctcgttcacccagtttgagagagtggataggggagcaattatcaggtatggaccatcaagacccttccccttgagatgggcaagaaaaccgatagtctgtattgttttcccaaggcccatttgatcagccaatatcccattaagcccattctgccaaagtgatattaaccacttaacaccctttatctggtaggacttcaacttcccgccagtcattagaggaacaagtctggcttgctctttttcccacctttcttcttctgtgagagtacaatcctcaggtgagcaatcttcatgagatcttgtaagcatgactgccactgctttcttggcttttttctgaacaatattttattttgtcggttagaaatgaaatggtttgcttgaaattttgatctatgtataaaacaagttgccacattcatacagaacactgagcaagctattcacttaaataatataattgatcctacgaaaggatctgaaattctgaataagtgtgcatggttctagagaaatttgaaacaagcccaaaaatataaggcacaagcaaaagttaatggtttttaaacttttttccttcatacggtgtccctctatcttcagcattcatgaataaacaacctctaattagcaagatagtaataacatatataaggtgattttcctctgacactcactagtattgagcattttactctggtattttcttgcttctctaacctcctggttcactatctaacagtcaaaagagcctatttgattgatatactaatcgctaacatttgccacaaatttgtgccccacattcaaacccctaaaaatatcagggtaccagaagaaggcggttgcaaatgtgttatggcgagtctttaaacaccccttctaattatgattttctaacaatgtactacaggtggaaagctatttagtaaatattgaaaaactggcaacattagtactatttgaaatccagatgagcaaggtcaacataagcatatcccattaatttagaatataggaaaccaaattactccatgtatgaagctagaactcacatcattgtactttggtgcagaagtagctttcctctttctgccacgcccattcttcttctcttctactggctcctcttcagcatgagtttggacgccctccaccttagccaacagcacaaccatcaacagaaaaatcaaataaagcataggaagaagcaaaaagagtcatgtggcgcgtggagaaacaatacatacatcagcgatcgtttccatcttctcaagtagaaattctgaatagagttgtgtctgtgatagtagctcgtccaacttgttaaaacgtgcatttggatcaaaagcaagtcttgcagcctcttccctcttccgtgctacctcttcttcttcagccttaacccgggcgtcgtgcaacttctcttcctcctccttcatcgcatcagtgatgagggatgcatcaccattcttggcctcaaggtcaatcggtagagatggaactgcatccacaaaatcatcagctttttcctccttgacaggctccaataactgaccttcttccttcaccggcacagtgagaggtgacaaatcactgttgttagccgcaggttccacattcagggaagaacttgcatccacaaaaccatcaactttctcctcaataagcacatcgagatgatcctcctcttgcttaatcgcctcggtggtatccaagacatccccattcttacattcagaaatcttctaacaacaacaactcaacgtcaaccaaaaaaaacccgaaatgcggaagcataaaacagaaatagagatatctgaaaaaaaaaaaggcattcacaaataaatcacctcatcatcctccagaacggatgtcggggaatccacggtggcagcggcggccgcggccggggatgcttccaccttcatcccagggacggatctaacttccgacattgtgggggtcagatgaaccttcttaaaccgcccctccaaactttttggagaacaaacaaaaacaagccgttagtactcgtattaatgttaaggcaaatcaataggaaacgctagagaagctagggtttaacgcacgtgaactcgacactccaagaaaagaaaagatcgagaaaaaaagtgggcgagagaaaaagagaggatgcggaatgctcaccagccaggattgtggcgggaagcagcaggacgacggcgcccctgccgcgctccctgctcgcgaggagatggagatcggcggccggcgcggcggaggcggaggaggggggagacgagatgggaggtttttcttttgaacgcatataggggacgggaatgaaggggaaaagccgtgttgcgctcccactttgggacctgcactgggtggtgggacccactccttcgggagatggcgtgcaacggttcaaaaattgaagtgtgtgggcccaggccacactatctgggaggtgagtggctacagtcctgtgtacttgaggctgtttacccccccccccatttaattcaaaggaaattttatccctcctcaaattcctatgtttttcctgcggctcaatcaaacggtcattcctatgtttttttctatgttttgcaatcctctattttacacttgtattcctaccagaattctatgtttttcctattcctccgttttttcgttcctgtgattcaaaggggcccttagttcgggggaaaaaatgtgatgtaacatcgtatatttgaaaaaactaattcataactcgtctggaaaccacgagacgaatcttttgagcctaattaatctaccattagcacttgtgggtatcgtagcacttacgactaatcatggactaattagactcaagagatcgtcttgcgattccccccataactgtgcaattagttttttaatctatattttaatgctccatgcatgtgtccaaagattcgatgtgatgtttttagaaaattttgggaagtaaaccaggccttaatttgaatatctatgtccttgggtcaaaattttaatttggataagaccgtgttcgggagataggcgcacataaaatagagcgacatatttttttcaattaagtatttggtacttttataaatttaattaatacttttgtatagaaactatttctttgcgaaaaagtatcgtttaacagttttaaaatgtgcgtgcggaacacaatgaaggtgagttgggaatggtggggaaaaacacagcatgttgtccgttgattctttttggatagagagagtactcttttttttctataataaggctgtgtttacatcttagaggtaaaaaattttgccgtatcacatcggatatactgacacacatttgaagtattaaacgtagtctaataaccaaacaaattacagaatccacctgtaaactgcgagacgaatttattaaacttaattaattcgttgttagcaaatatttaatatagcaccacattgtcaaatcatggagcaattaggctcaaaagattcgtctcgcaaattagtcgcaatttgtgaaattagttattttttagcctgtatttaatattttatgcaggtgttcaaacgttcgatgtgacaaggtataaaatttttgtgttggaactaaacaccccctaatacactttttttgacaggagaataatactcctcccaatatttaggtgcacaaaattatagacgtatgcgtgcattcaaaattttgctcttaatactgtacaaattttctcacaaaagaaaaaaaaagaagctaccaatacatttaaaatgttaatatgtggtacatatataatttcatacaaaaatatgctcacataataattagacaacacataaatgttcaaaatgtgatacaactgatacattgctctcttacaatacatgaactacagaattatacattggaagttctctttatggcatgtttagttccaaaaagtttttcccaaaaacatcacatcgaatctttgaagatatgtatggatcactaaatgtagattaaaaaaactaattgcagatgaatcttttgagtctaattattccataatttgccataagtgctaaagtaacccacatgtgctaatgacttattaattaggctcaaaagattcgtttcgcggtttacagacgagttatgaaattagttttttcattcgtgtccgaaaaccccttccgatatccggtcaaacgttcgatgtgacacccaaaaaatttcatttcaccaactaagcaggcgtatagtatgttttcgtccgtcgcgcaagtgtccgcttcgctcacgttccaacctacccctgcgtgcccttcgctcatctctcccaaagaaacgaactgaatcagacacacaacatacagtaacaaggcaataaagatgtaaccaaagaaatgaaccgaatcagacacacaacattcagtaacaaggcaataaagatggaaccatgaacatatgaacaaagctaaccaaaaatccctccccaaacccaatcttatgaacaaattagggctaacacacatgttctgtttatggtaagacaaattgaatccaagaaaacgaagagattttgagttggagaaaagacaaaatcaaatacagatgaaggtgtcataaatgtaaactgatccagccaaggtggaaatcaccttgtcatctttaaagattgggcatcattacgtccaatctagacttatctgtgtagctggcactcgtcaaataaggcctctcatgcgaataaacacattgggtgagccagcgccccacgtggtcccacaccctctgatccacacactcgtcaaacaaggcctctccgatgcgcaattgactggtgggtgacaatgaccaagtgagggagggaaccaccttcaccgccgtcatgcaccaacttctcttaccctccccttctttctatgttgcgagagagaaggcaagatgagacgaggttgggttggggatcggagtcaccgctcaagatagtgcaagtgggaatagaaggggtagggctgcgatattcttcatgtagtgccgatgaaaaacaatggatagcactataatctagaatctagtgggaattagaggtgccttttccccgctttgcactctagcacaatttttcagaactattctgttccgcttcagtttttattgaatctatactatgtttaattgaactccagcactatataagttaaatttattagaagcttgcgttatactccctccattacttaatacaaggcgtaactgttcacaacacagagaccaagaaatagtataaataccaattgcagtgattaatttttgtctcatttacgcttcattcactttgcctgcaaccaatcgccaacactgcttgttgacccgatatcttctgcatgcataggaataggagaggagatgatagttttcaatgcttgcatgcacatcaaacgggagcaaaagtaaataccgccctatattctgaaacgttaataaaatatagctacgccttctatttaggaatagagggattaccaaacatatccatattttataaaatactctgaactacgtagtcacgagctcataaagagggtggtcgcgtttcttcttccatttttaattagaacaagaaaaatacagaaaggagaaaaacaaaaagaaanagnnnnnnnnngggggggggggagatgcgctaatccacggacgagctgtgacgagcttgaccgcgagtccgcgacgcgtgggctcgggggtgagacatggcttccccggcgccgccgcccaccgcccggctccggccttctcaggccgccagcagtgcctcctcctcctccttccctacatccatctgcggccttggctcgctcggcgacgcctctagggtttcctccgtctccttccggcggcgtccaccagcatcgcctctcgtccggtgctcccaagaccctggcaaggtagagcggcttcttttcgtttcgtttactcggtttttaatcgaacggtgctgcgcgggttcgctttggatttggctagattgggaagaatgctctcgctagctgtattatcgaattttctgtgtgaactacaggaaagcgaaatgtgggtcgttcgtcacacatagggtcatgccagttgccaaaattgatgctgggcgttcgttttaggctcatgttgttagtgtaaatgtggcacaccgatagagatgcggaaaagggttattctgtagaaatgggagtatgggttggtcctgttggacagggttagtatctaattttctttatatcaggaatgattctggcagtatatcaatgtaggcatcattcagttattctgcttttgaaagaggaaccacctgtcagaaaaaaaaggaactggtgcataacaagggaaaaaaaagtagccgccaagaaaatttgcaagcaaagttaggtttagacgtaaaaccacagtaatggtctctggttgactttactaaaaaagatgagtggtcttgttgtaagaacgttaactgagaattttctatataatgcttgaagcaagcacacacgtgttggctgcttactgatatctgaagatgatcattctggcatttgtgtggtgaagctaaaagaggatttatgttgcggtgagattagaggaaatgttgattgctgaaattagttgcagttttgttatgtgcagagaacagcttgtttataccttcggaatatggaagtgcattttcattttacaaacttatctagccaatgtaacactggtgcaatgggcttattattattctttttttgcaaatctaaatacataattatttaaggaaaaaaactattgggcatgaactcttagtgtaaaaaagaaacactggttaaaaaacaacttttgaggttgagtaaatgtgattgaaataaaaattaacttggctgcatttccttgttagattgaagtgtttaatactgaaggaaccgagcagtcacaaggaggctccactggtatgatgtttgcgctgtgcacttattgggtgtgtttggctggccaactacaacggctgtgcagcgctgctgctgcagcggctacagtagaaattgtatattgctactgtagctgctggctgccaagtcacaccgaataggcccaattttattcttcaacttgcatgtgttcttttagagctgaactatttttttctgtcgtacaggttcgataaatcatggcaaatactcaacaaggagtttctcctctaaagagtattcacagctaactgtaaatccaatgactaataatgataccactgttgttcgctatctaaatttctatggcatagcatttaggcacatttgtttcatgaaatgcaatgtctcattagaaattttggctggagcttgcactttgcaccaaattgtattgcatgagtgaatacctcactgaagtcgatgatcttgggtctatcttgcttcttgtgattataagcaacaatctgctgttaatgtttaattgaaataactgttggcagaaggaaacaccttacagagcttatgagcaaaacttgtattggcactgggttaatgatttcagatgcaaactggatatagaagcattttgcatgcacacttcttgttgagaatgaaactaatatatttgaaattcaggctttcagatattttcgtgaattatgataactgtgcttggaatggcatattcattttacagtgctaatattacaacttataaccattatctacactgcttctgtgtcagcttgcttgaaagactaaagaggtatggtgctgctggtgttttgtcatatggactactaaataccgtctattatgtcacgacatttttattagtttggtaagtaagtcagtgattggtactgtgatggatcattaatttttatcttggtgttacacatctggaacgttcacctgtgtaagaatgttggtcaagtgtaaagtggttgatatgttggtcatgagaaagagggttcagttggtagctcagcatttccacagggtcaaacgactgcacatttattcgggccatcagatggaaaagagaataactgaatgacttactttttcaggtttattttttctcctgctcctggtaagatgggttatgctgcggcagtagagaggtaatagctgcaaccaacccccatcccgcgcacgcatgcacgcaagcacgtgcacacagggttttctgatcttaattagttttgtgttactaaaagcagattcctcaagttgatggcaatggtatgggctggcagtcaagttactaaaatttttcgagcaggagggtgagtttactttcataggactggtttctaaaactcagcaaatttagtgatcatttataggattttttttctggatcagccgagtatttttttcatacttttcaatattaccttgaattacattctcagatgtcagatgtaccttttgaaattttatagaacatgtattgctgtcaaaactgactagtttctgttctgagagatgacttgtttggtgtacaatagggcacttgcattggctccttttgttgatagagggctaagatggttcacagtcaggttcaacttcaaatcagaaggaaaggtaaaatactcatctcttgctttgttatcccaatggggagcagttaaaccgggaacgagaggggaaactacatgctagatttaagatttaaatatcagtcttctaatgtctgttgcttcatatttatcaccatgcaggcatttgctacaattgttgggttctgttttgcacttgctgctctactgttctttggattaacaatactttgggcgtaatacacctgtcgctgctgaagaatcacatagaagaccaagaacactggtgaaataaaaagattgggttcctcctcacattgcggaagtgaacctttatgcaatcagtaatgtggcttccactttactattaattggcttagctcttcaaaactatggttctctcggtaccatgtgtttgtttttgaaaacaggtttccatgtattcttgtatgagtagctattctcaattctcatttacataattcacctgcaagtctgcaacctggtgcttcattcgttaatcgttcataatctggaacatcttcagtgtacaactgtacatattcctgtaacatgatccttggggagttgtgtgtgttttcatgttccttggtgcgtgcagacattgtaaaacaaagaaagtttgttctggaatcttgacaaagaaaaccttttgaatcaatacacattgatgcttctggcgagcctctcttgactactgtaatttgtaagatcaataggctgttccacagccagcacgtttgtttcctctgaagaacttccttcacttcactgctcaatgcacagtcgtttctccgttaaaatcagctgcattgcctgcatttgctgctgtcacatggatgcaactatcaacaagctgatgatttccatggcttcttggagagggtgggttggaagctaaggtagtaacctccccattcccatagccatgaatccctctccatactcttgtcagcaatcttgcaagaatgggtgcctgcactgtagcttgatgccaatccctatctctgctgatgtttctgcccatccgatgatctgcagctatattggtgcagtgcatccaacctaacaatgttgtcactctgacctttcgtcagttggccaccctcgatttttctcaatttcgttagcatattttttaaactgataaacgatgtgacttttaaaacgggctcttaaaatcttatgacaatacatctgtattttttttcttcacgaatctgtacaggctgccacatgggctccgagccaggaggagcggagagccgtatccatccccgatcgccggcacattatcggtttcttttctcagagtgagtgcagcggcggcacattctccgtgattaaaaactctcgttgagcaataattatttcttgtctcctacacatcgtgagcttctactccatatcaacccaagaccaaatggattattctttgtaaaaaccccatatccatgtgaaccgcactacgacaaaaactaaagaaatttccactttgcgtgtcgactacaagtacacagctccaaagtaaacgctcatgcgtcgagttcaggtttcattcgttccatctgccagataacatgaggcggtaagctcgtgagaaggttcacgtttctaataagaacaggtcgaaaaccgtgaaatttcaagctttttcacgtgggacagaaacagatttcgaggcggagaaattcaaattccaaacaataaatttcagcaaattttgtttaaaatttatcgaaacccatcgtatcactaggagtcgagattcggcagtctataggcatttaacgaaaccatccctgtgatgactccctccgtttaaggcatttgatttcgtcctagataaattagacttctcaaaatttaaccattttttttaaaaaggggatattgacaattatgataccaaataaatacactgcaaactcataattcacagtggatttcaataaattaaatttgttgctttaaatgttggcgcactattatataaatttgatgaaaattcaaaaattttgatttagaacaaaactgattgtcttatattacaatactatatggaaccgagtaacactagtctacaactcccttcactattaaatacttacatccgttttttaatatatgacgtcattgactttttacataatatttgaccattcatcttattttgaaaaatttaagtaagtattttttttttcttttatagcggcttgatttgtcactaatggaacttcaagcaatacttatattttgggatttccataaaatttttaaacaagacaaatgatcaaagattttaacaaaagtcaataatgtcatagagatggcatataagtatttgtgggttgcttagacgggcccatttgagttcacgtgagatgaaatttaagtacgggcgcacaaaacaataaaactattagctcatgattaattaagttttaattatttcaaacttgaaaaatagatctatctgatatttcgtacgaaatgtaccatttagcatattgaaaaacatgctaacaaaaatctaggtaaaatttgtatcttaataaaaaactaaagggctagtaaatattgagattttaaaaggttaccttccaatccttccattggttgactaagaatgctttaattattgtatattagaatccttgtcaaaattgctatgtactcatggagcgttgttcgttatggtgagggctaaagaggatgaagaataatttcatactataatatatgtgtaataaatcctttatattttctcacacttgattaataagtactatattcggttatgttttgagtaatgatacaatcttcaaaatatatctttcactatattttttctattacaatatatatatatataataaatatatttatttttcctatagtactttgtaagataaatctactaaataatttaatcttatttttatccaaaactccaaaaatcatgaaacggggagtagagaacaaaatgaaaccgcgtccaaattgcaaaggcgtaaatcacccccgccgtgtctgaccgtttcgcttcggtgcggctcccactacgcgcctcctcctccttgtcctcacctctctcactctcctcccttcacttcccaaccaaagcgagctccattaatgacgcctcccctaatctagccgccgtactcgcctccttcccttccgagaccacgcgcgaactgccccatgacactccctcctcctcctcctcctacttaactaggaaatcttcgcgcgccagctgatcgtataccacgtacgtacacatgggctaccaccagcccgtacacggcggcgccgcggccggtgccggcgggagtggcggcggtggcggcggcgaccacctgcatcagcatcaccacccgcggttgcacagcccgcggatatccgggggcgggtcgatgacccggcgtgccaactcgttcaagcgcggggagatcgagctccagatcggctcgccgcgctcgccccgcggcgacggcgtcgggagccccctcgccgagtcgtcgtcggcgtccgaggcgtccgcgggcggcggcggcgcggtccaccaccaccaccaccagagccagcagcagcagctccggttccgcctcttcaagcggccggggtccggcgccggggaggtcgtgctcgggctggggatccgggagaggaggcggattgggaacctgctgttcctcgcgttctgcggcgtgtgcctgctcctcggcgtcgccaagatctgggcgggcggctggttcgccctccccggcgacgacaaggacgctgatttgcaggtatggaagctataaattcctttccagttttagactttctagctgctattttggcaagctttcttcttcggagtcaacaacacgtgtagtttgaggaaagttgcatgatcctctgaaatgttctgtccgtacatttcttaacgaacaaactatatatcctgctgttacttaattcgaaggtctttgaagactatgaaatcatgctagcttgctaatgttcaactgtaatttccgcacgaacttctgatccttggtgttccaatttgtaagcatgcagtttggccatcctatttgttccataccgtaactctgcaatttcatgttctggagtctggacaaagcaacaagagttgaaaacagaaatgtttgaaatcttgacaggtttttagacagttgaatgtgatacttggggaaaaaaaattgtggtggaagagatgttagaatggagttactgcattttagatttgcatggaccttattgaatagggatattttacaggagatttagcattttaatttttaggacagtgtcttacttgcttggtatgtctataccaactaatttactacgaaaacgcttctttggtgcttttggccattggcagttggatgcagttaagttttggatcttacgaaatatattttgtttgtacgttcaatagtttattgtagtagtcaggcagtcaacttgagtttattgtataaaaaatttagataactcgagaggttccatactccatttgttaccaaggttaattataagggacatcatgtgggatggagatgggattcagagcgctgcaaccttgagctagcttaccagccaaccgtttgtcattgtttgatcttcccaagtaggatgtgttgatctctttatctcaagtcagtaatttcacttctagtttttaccatggtgccctctctatctctactaataactcaatgtctgaatcatagcattgcatcgacataatttagttaatccttttagtaacattttttctattacaagcttattttgctgttctaacatttcacgaagtttgtatctacttaccttgttgacccaaattgttgatcttacagtgtaatttggttttgtgctgtccatgtttctaggatctctcaatctcattctccagtgatggagggtatcaatttgatagccactttggacatgttggagggaaagagagtgacaggatgttgatgacagtgggatcagaagacagtgttcctgaggctagtaatacatctctgcctcgacctttttggttcacacattaattagtggaacataacatttattttggctggtgcttcatgtaggcccccgatgtctggtcccagccaagcagcggaaagttcagacaatgcattatttcgaattctcataaaagtaagttggtctgtattaataccttttggtctcttcaatactcctttattaacaaggtatggtcttctgttcttaatttgtagaggaagattctcacacaaatggatacattctcattaacgcaaatggaggtttgaatcaaatgcggtttggggtgtgactcctgtcctactttttgactttaggttaccattagtgtgctatggtctgatacatttttcatgttgcagatatgcgatatggttgctgttgctaagatcctgaaggctacattggttctaccttcacttgatcatacatctttctgggcagatgacaggttgtgctttaacatagtttcttcatccataatctcctaaaaactaaaggatctcctctctttctcaaaaaaaaaaagatagaaagaaagaatagaaaactaaacttttcaatcaatgtgtggccataatgcctattctgatttcctcatttctgtagtgaatttaaggaccttttcaattggagacacttcattgagtcactcaaagaagacattgatattgttgaaatgctgcccccagcatacaagcatattgagcctgtggctaaagctccaatatcttggtcaaaggttgaaactaggtttttatctataatttacattaatatatgatggatagtcggaaacactaactagtgttttatcttgtgcaggtgaattattatagagatgaaattctccctcttttgaaaaaacacaaagtcatttactttacgcatacagattctcgccttgccaacaatggtcttcctagttatattcagaaattaagatgccgagttaactataggtctttgaagtattcccaaacaattgaagatcttggtgctaccttggtttcacggatgcatcaggatggaagcccatatcttgctctccatctaaggcaagttcggtgctcctaacattgttgtaggatgcttctctctgcactcattactttcgttcttctgtgcataataatctaagttaagtaaaggcaaccctgattttcttaattttgaaggttttccacaagctgcagcttctattattttgaacccgagcaagaactgtttatctctaaactattgagcatatgtgagctagatatggctaactttgtggattgatagattatgcatgttgtttataatgtagatgcttgtgtagatgaaactatcaccgtgccctttgaaataaggctcactgaagcaggggtgtaattttggtgaaaatttgcaggtttgagaaagatatgctagcttttactggttgcagccatagcctgacatcagaagaagaagaagaattgcgtaaaatgcgttatgaggttagtcattggaaagagaaagaaataaatggaactgagagaagaagtatgggtggttgtcctttgactcccagggaaacttcgtttttactcaaaggattgggtttcacacgaagcaccagaatctacttggttgcaggtgaagcttttggcaatggaagcatgcaggcgctgatggatgattttcccaatatatattctcattctacccttgcaacaaaagaggaacttgagccctttagaaatcaccaaaatatgcttgctggtcttgactacattgtagctctccagagtgatgtctttctttacacgtatgatggtaatatggccaaagctgtacaaggtcataggcgtttcgagaacttcaggaagacgatcaacccggataggttacatcctttcctccttggaaatgctctgtggttatatttgttgcacacaagacgacgttgaatgccaaatagctgtctttgacatgtgtttccttttttttgtaatgtcttattctttgtattgcaggatgagtttcgtgaacctgatagatgaatatgatgaaggaaggatgtcttgggatgacttcagctcagaagtgaaacgtatacatagagatggagagcgaataggggctccatatctcagggagcctggggaattccccaagctagaagagtctttctttgcaaatccgttgccgggctgtatatgtgagaagcttaatgacgagtgaatatgtatatatttgacgattctttaaccatctacgccacaggtcaggagttcaggatatatagtgcccctctgctccttgacagtgggtcagcagcaatatgcacaattatttagtcatgatcacttgaccagtgaattcgtgctgatgagagttcagagacgagacaccaattttcaggttcatcccacaaaagtttgctgcatgaagatcatcagatattgcaaatacgaaaaccatgtgagaagtctggcagctgctaatcaattttccagcagccagagcatgccatctgagaaggctggaacatcagagcaactgcaatcagtatacggaaggtaaataccgcggaggagattacacttacggctttgtattgccaatttgccatatcataggttttttggtgcacatggtgcttcccaatcttgctgttgctaagctgtattttgtgtagactcaatacaactgaattttgtcacttgtattttatctggatatattgaattaaacgaaagagattttgtctgaggctcagagtcagtctggagcccctgctgttcctgtcccagcattttttcctttaaaggcataacttattccattgatttactgcactgttttgcgtgacatcttttgtttttatgagtagcgccatgcgtctctttgctttgacactaaatcatctgcctatccaatggcattctctgcatttttcaatccacagattgtttctaataaaaatggggaaacaatgcacataatctgagaacttccacactgctgccaaagtacctttttataatgagtcccactccggtgctttctactaggagtagaaaataatttgaaccgttaattgtatatgattgaacggctcagatatatttctactcccaccacatttaatggtagtagaattgtggagggatatttttgtcccagaaaaattatttgtggagaggtatttgtccttttcactttctaaacctagctacactcactcgtctctcgttctgatccggcacgcatttgcaattgggtaagcaaaagctccgccgtctctggcccaagtccggcgacgactacctcctcggctcctcttctggtattctcacgtacacccgtcgccgccatgcacacaccctctctcgagctgctcgtctactactacgtgtacacgtataagtgtactgatgcacgtataatatacgcggtgacatgatggaggagttccacaaggagatgcggcggctagccgacgagctgctggagttgttcctcagggtgggcgctaggtctcaccggcgttgaggcggagaggaggatcgccaagacgatgacggcgacgatgcactggtaccagaggtgcccggacctgcggcaagctctgggactcatcgcacacaccgactccggcttatgctccagagcattgtgtcagggctgtagctattccggcgaggactagaccggtgggtggcggtgccggcgatcgttccgggcaacttcgtcctcaacgtcggcgacctctcttccacatgcatactcaccaacggccgcttccacagcgtataccaccgcgccgtcgtcaaccgcgaccgtgacaggatatcgctcggatacttcctcggcccgcccgccggacgtcaaggtggcgccgttgacggacgccgtgtcgcccggccggagcgccgcctaccgcgccgtcacgtggccggggtacaaggccgtccgcaagaaggccttcaccaccggcggctccgccctcaagatgatctccaccgccgccgccaccgacgatcgaacacaacgacgtaaccgacgttgtcgtgatgtcaaatttacccctaatctgtcttagtactttactattgtacccttaagaataaacggttcagattagttctacttgtagtataatactttcagtataaagcaccggagcgttgcccttttataatataagtagtagaatttcgcactacactgtatcttcgaatgacctaaaattactataagcatgcaggtttctgagatatttgtaacagaagaaacaatatatatcccttcgaggcgacatttcctgctaacccaaaagactgcttcagacaaacgatggcactgtctggttcaagtgatccgactttatatttcttcagcatttcataaaatgtgccggctaacctaataaccgtctgctttgcctgcataataaggaaaatagtcaatatactgtttatgcagctcgccacaacagatataaaaccagaggtaacaaatatgtgaccaaaagcacatttctgcaaactgaacaacattcagcagaagttagtcactacttaaaaattgtagcagaagcatgcatagtccgaaggagcgaggaaaatatcatatgatcctgttgaagtgtgttaacattggattccaacaactactttctgattctagtgaagaataatctaagatttcctatgtcgagtcacatgaaaaattgacttggacctcagtgcctattactttcattgtcaaactacaagaggaatcaagttgtatacaccaatttgacattatggctatgtttagatccagggtgtaaagttttagtgtgtcacatcaaatatacggacacacatttaaagtatccgtctaataagcctaattaatccgtctaataagtctaataacaaaacaaattacagaattcgtctgtaaaccgcaagacgaatttattaagcctaattaatccgtcattagcaaatgtttactgtagcaccacattgtcaaatcatggcacaattaggtttaaaaagatttgtctcgcaatttacacgcaatttgtgtaactacttatttttttcgtctatatttaatactccatgtatatgtccaaatgttcgatgtgataggatgtaaaattttgccaggggatctaaacaggcctatacttatgaaaatagttctcttttaaatacccatgttcaggctctgtattctcaccatgccaccatgctcatcacaattatcaggctctgggtaatcccacgaaaactaaccgatcaacacacacagagaagtttgacattatattcaatcaaatggggacactcgtgccgattcgttaaaaaaaagtagtttgaggttttggacaattattaagttctgcctcactatgctgcatagatatctgaaactacattatggaaagtaaaaattcaaatttcaattgaccattttgtaaaaaggaagtagtttgcaatgcaggctatcactgtctgactatgtagtatgagtatgaaacgctggataccagggagggacctggtatcgattatattaagagggcagcataactctcagtctggagccatactattgtgcaaactcaaaagtaaaatataacacaaaatgcaacagcaacttttaaaaccccacaaaaggatgtaatagaatatcatttcaaatcaaatgtataagatggaaatttcctaaataatattaactacatttacctttaaacaggatctgagcttggggtgaagctcttttgtattttagtaactcactgagcgcatcctcattagacattaggcatttatcaccatgagtaacagatattgtgcgaagaagacttgctttagagagaatcagctctataaaagacatttcatttggaagccaactaattctcgttatctgtacaatttgaaggttggcgcacatgccaccagtccactctgcattttggaacaccccatttgcctcaactttctgctcgttatcagtgatcttcacaaacagaaataaaaaattgtaaggagagagagataaccttcaaacagtgcacatatattcaacttgcgaggcaacattcaaccttaccattattttgagtttttcgagattcggagcattccttagtaagcaaaaaatcgttaaaatcgcgggcagttcacagaagtccatgtataacttcaagctcttcaagctcttcaagctgtcaaaggtgcatggaagtgtctctagtatcttagctccatttgactgaaagatatgaagaaaacaggtactccatcagaacttaaaagttgaaactggatggatagaaataatcaaaggacatattatgttttttttcccttctgtccaaacaagaccaaaaacacatatccctttattgaaggaaatgttccacattgttaatttgtcaaggagaacacaggcccacagcccacatatccaactaggggataaaccttttttctagagcgaaagtaaggagtctaatgtagcaaatcagaaaggtaaaaggccatcggactaccaagttggaagacaaatgagttactgaaagcatacggatgccaatatatattcaccataagaatatgtgcacaatcacataatcccttgtatgacagtaatatctacaattctttgtatgacagtaatatctacaattctttgtatgacagtaatatttacagattaggagacagcacagaaagtttgctacgtttatgtcacccagcaaacatgatcctaatatcctatccacaagaggttatgcaaccaacaacagtcatgatcatataattgttgtcgataaatcatataatttcacatattcaactctgcagtttaatcagcgagcaagtattttgattcaacctaaacatcaaccattttaaagtaaaatgatcacctattttttttagaggaaactaattatcaactggcaagagaaaaacaagaaacatttggaggcatcagaatgtaccggttgataggacacaaagaggtgaagcttcctaacatgaagaagcttgccgagaaactcggcgaaatcacggccaccaagataatcccacaaatcgatgacggcagaacgcaggcgtggcaaatccaaaaggttccatccataatcgttcggcgaacaaatcgttagatgctggagattgggcgctcgaatcacccaatttatgatatcgtctccatcgatgaagattccagataacactagcatctcaagcaatggggaattctcgatgatctcctccagttggtactccccgcccgctcgcagccacacgtggtcgagggttaggctcctcaggttggggaatccggcgaaacccggcgggagcggcgggatgtcgcaggcgaagaggttgaggtaggcgaggcggtcgcaggagaagacggaggagtggacggcgaggtggttgtggatcggcgacgcgaggtcgagggactcgacgccgcggcgcgcgaggacgaggatccagtcatgggcgcggcgggtggtgagcttgtcgacgtatgcgctgaagctccggacgcggccggggcaggcagcggaggaggacgccgtcgacggcggccagcgccgcgccctcctggtgcgggaaggggaaagagatgtcgagggacgggagggactcccaccgccggcgccaggcgcgggagagcgcggaggtgcggacggcgtcgcggaggccgagccgggtcaggacgccgtcgaggacgtccggcggcagggagatcagcgcgtccttcgcctcctcctcctcctcccccccgggaacagcagcctccgccgtccgacacttcttgtgacggtgcggcggcggcggcggctccattcctccggcggtttcgaggcagtgcactctttccgccgacgcggtggaacaaaatggcgcgcagctgggtggggaaggaaaaaaaagcgcgggaaaagagcactcgcgtcgcgccggcgagatcatgtgaacaagcgcaactacgggccacaccacaagcacataagttttccggcccaaaatatcccgctttccaaaatctccatgtcaaatattctagttgaaatttatcagaatttctagtttttagtttgattttcgtgtttcctactaattaaagtgggatattgattattgaaggggtttctgttcaattttctcttgacagctgaggcatcaatatccatgtccagaacgtattcggcaattgattattcgcgcatcaatatccatgtccagaacgtattcggcaattgattattcgcaataggacactgtttaattaggtcccttttaaaattattaaatcactagaaaaaataccagtgtgttacaacgggtatatgctatttaaattttattgttgttatatggtttagctaggataaaatttactgtgtgaattcgcttagatatttttttcgaaaatcataagctgcaagagtccgtatttcatctcaagttagcatgcgggtttttttaatgatatttcttatatgtctccttttatatttccaaaaacaaatgagcttaaaatacaatttaaaaacggatctgtatttctaaaagcgaacgaacttaaaaacctacttaaacatggataacctaccaaaatactagtagaaacatctttaattatctttaatttttataatagtagatatagagaaatctcgcgatcgcggtaacataattgtcgaggctgtgaggaccaaagggaggagccgaggaggggttttgtcgagctttgcttgaaggccgccaatggcgagcagaaggggcatccccgagctcccatgggagcttcaagacgccatactcgcgcggctgccgctccgcgacgccgcccgctccagcgtcctttccagcagctggggccggtcctggcgccacctcggcgagctcgacttcgtctcgtcgccgccgccggcggcggcgtcgttgccggtggcggcggcgacggcggtggcgtgcgacaaggcggcgatcgacgccatcctgctgcaccagcacccgggccccgtgcagcgcgtccgcctgagggtcaccgacgagctcctccccggcgtgcccgcctggatggcgtccctctccgagaaggggatccagtcgctggacctcaccgtgcgcgccatgtaccggccgccgccgcaccccatgcaccgctccatcttcgcctgccgcgcgctcaggcgcctctccctcggccgcttcgccctgccggccgcgccggagcacttcgccgggttcccggccctcgcgacgctctccctcaccggcaccgcgttccgcaatgcccgcgacctggaggcgctcgtcgctatgtccccgaggctggaggagctcaggatgtgctgcatcgccgtggacgtggactgccgtgaacatggcggcgacgggcgccgcaaggtgaggatggtgtcgtccagcctccggttccttcggatcgacgggatggggaacgtcgagttcgtgggcgcgcgcttgccgcgcgtgtcgcaggcagacttcgcgcaggcctcctatccaagcgccccaaaccttctgtccgccatggttacctcgcttgagacgctcgactattactattatgccttgccgttatcgccggtatgtatgtacttttgttcgaacactatctaaatcatcgttaaaagaatctcagaaaaaaaattgatagcattcataccatttaaataataaaacacattgaggaattaaacaaaagacaaactcagacgtgaatagaatttgtctttttcgtttatcaatgtgcagatcgaatttggacatgatttttttggagttatagatcttgctatactctatattaacaattttttaaatacttttttttacaaccatttgcattgattttgagagaaaaaattacacgaggaacacatctcctcgagggatcagaaatcctccccattttgtttcacttcaaatttcgcccgtatctacttcctccatttgaaaacagaagggtattcctttgtttcttacatttacaaattttgactaacaattaaactaaaaatatagtatatgtttactgtcatgcatataattatcatatttgacaatattttcgtactatatcaattttatacttacaaatataatattttcattagtttacatttcagtgccttgtcggttgcccatattatggcttattaggaaataaatgttaatttataggtaaaaattttatatatttgttcgtagcgacttattagccaatgctaacaagaaattatgttgaaaatattttaaaatcaaatttcagcttattaggctaaccgatggggctctaagaacttatggatatagtatactttgttgacattactcaatgtcatgtttcagactaaattattgaagggactaccatcttcctacaaaaatttgaagagattgaaagttcatctagacttcaaccatgctccaccgattctgtctacgcttaacttcctaaggaccgctccaaacctgactcaacttgtgattcaggtaatttccatattcctcttctttaatgtagttttggaaacttcctacttaatttatatataattcctccgattacataattcttaatgttttgaacaacaccatggtcttaaaagatatacatatctattatgaatgtataaaaagttaatatctagtttatttaaaatactttttagaacttgtatatacattgtgttctagtggttcaaacttgatattttagaagttattaatttaatcttatccgtgacgttaaaaatttgaaattatgaaaccggagagaaaatcatgtatatttttgtattcatgctttcgattattgtcagggatatgtcctgcctttttctgaataacatttttcatctttgtaggactttactgatgactcatatgcacaatctccataccctttggcagcggagctatatggaaatttatgccccagccttctttttctccaaatgtcttatgtcacttcgcagaacaacgaaatggatttcattcgtctgatcttatcgaaagcgagaatgcttcaggtaatggaggttaaaatgcgaagaaacagcagaggcatagaaatcaaggaagaaatatgtggatatgataaagtatctccgcgcgctcagatccgttttaaaaattagtaaccattcaccactctgcagatatggagtatcatgtccatgtaatttttaggatcctcgttgagtagttgtcatcaatagcatctctaatagtcctccgccgtccggcgcttcttgtgacggtgcggcggcggcgccattcctccggtccggtgagagggagagagcgcgcgccgcagagagcgcctcgagggtttggagggagctctgtacaggcggtttcgcggtagtgcactctttccgccgatgttgtggaagcgtgcagcttgggtgataactggttggggagggtgcagtcactacatatgctattatgttgggaaatttggtgcaagagaaacaggcgggtttttaaagatatagagctccaaatcccgcagttagtgacaaaaattctagacaaaattcatgtatggtcagcgtgtggtgcaaaaaaacttgcgagaatagcgtcttagtttcctccatggaggtgtaatttttttcttttgtgttgtttcttctcctgtcaccgttggtgacctctgtaaagtgcttttcttctaaatataaaaccagctcggctggcttaggtttcaaaaaataactggtagggggaaggaaaaaagcgcgggaaagtgcactcgcgtggcgtcacgcgggcacaatcatctctctcttctcttctcgatgagggttaacaagcgaaagtacgggccacaaacgcataagttttctggcccaaattatccccctttccaaagttatagatggccataaggcccgcccggtacagcccggcctaagcatgggttaggcacggcccgaggcagtcgggccgtgctgtttggagggatgtatgaaatgatagtagatgtatgaaatgccggcccgaaagtatgggcggcccatcatatcttctttgaaataagtttattttccctcctccctctttgggctgtgacatatatatagctaaaataagtctattttatgtccctactctttgggccgcgtcatataatacgtctattttgtagacaagcagacaattaataagaggtatgtatgaaataatagtggattaatactctacctgtgcatataggtgttatatttacacttctttttacttgtcacaatatttacaaattcatggtgcggtgtttatattaggatggatatgtacacacactaaattgttacatgagatagcttttcatttgcttgaggggccatcccatcgtttgttgcataccatctaaatagtcaataaattttttaaaacaattaataaaatatatattaatataagacgtatatcgcttcacaagcattgacatataaggtcaaatttgactagtacaagttgtgataaaaagaagcaaatctggacccgaagcaggcttatttgaacaccaacctatccacctacatgtactacacagaatagtcttcttgcatgatctcatacatgggataatctccatctccatcgtcttcattggaatcaactatcgttccttgccgatgaaaaattggagtcctcggcgccctaggcagcgtatccaatggctggcagccgttattctcctgaagcttgttgacaactccggcatgattcagcaaagcccagacgatggtcaaaagctcgccgccggtcgccagcttggaggcgtgcacagacgctcgatcagacggcgcgatgtacagcaacaggtttgcccagaaatgggcgagcaccttccacctctcctccgcatccttctttcggtccacaagattgagcgcgagcaccgctccctcgtacagcagagggcatcctgcttcttgctccttccaaccatcgcgacccagcttcatcaacttgtcatacttgtcactggttgtcctgcattctgcgaggtatgcgtgtgcatcctttagcacacggcaagacagtagctggcttgtgtaagtcccatctggtatgagatccggtgcgaaagctacgaggtaggagcagtatcccgagagcactgtggctacttcgtagtgatacctcaactctgcatcagcctgcgccatgtcaaacttggactccccatagcagcagatgcttgtggctatgtgccataccaaaatgtagggggcgtatgttttatggctaaagaggtcgtaatccaggtctcggtccaaaatgccattctggtgtagccaccttcttccatcggtaattttgccattggtaggtttcagggcgtccttgagggcgcacaggacggcttgcttcacttgcggtggcaagacaatggatgacgccataatccacgggtcaagcaactgaagtgtcagagttgatagcaagagttgcacacggtatagataaccagcattatcaagcagggagtactgattaatggcattcttccagtatctggagacgttgaaatggcacagcaccttcaacggagtgtcgacccttgcacggtgccatgacacttttagcacgtactgacacatcaatttaaccttgtgccaatcggacaacaccaacgaaagaagctggtatgactctaaaaagatgtagagggcaacgaccagacgagtaacaaaaagatcaaggttgaagctatggatgatgatgtttactttggctgtagtactgggtcggtagtgaagaagaacggaagagaagagggtgaaaaggctggtaaccatggtgagcaaataaaggatcaaatcgaaaacgagattatctttcaaggaaggataccgagcatagaagaaatcaaacaggaagcccagctcagcctcaaccacccgaaaggctctgtcaagatcgcgatcatccgagaggagcctatcgacgacgagagttcttgataggtcgttattagaatggaagttgagatcaccaacatggtctgccccgaacctcaggcgcatcagcctgaagagcgcaaaagagaggcacaagtctcgccgcctcgccgcgccgcggctccctgcagatgagctgcagctcagcagctcgcccttgcactcccacaccttatcaacgctcaccgtgtcaggcgcatcgtaccgcaagtgtatcgccatcgacgacgactcctcttccttcccatcgacgaggtagatgtactccttcatactggacgggtcgggatcgtacttaccgacgatggagccatctaacagcttgtgtttcatgtactcgaacacgatctggttctccctgatcagcccgttatctcggctcgtcgtgcggtacgcgttgatcctcagaaccaaccgcgcgacgctcaagctccagaggatgaacagggggaccttgaggttcatcctaagctgggccttgtagtacaggatgagaaagagcaggtagatgatgtggagtgcttggttcatcatcgacctggcgtgttgctgggtgtcgttgaagctgaaggccgtcatcgcgtcggcgctgccgaggaggaggaggaggaagcaggcccagacaacgaagagctcgttgcggacggacgatgactgcatgaggccgatggtgtaggagatcaccgggtagttgaacatgaaggccgcccacacgaggaagcccaggaagccgttgctctgatggcgccgacgggagttggagaagacgaggatgacgacgaggaggcagctcagtgtgaccagcccctcgatccgggcaagctgcccaacagagctcgcggcgaattgcttcgcaacctgggtgacattccccagggcaacaaatccatccattctaattttaattcctgtctctctcttactcgctcggtgtgttctttcttctatacgagttcttctatcaaccactccgccttatatattatactccctccgtattttaatgtatgacgccgttaactttataaccaacgtttgaccactcgtcttatttaaaaattttatgtaaatataaaaatatttatgtcatgcttaaagaacatttaatgataaatcaagtcacaataaaataaattataattacatacattttttgaataagacgaaagatcaaatgtttgtcaaaaagttaacggcgtcatatattaatatggagagagtagcttctattgtgaatggatcaaaccacaataaattcatacgactctgctcttcgcgtctttgtgagtgctattatttgaaggaccgactctgctacaggtcatttcttttccctcttatttgtgaagaccaggaaaggtctttcttatctgttgctcaaaatgtcctaaacaaacacaagcgtgattgaactgctaaccatttcttttgaagaacgtactgttatttttagttgctgctgtaagcctgcaattaattatccatgcgaaaaattctgaccgagcaaccgtgcaggtcttgttagtttgaggattttttttttctataccaattgaagtttgcactcagccgggatctatttgacactaggaattcatggtattgccaggtcaattcatggtattgccaggtcacagctactgcccactccttgtagaccaaattactacatgtcaacgcataagatacaatgtacttacggatgttatgagcttcacgggaacaagttaaacagggtgatgctctaaaattttcatgtagactagccacttagttgtgcggtacgcaactttgtacccgtttataacccctatatatatatatggaccgtaatatttaataaaatttaattacttttttattaaaaaaaatatgactctttaaaacaatggtatgttcctatgttgcatattttatgttctgaatttgtgattttttttcgatgttttaatccttggaacttaatgtttcatacattggacgttgtgttgcagtcaatatatatcgagtgttgagtcactttgaaacatttcatcaagggagctaaaataatataggatctgtaatgccccgcttttcgcaagacgataaatataagttaataaaatcctatttgcgaaaatttagttcttgagtgtaagtctaagtcgtgccatggatctcaattcaaatatatccttttcccctctcatcgacataaaaaatcgccacctcgaaattccagctccaaattgaatatacaaaaatcaaattccggaattcaatctctcccggtgaaatcatcgccaaatacttgtcctgattccaaaaaaattaccaaatttccaccttgaatccctccctaggctccaccttgaacccttgagtacagatgcccaatttgatttcaaatccaaactccaattcctctccaattcaatttctctatagaagtctaaatcgccttcctccttattgggctgtttttcttcccgggcacatctctctcgctccctttccctcttgggccgcaaccgtttcctggcccatcaccccagccgctctcgctctctctctctctctctctctctctctctctctctctctctctctctcgcttcttgccgcgccatcgccaccgtctttgccttcaaaattccgccaccgccttcgtttccttcacgccgcgcgtcgtggccgctcggaaggacgccgccgtcaccctcgcgtcactccgcctgtcgcggcgaccgccttgcctccgctcgccgccaaactttgcaccgcctttttggcgacattgccatcgtcatccatggtccccgccgcttgtagccaaaacccggatgccggtcgtgcgaccgcaccacctcggcatccacccccacggctccttctcctccaagccccggttcaatccaccctttaaagcctcgccatctcccatccttctctccttggttccaccccacccgagccgtgcttgccattcgtcctcgctcggccagtgtgcgtctcatcgtcctcgcccaccgcgcgtcacgctgggagtgccgttgtgatcatggtgcaacggcggacgcttcttccccttctctagccttgctccttgccaaggccggaaccgattgcttccgcaccgatggtcgaccgcctcaacgccttttcatctcggtagccctccgtatttttcgcggcccaaccacctcctttaggctgctagctagctggccgccgctccgtgttacgcgaagctcaccgccgctcgccacctctgtgccgatgctagatcgccgccgtgggtctccttggagccgcgtcgtgcccccgtgaagcttgaaatgagttcgtgaatccttgaagtagcacgagctccgaagaatcgagccctcgccgctccggcgaggttgccgttttcggtagccatctggcgaatccgagccgtaggctcatttttcctcgccccgctcgtcattcaggtgcgcttccctcgtagcgccgtgcgccgctccggtaaacgtcgccgccgcccgccgtcggatccacggcagggtcgtcttcctccttgcaccgtcccgcgtggctgccacgtcctcggctctcccctctcccgtgcgcacggtccgcggttagccgtgtggctgcacatgggaccgccgcattccgtccacaccggtgcaccaatcgccctccccgtccaccccaagccctagcgccgccgcacgtgcacctggttctcgtgaaccttgtagctagtaggtgggtcccacccaggatcccgcgcggtccaccggcctgcctcgcgcgcaccttgcctacgtgggccgtgcctcgcccttcggctcgcgcgtgcacgttcgcgcccgcactttgctctgggccacgcctcgtgctcgaccaagaagtttaatttcggtccctcgttcccatttcctttccagggaattctttaattccttttcctattagacataaaaacaaataattcttaggaaattcatatcacttgatctgcagctttgtttgacctcattcaagttccagtatcctctaaaatttagatatatctaatggcactattagttagtctaaatatagatatatatatctaatggcactattagttagtctaaggcttcgttcgcaagtgccggatcggagcttgacttttgggttgggaacatgtagtactgtagaccactgtagcagtgtcagggcgtcagggacggagggaaagcggcagcctggacgccgtctatggccgacactttccgtcgccgtgccgtgcgatgccgggcaggggctggcagtggaggtactgtagcatgcgaattaatgggtgtttttttgcaagacacgggtgaaagaggtatttgctacgcggcaccaattgtgaaagaaatatttgatatgcacacacatgtgatttctttaataataattttcataatatgtgaagattcggacataaattttgcaataacaatgattaattttttgtctgaaataataacgcaagaattaagaaaaaaatgaattgtgaaacaaataacgcaagaatcggtgcatcaaatttgttgttaacgttataaaaataaatggtaaaccatacaatcctgaaaattgaagtactgaacatacgacaagcattatggataacatcacctacctaatggtagttattgtacgcatcatcagcaatacagtcacgcaacatgctcatagcggcctcgctatttgttgcgtaatacatatggtcgaatgaatcgttcagcagcggcactggattgccgttgtagagagcattagtgaaccgataggtcggatctttactatccaacctaaagttctgtagagcgaaagctgcatgaatgatgcgtgcagggatgtcctcatctcggtaataagggatttctttcaatattttccacatcttttttgcgatgccaaattgtctttccacgatccctcgcaacgtggagtgtcgatggttgaaagtctcttcccgtcctacgggtggcggggctccctcgaccgcaagttgatccctgtggtaccgtacatgtgggtacggtgcaaggaagcccatcctggtaggaaatccggagtcgacaagtaggtacctgcctggttaacggcgcataattaaatattagtgcacatgtgtaaaattaaataaaatcaagacatttggcaataaaaaaagtgtattgaccgatacaactcacctaacggtacccgtgggaaatcgtaggggtaagcctgcactgcctcattgagaatcctttggtcgtgaactgatccaggccagccagcatcacagaaaataattctcccatcatgatcacatattactagaacatttctggttgttatgtggtgacggttcctgtgttgcatagcgctagctgcattaggcagaactggaatatgtgtgccatcgacagctcccactgattggtagaaaggcttgaaaggattctcttgcagaatctgagggttgtaatctaagaagttgggatcaaccggtttcaatattttcccagcgagatcattcatagcctgcaaaacatggtggaagtgaaccgacactgtcgagttggagcggacccaccgattgttcgcgtctctgattggacgatttccacccatcgtgtacaagaaaataccaagcttttccatggaacagacccctgctgttcctacaagaccaaaagaagtgaccaatagatcatgcaaattgtgtatctcctctgcagtaagcctgaacattgccctgcattggcttcgatttgccatcgtgtccatcatccaactgacaccggtttgcaccggtattctccttggtgccctctcattgaaatcaagggtagcagccatgtactcaatgatggcatcttcttcttcgctgcttgtgtgaccgcctccattccaactcgatccacccgcgccgtaactcatcgccgatttcctttaacatatgagaaccgaagaataggcaatgtttgtcataatcaaaaggatagaaattaataatggcagtgatctatgcaatcgaagaattatttggatataaaagcaatgcaatggaatacgtagttgctcgaattggatataaagccgcaaatgtttagggactcacagaatgtaaaaattgttagcacactgagttctaaacataaataatggtttatttggaaaacatcgcacatcacaactcaaagtaaagtacagtgcacaaactactaggtgccaccagatgactgtccagtaccaccagtgcgtataaattccaagcgcctagcagcgtccttgagtcgaacaaagcatttgcaggtcaatgggtcacggaatagcgcacaagcagcataccacacacttcctccaatttcatggccatcattttccaccaactccatgcacgcatcaaggcccatagacttctctgcttccatctgagcaacacgactctggtagctctgctgtcggatgtccgcaatcctcnnnnnnnnnnnnnnnnnnnnnnnnnnncgggacttcttggaagaactccctgaggcagtagtgtttgctgctagcctctttcccttgccccggtctgctgccgttgggggtggagttggaggtggtggtctataagcagcagcgagctgcgccatgtcgatggtctgccactgaactgctccttgcggtgcctgtggggctgcccctgcgacggcggagtggtttccgacaactgtgcgcccactgaataccgcgtggtgaaggtcaatgtgcttcagaggatcattcctgaagcttaagacacctttattttgctgcaacataagtagacagtaaaaataagttagtacaaggcaagtgcattaggcttgtgcaaacattgaacataatgaatatgtgcagtccaatgtgcattactactaaaatgctggcagtaaatgtgcacattggtaccaagttatcaaatataatcaggagtacatgttacaatgggccacacatctgacagaatgaaagaaagatagtttgaacattgtaaacataagataaactgcatatgttatattctttgtagatgagcacatttttgttcattctctctatatacatcacaaagaaggtgtgtacagctagttgaatatgtattaacatgttcctaaatgacttgtacaagatctttcctaatttactgatacactacatatagattttgtttatgcagagaacaaaacctataagcattaccatgttacattgactgctacattgcataagctaataaaatgctacattgtgtaagctatatccttcacaattaaacacatgtgaatctgttaaaatgcttttgaatgtcacatgtacaagatcatttacttctcgcaatcattgccaatcagttcatggtagacagtgtaaacatcattttgttaacttaaatacaagggaatggcacacattactaaaaacgacatgacagtaacaactatgaaacatatgtgagcacaatccttccattttactgcagctagtcatttgttggcacacacaatttgaacaaaaaaattattacacctcacaaaactgtatttataattgcatgcatgtactaaatttcagataataccaattgtaggcaaaattgttggttcaaaatatttatggtcaagtgtacgtaccgcattcttgctttcccaccactcatcatcggcaacaatggctgatgtatggggatcacgacccagcccgcttgcatgcgattctagccacacccacctgttgtaccgcttcttacactgcccccaaatgtactccaattgagccttgttcaccttcttcttgcacttggtgtacatcttgtgtattaggttctgccatgcctgcggcttgggggagttggaggtgatggtgaacgctgccatctcctccaagcagctctcaagaaacacacgaacctccatatcggtccaccggctacggccatcgcccatctactccgtgcaagtcaaatactccctccgtttcgaaatgtttgacaccgttgactttttagcacatgtttgaccgttcgtcttattcaaaaacttttat

SEQ ID NO: 78652 - DNA, 1536 bp, Oryza sativa
gatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccaggttcgctggatccgggcgctctactccaacttcaccgagttcaccgcggaccaggagcggctcatctccctgcagcacggcggccggcggttcgactacgtggagggcttcgtcgtcgccgccgagggcctaatcaacaactggaggtcgtccttcttctcgccgcagaacccggtcaagctcagctcgctcaagcaccactccggggttctctactgcctggaggtcaccaagaattacgacgactccaccgccgtaaccgtcgaccaggtgcgtgtccgtcgtgccggcgcgatcgcgcggccggcgccgtctttcctgattcaccaataattctctgcctccccccctgaccgcccatttgtttatgacgaaatttcttaattattcctactggagtagtttagtactctaatggcagggcacctagtcaatcattgggccatgtttttagttagttatgggcggtttagtcaagctctctagtgtaatccaagcccttgatgattgtatgattgcacccacatgctgagcacagtggatcggtggatcttgcaaacgtactagtagctgtctagatcttagtcccactgacaaaacatgcactattttatcgaccacttaattaatcaattattacgcagtactagctattaccactagtatagtactatacgcaagtgatgaaaaagaaagacgaagtagatcat

SEQ ID NO: 78653 - DNA, 2904 bp, Oryza sativa
tgcctgaaggttgtcgctgcactctgcaacggccaccgcacccgtcgccgctgctaccacaactgcaacccgctgctgccgccgccgaggtcatcgctgcactccgtcgcggttgccgaaccccgccgcaaccgcaacccaccaccactgtcaaggtcgtcgtccccatccagattcggcgagaacaaggctagatccgagccgacagcggtggcggcagctcgatctcaccggtagagaggggggagagctcaagatcgagcaccgtcacatggatctcgacaccgctgatctcgtcgccttgtgcagggagggagcccactacggccctcccgcggcctagcagcggtcatgtcgtcgtcgcggcggcggatccgaccttccccgtcatggtggcggtggctctagcctccctcgtcgacgtggcggtggatctggccacccccgtcatcacgactgccggattcggcctcgagctcatagcggagaggcggtggcggctatggcagccggcggtggtggaggagtgagagggagaaggagagaccgcgagggagaagggagaggcgaataaactgaggtgggggcggtaggtgggctaggtgcagtgggtttatatattcgcctcaatttttttttcagcggtcctctttacctaccgccagcgaaaatgcgattttctagcggacacttaagaagtccgcctcaaaaaatagagttgtttttttatggtggacctcttagcattcccaccaacgaaaatcggttttcgctagcggtccgtaacccccaccccttgttatatttttgctggcggtttttgcgtatggccgctagcgaaaattatagggtaacaccatgaaaaattgtttttctagtagtgtatgctgtgcgttcggctcttgcagctgggaactaatccctgaggcatgtaaaacggagcaactcattagcgcctgattaattaactattattttttagagtaaatttcagaaaactacaacaatagcgacatgtttcagtttgctacaacattagcgacatgtttcagtttgctacaataataacgtggattatcacaaaactgtaacttttacgttatatgctgctacagtacatataggtgacaactgtagcagcatataacataaaagttgcagttttgtgataatttaccatgatattgttgtagcaaactgaaacatgttgctaatgttgcagcaaactgataattttgtcactttagttatagttttctgaaatttaatctatttttttaagaaaagatagattaatatgcttttttaaacattttttatagatttttttaaataccatttagtagtttcgaaagtgtgcgcgtgaaaaacgagagaggtgagattagaaaagtatagagaagaacacaaccaaatacagagaatggaaaagcttaacacatgctcatcattcacatagtataaaaattgaccaactcctatgttacacatactattattatgtgtaaattgtacttttgcctatcttttattatcaaaatacgtttcaatttagaccgctcttaatccaatattttactttgaaccagctatcttttcatttgttgcactttgtaccacctccaccgtgttatctagacatgtttgtgttctcctctagcgaaggtattgcatgctgcagatgggtgggggagttcgccagtgtgtcagagccgatatgccacttgaggtcattagggtgttagagaaatcgtatggggtgatctaaaactctaaatcataagaaagataaagttagctagttcaaattaaaaatattggattaagatgggtccaaagtgaaaccatatcaataaaaaggtggcccggagttcaattcaatctattgttattgacctaatgacctccctatgcacctagctgcatactccctccgtactcgtaaaggaaatcgtttagcacagcgacacggtctccaaaacataattttaacttcttgtttctataaaaatatttattgaaaagtgatatatgtatatttttatgaaagtatttttcaagacaaatctattcatataatttttacattttcaaactcaataaattaagagttattcatgatttatatttccaaggtttgacttcaaaattgttctaaacgactttctttacgagtgcggaggaagtactcctatatggtttcaaatattttcactggctactatttatattttagctttgactgttatccttttttgaaaagaatattgatgtgtacttaaaaagtagggtgccatattagcaatgtgtgttgtcccgtaaatacaaccatacaacttttattaataataaattaacatattacaaactgttaatggtcatgttaaaaattgatggtcagacaatggttacaagtaaataagaagattggactgacttgggtgcacacaatttcatttggtaaatggtgatgaatgccgaagctatatatagtcttctttgatgaaaaatgctcactccgtttcaaaaaatgtataaagttattgactttcgcataacgtttgaccatttattttattaaaaatttagtataaatacgtaaaagtataagtttaaggttatattttatttgatgataaaataagtcataatgaaataaatgatatttatataaattatttagtaagatgaatggctaaacattgtgtgaaaagctaacaacatcatacattttaggcaaaatttgctacaggacacccaaaaattgtgtaattagctgtgagacaccggaaaatcatgacactgctcatgaacactacgaaagttgtgaaattggctgtaggacaccagagccaatattttttaatttccgagacaaaagaggtcagagaaattactaaaaga

SEQ ID NO: 78654 - DNA, 1701 bp, Oryza sativa
cccattagcaaacggtgcactgcaattgtagtacacattgatcatagctgcaatagccaagagatttatactagaaaaaggtgttctgcttctgctaatggttggagactaatcagaaactacaagctcagcactacaatactatccaaacttccaaactcagcaaaaagaaacaaagacaatggagacgaagcacacgtcggggatcacaaacaagcttacccgttgagcaaccaaacttgagaggagtagttcgatgggtcttgctccgggaagcagagctccacctggagtgcaggttttcccgtccatttcccgcagtctctgcaggggtaaagcgccggtgcgccgccgccctgcccgggaatccgatgatcgaagaagtagacgccgccctcgaagccggggtactgatccgtgttgtacgatctggagcagccgcgcccgacgaacagcatcctgccctccagcgagggcagctccctccagatgtatcgaaccacgtcgccgtcggatctggagcagggatccccgacgaacagcatcgtccggccatccagtaagggcgcgtcgccgtcgccgtcgtcgtcttcctcgggctgtgccatccggaacaccttgaacgccgacgtggactctccgggacgaggagagcacctcacgaccatgagcagctctccgctggactccacgaggtagcgcgccacgacgtgctgcccgtcgtagccgcgcccctgcgacgagaagcagcgatactcccattgcacttgaggcggcgcgttcgcttcgtcatcgaagcccggattgcccacgacgatgtgctgcccgttggtgaggaaatggaaggctccattgtggcgcacgacgtccaccgcatcccagcacgcgtcctccatgaagaagcagccgatgaccaccttatcgtcaattcgccagaacgcaatcttctgccggtggtggcccggtacgggagcacaattgttgacgaatccggcgaccacgcatccatccataaatgggtccgacgagagggtggcggcgttgatgaacagcgggtcgcgcgggcgcagccgcttctgcctaggccgcaatacaggctcttcgcggtccaactggatccagacggggagaacgaaggtattcggggtttggtggagattggtgaggaaataatctcgataaccctgagctcgaggatgagcagtggagacgaaggcccagccgccgtcgtacgagccgaagtagcaagcgtggcgaatccactccgggacgaagaaggggtgggtggcgcagtcgctcaggacgcaggagaaggccagctgctcggcgagcggcaggatgagatacggcagcttggggggcgggagcaggggcgggagccgctcgaggtgctcgcgccatggtcggcagacgccggcgaggtgcacgcggttgtacacgcaggggaggcggttggcgatctcgcgcacgacggcgtcggtgaggtccgcccatggcgggaagtcggccatgagagacggagacggtgggggagggaagaggaggggaggttgcggactggggtggagaagaagaagaccagagggatgggaaggtttgattcctcttgtagcttcgggaggagggagctgtgtctgtcttcggagtggattaagggttggtttggtttgttgcctaaataggtcttactaaattttgtca

SEQ ID NO: 78655 - DNA, 4180 bp, Oryza sativa
aactatcataatatgtaactctttttatttaaaacatcttacttttataaatattgttggttaaagtagcatctcgaagaccgtatcagaataaaaacatcttacttttatagatattttggaacggagggagtagtaggtgtgatgtttgaccggtggtctagcaagtacgcaacgtccacgatgaatttataacgcgtactccctccgtccaaaaaaagacaaaccctggattttcgtgtccaatgtttgactctccgtcttatataaaatttttttataattagtatttttattgttgttagataataaaatataattaatacttgacttgtctttttaatttttttttataattttttaaaataagaaacccaggggttgtcttttttttattattttttttacggagggagcacgtgtaagctctgtggcgtgaaagtacgtgcctgccctgcctacggacacgagctacatgtacgtacgtacgttaattcgtaccacactcgtgcactgttggatgcgtcgcgcggccggcatatatatcgctaattaataaagcgtgataaatatgttttgtcatatcgtacaacaggtcacacatgtaggagagggagagagctagccatttcagagaagttattcacaagccgcgcaagaaaaatcgaattaatttatactgtatatgtttttgaagagacaaatatgaatttggatttatgtgggaagtaacgtacatggcacatgcatgttaattatcagataacgatttgaaataaatcctccttaaatataattgattagagaaatgaaattaaatgacgtccaaaagtccgcctctaatattttacttatcagatatacgtttcaaaaagatatgtgccttagcatgcatggatgatttggttttaaaaggaaatggctaaacgtaccaaatttacagaactctattacataccttggtattccaattgcgattgatagattgacagttgctgattttagtatacctcccaataagatagagaaaagattggccacttggaaatgtggacacctatcctatggtgggaaagcaatattgattaattcctgtgtgagtagtatccctttgtatatgatgggagtctatcttatgcctgagagtgtgcaccagaaaatggactcaattagagctaggttcttttgggaaggtttagagaggaagaaaaaaataccacatgatgaaatgggaggccctttgcaggcccaaagactttgggggcttggctttatcaatacaagaataatgaatgttgtactgctttgcaaatggatcttcaaacttgaatctggggtggaggatccctgctgtgatttactccggaaaaaatatatgtctaatggtggggggttttatcaatcaaggactgaggggggttcacaattctggagagggctgcatgaggtgaagaattggatgaaattgggaaggtcttataagattggaaatggtaaagctgttagtttctaggatgatacttggctgggagatgtgcctttaaaaactcaattccctatcatctatagcatttgtgccgatacgaaaaagactgtttaccagatgtgtcctaattgagagtggacaattaacataaggaggaatttagggggaagagagatgacagaatggaatgatttacatactttattggatgagattcagctgaactcagataatgatactatgtgttggaagttgaccaaatatggtatctataaaacaaaatctctatacagagagctagcctttgggggtgttagagatgtcattatgcaagatttgtggagaactcccatacccttgaaaataaaaatcttcttttggctcatgttgagagggagaattcaagcggcttcccaactaaaaaagatgaaatggaagggcagtccttattgtaaactatgtggagagttggaggatgtcaatcactttatgtttaattgcccaatttcgaagttcatgtggtgttgctttagagatgcgtttgggtgggctggtatacccagaacaagaggggagctccttgataagcttaagatgcaaagttgcgatgaaaataggattctactttctctttttgcagcaggggcctgggccatttggctcattagaaatgattgggtgtttaataataaactgatctctaatgcaacccatttgccttacaaagctgtctcttttcatctccagcggagaaaactagcactagtgaagactcgaagctctttggatacctcgcgggacttactacttgccagcatcagaaggatagcaagctcaaatgcctgaaaagtgtagtagcgccgtgacttcgtgatttgctttgctgggtttggtagtcttggtagggagctttccagatgtttggtaattttccctggcttgtttttgggctgagccagcagccatgatgcttatgttcgcctagctggttgtttcccagccgattatcttatgttacttttgtattctgaactcttatagctttgaatgaaagatgggctttgcctttttctaaaaaaaaaatagctacgtacatcaaatggaagctatagctactagcggtacccatttaaaagaaggaaaagtttctacacgtactaatttcttatactaattaatcttttaacaactcatccctaacaatactctcaagaaacacccaggggttttccggctagctccacaaggtgatgggctaattggtctgggttcaaagccacacctcttctatttatttgatattaatttcttccctaatattcacttttttttatctaacaatactcttattctgaactgtttttagagggtaccaaaatggagacgggattatgggaataagaatggcaaccattgtaacaccctaggtaaccacgtacccagagtgccacaccaaaatacactcaaaactactaactcctaaaattattagaaatttcggcagagtctctcctatagatacggacatccatgataggcagttataagataaactaataataatattattcccacagtgctatctattcatataatccatagaaagaaactaatagatatccaaatgaatattacaagacaaaaccaggatatagtttaagtgtcattatggacctaagcaatataatttgatagtgtgtagatagatgtgtatataagggtgctactttccgcccatacatactgatctcaatgtgtacttaaaaccaaataaacacaagagtgagtacataaatacttagcaagtacaatatggaactagaaaacacatatacacatcattggcaataaagcctgaacataaaactttctttctttgaaaagaaacacggtttcaaacaccatgttaaagaaaattaatagttcccatcccgaacagacatgaattgaaatagtagttcccatcctggacaactgtgaatacatcctagcatttgccggcaaagccgagtaagcttgatcaacaattacctataggaacatgaatataaaaccagatagcatatccatgactcacatggaacatgaataattgaaactagaaacaaaaaagcaaattgaaactaaattgcacatccatggcaagcatggaaattgagttatttaaccagaaccagaatccagaatattgaaacaagaataacgtcattgtgaacataagataaacctgaaatataaatatcatgaacaataatctgaacatatgcaatcacatataacatagaaatatattgaaaataaataggtggagcaaacaatccaagaaacacataatttgttcgtcatacacttgcctttaacctcgacggcaacccgacgaaaccccctccacaccagatctctccacacctgtggagtaaagctacaagtaaaacctctattgaggaatccttgagactatctatacatgtacaaaacatcatgaaagatcaaaaccaaaatttatctgtcaaccgggacggtacctacataaaactacctatactacctatacaatgttatatacatatttcacaaagcgcctaacaaaaagtagcaaccgatatcactttagacatctaaacaaaattctctacaactttcatgtgggtgaaaaatcagattaagcctatgtaagtcccatataaaggaaaa

SEQ ID NO: 78656 - DNA, 5192 bp, Oryza sativa
ttttttttttccattttattttcttttttttatatgtaggtatataaagagactagaacttttcttttcttttttttatctgtaggtatataaagagactagaaaggagatcaaacggtccacgtcgattcaatcgacgaaacttcgtttggactctgattactgcaaacttatagtctacttcgtactactcaacgagctatacgcatccacgtttccttattgcctattccaacaatggtttaaaggttgaacttttgcacacttgttttaatatttcctgaaatacaataattcaaaactcttttgcgcatttgttttaatatttcctgaaatacactaattcaaaactcggggtattacgattcaatcaacggaactttgtttggactctgattactgcaaacttatagtgtacttcgcactactcgacgagctatacgcatccacatttcctcattgcctattccaacaatggtttaaaagttgaacttttgcgcatttgttttaatatttcctgaaatacactaattcaaaactcggggtattacaggaacaagccccctcttagcgcacgtatgtacatacagtgccggcactatatccatacgcaactgcgagggtcggctataatagcgtttgtaacagccctccctccagtcggcactatatccatacgcaactgcgagggaaataaaaaactcggctataatagcgtttgtaacagccctccctctagaaattcaaaactcgggctataatagcgtttgtaacagccctccctccagtcggcactatatccatacgcaactgcgagggaaataaaaaactcggctataatagcgtttgtaacagccctccctctagaaattcaaaactcggggtattacaggaacaagccccctcttagtgcacatctgtacacacagtgccgacactatatccatacgtgcaactgcataacagccctccctccagaacccggcactatatccatacgtgcaactgcataacagccctccctccagaaccgcgtagccagcccagggctggctcacttacgcataccaccccacttacatttttatcctcgtttcatataaaacggttaacccgggagtgatacggttggaaggaaaataccttataaattggtttcaccctttctaaagtagcaaggtggtactaaatatgcacatacaactctcacgggccacacatgtctcatcctaattgggccaggatgtcacaaccatatccaagcatatatgatatggttgttaagagaaatattatttggaaaaaagaagagcatattcaccattgtcacttcctatcataccaaaaatttggtgttatcaaatttcagtacggtgacaacctaaacatgatcttacccaattgcagaactttcctctaataaaaacgctattaaattttaggatgcatcaaactaaatatatctaactttaccaaaatttggcaacaccaaaaattaacattgttaaaatttggtaaggttaatttgggaacaaagcgaataagcctgaaatgttatttgccatttggaaccataatctcgtctcaactcatatatattaattgtttgatatatataaccctttgttatttgtttggcattatatatagatctgcacaagaaaacaaaaaaaaaacataaggatatatccacagaaaatatccagaattaaacaaaagaaaagggacataatgggtacataataattaagcagaaggttctccaacatccccactataatctgttttccactgatgagaaatgtctgtcgtgtgtcctatacgtacatatcaaagctacctaccaaccactgttactatagctagccagtactatatctactcccataattaagcatagaggccccatttgtagcgatgtgatttagcgatcctaccaatatcatgcgtatatatgcacacgtgccaattagctgcaaattggacaattactactcccttatctgtttccaaatatatatatatttgactattcctattattgaaaaaatacaaatgtaaaacatatatcgtatataaaatacctttaataataataatgtcatagtaaaataaataacatttacatagtgttttcaataaaaataaatggtcaaacagtatgtttgaaagttaaacaagcttatatgtatttgaaaactgaggtagtagtatcactactatagaattggtcatcttgatgctgataatgaagatgttttgggttgattttctacatgtatgatgattcactacttcaacttgtttgaggtcagtctaatatctgacagggtggtgcactcatatgtgaagtgtgctaattactactcgtcacaattgtctatcatcattaatgggtgttgacttgtcataggaatgaggtattctcatcggtgaccattgatctgttatgtactccctcagtctaaaaaaagacaaaccctggtttccgtgtccaacatttgacaatccgtcttatttgaaaaatttatgaaaaaaattaaaaagacaagtcacgcataaaatattaatcatattttatcatctaacaataataaaaatatgaattataaaaaaatcatataagacggacagtcaaaattggacacggaaacccagggtttgcttttttttttgagacggagggagtaaccaatagccatcataaatgtgggttatgactcgttatcatgaatgctaattccctttagtgtatatagaagaggtacacatgtatgcgcacttaaagcatggcttgcatctacgtttacataagagcattcccaatagctcatctgtcacacacgcaatcttgaaaatagcataccgaaggagaaaaatgggctctagtagatacgtcatcgctacttccaaatttgacgtttctctctccacaccatcttgtaaccgcctaaaaacagatcaaacttccgcccccatccgaatcaatggactcatccactgccgtcaacactatcccgtgtaacctcgactcctcatttttcatggcgatgaccaatgaggacaaacctagtcggccactccgccacccgcgctacccatagtgatgcagactgtctcccgatataatacaattgttacagtagaggataccgatagagtgaccgtggatatcacggtagctttctaagaaacgtggtgaggagcgccggcctagggacagtagtgggggtgggatggaatggggaggggaagggaggagagctagccagccgcccagcggggatatggtacacacacgcaagcgtacgtgcacgcggtgactgcaggaacatgtccaggatattcccgggcgtgtcggcaacagaccatgtacagtatgtactgcacgcatgcttgtgcagttactaccggactggtggtaaatccttcgtcccgccaaattcctgctgtaaatgtactggcatattgcatatatatacgtaatatattcatatataggtgacttcgcacatattttgctggaagtgaatgtttttcactgtgcattttcaaagactatatgtccgagcaagaataatgtagcaaaactataattttttttctattaattatagtatgaaatgcccaaattaacgattcaagaaaaaaaaaagacccccacctattctactaataactatttccttcatcccaaaatataaatatttttagcatagtaaagtcaaaacatttttaattttgactattaatagaaaaaaaatcaatcatgtaaaattcatgttactagatttattattaaacaaactatcataatatgtaactctttttatttaaaacatcttacttttatatatattattagtcaaagtaacatttcggagaccatgtcagagtccaaaattgcttatattttgggacggagggagtagctagtaacatatataccactgatcaaacccatatatataaataaagatatctagcctataagtgtgatcgaggataacatattagattgttggataatgattacgtatatgttacccaggtaaatgcgtggtgggaggaggggattgagatcctcttccttcacagacaccatacctttgttactgacagataggttcagggttcatcgggtccatatataagtgataaagttaaatgtatttgaaggtaaaggagcctgatccgggaggaggggggcagaaggaggacgactttcgcttgcatgtgatctggacaacgcgctcctctgacatgcacgcagtatatagtagtcctgcgcgcagaacggctgaggtgtgtgttgatcagttcagtggagtacgtacgttgtgcacaagtcgcatgcacgagcaagcaaacgaacgtaaaacataatggtagtatggtactactactagctatagctgacagcgctgcatgcttcacacagatggagtcatatagatataagatgttgcacatgtatacactactggagatacaatctttgctgggttagctaaaaaccacattagtcccggttcctgtaaccggttgaaaagccaacgtcacttttataatctttagtcccggttagtgttatcaatcaggactaaagatcatttttagtcctacaggttcaaaaaacgtccagccccttattatctttagccctggttagtattggtattatcaaccaggattaaaattcaatgcttcatatataatccctcgcatttatcctctccttctggatcacaaacatttcatcctcattttttaacttcctcctctcttttctcctctctcgactctctctttcctctctcttatcctctccttttctttttcttgcagcagcagcagcctggaggagggggcagcctgctcaggcctacgtgcagcgggcggcggcctgtgcaggagccagccccggttgatttagttgttagattttgttgatttatctatgaatttgttgatttatgatgtcttttaatatgtaaatttgtgatatgaattatgaatgtggatgtggacaattttgtgatgtttatgtgaatgttgatgattttattgttgagtttggttagaaatcaatatataaaaaacaataaaaaaagactaaagatgacatcgtcagccacgtggcgctatcatctttagagataaccgggagtaagatatgcatctttatttct

SEQ ID NO: 78657 - DNA, 1132 bp, Oryza sativa
ttttttttattgttttcttatgaaactcccagacgtcaggtttttatacagaatctagcttttgggtcactaccatttcgcccctcagatacaccctctgttaaaaataatctaacttctgtttgtgtttcttaataagtaaagctttactaaattcagctcattacgttaaggtgatacaagtgtatcgagaacactctcagtctctgtacaacaaagatacacatagccaaatgaacattctcaaatttacataaattggagtacaagaagtattactggccattcattttaagagtacctccaacaagctctctatatgcccctccaagcataaaacttagcaactcggaaaaatcagtcctccaacagactggccaaccagattaccaagccatccggctagctaatattggatagtcggtatccctgacccagcctcgtcaagtgtgggtccacgccatctctctcctcaacccccttgccataacttgctagcaacacttgatatgcagctggctatcgtcgttgccgtctcaaggctattgctggaggtagcaagttggctgccatactgtaggcttggcagtgacgccctatagctcaacgccctggatttggtggccctcctttgcttccccttggcatcgacgagcaacaggccacccatctatgctatcgccgaccctagccatgctccagcaccgtcgcaccgtgggattggtggcagcgtcctgcagctcggcaccctagatttggtgggcctcctcctcctctcctcaggcctctatgttgacaagtagcatgttgtccctcctaagtcgttgcttgcgctagctgtgctcaagtgctatcgcactgcgggattggcggcctggatctagtggcccttctccgcctcccctcggtgtcgaagagcagcagaccgcccttcttgtaccgtcgattgcccgagcatcattgccttgctgctcggcggtgacgacgcggtttggatctggtggctgaggccattccctatgagattggcagtggatccctactcggtggagcaaagggacgagctcgccttcactatcatgagcgtcaacaatggtggatagagtgattgttgaagcatagaacaaatatg

SEQ ID NO: 78658 - DNA, 1204 bp, Oryza sativa
ataagacgaacggtcaaacatatgctaaaaagtcaacggcgtcaaacatttcgaaacggagggagtaaaattgaatcggaaatgaacaaattaatacaaaccaataccttagatgactcttcctcgcggacgacgtcccaatcaatcgaacggccgacggtggcagggctcactcttcgaacaaagtcgatgacggctctaggagacttggcgcaaaccttgcagagggcatgcgcgatatgaagcacgtcgtcgggagcagccttggcgctgccagcgtcggaggtgacagagtcggaggagtcctcgccggactccagatcggcgccgcggacagagatctcccctgtttgaggggagtgggaaatcgtcccctcctcttggatcgacaatagatcccactctcgcttccgcttcttcgctgtcgtctccatcggaccacgcacacgctcggcctgaaatagagctggctcctcaactccgccagcttggatgccttgatgacactcttcaggccagcactgtctgacccgagaggccgacaggacgagcacacaggcagccagactgccaaagatgggcggcctgatgggcgccgatgcttgctgcttcacagcgagcacgccggccagcttttactcccctcgaggacgacgcagacagctcgacaggcgtggagctcttccacttccccccgattttgagcaccttgaaccgaccgctgccgcaagacgacgcgcggacgagaatcgattggggggggcacgggcctgcaagccacagtcgaaaggggaggaggggggctggcgagaatcggggaggacgggagcctgcagcggaggggaatcgattctccgctaggcctgcgtcgcatcgacgaccgcggaagcaagatagcaacagcgagaggaggaagaaagagggatcgagagcattggatgccctgactctgacggaaaagccgaggcgcaacggcaacttctcacatccgttaacgacgttaacgtcgcctcacaagccgtccttctggtactgtgtgcgggaccacgcttccagtgcacggaacatgaaccggatcaggactcgcacatacgaacgaagcctaaataggatctttcttttggtcttgtataggtctttaattggttgtgtatagttgcgtatagttgcgattgtggatttctgttcgagcccggatttcaag

SEQ ID NO: 78659 - DNA, 1518 bp, Oryza sativa
ctcttgcgggcacgtatcactgttgccaccgcaaacgctaaaacaaaaatgttcgatttttagtctattagattgactttgagattcgtgttcatggaacataaaaaataaaaaaaaagctacgcacgatacaagaacgattttgctatatctcactcgaaagattttttcttatctctcactcgattttctcactcaaatttacagtgcattttattgtaagttacagtgtaatttatgaaacttaccctgtaacttttgtaagttacactgtaatttttgaatcttcgcatgtaaattttaaattttgtattggatttagtctttttcttgaggatatggtaatttagtgtccataatgtgtttcttaattgctttttgctttttattatatctatcggattttaatccaaagattaaaaatctgtgtgatacgatcataaaaatctttcgaaagatgtataggtactcccatacaagaatcgaccccgggaccttcgatctgggcccaactacttaaagaaagtttatttgctcagttgggataaaattagtttttctctctcaataattttaagcatctttctattttctattttcagaaatagcattagtaccattttaattatttattactgcttaataatttaattccaactaaattgaattaactaaaaatttgatttttctcatgatatggatttatttttcgactaaaaatataattatttatttgtcatgatataaatttagactaaaattaaataatattaatatgaaaatttctaaactataagagtgctcatttttttattactttactaagttaataacattaattttttccgttgcaacgcactattgaataataatttattatgagctactatatttctctctatcatttgagactttttttaacgagcaaaagtaccaaagcagtgtgaaaataacttcgcttaaaaacaaatatttttagttcaatacaccgtagcaaagcacgggcattttgctagtaatactaagatcctttcaacgcgtattgtctccttagcatcaataatactagaggctggggcgcgccaatggcgcgccgcctgtagacaggtcgatggaaagatgcgatgcacacgttctcttaactaagaaaagctaaaaagcatatggtaaaaagaaacaacaaatagtaccatagtagctgtagtataacaagccagctgtttgtacataaagtggttaattgttcactcagcttatggataacaaaaggagctgaggacaatgataagcagttataggtcacgtgcttacagagcaagtgaagttagatagaccgcaagcaaaggataatagagaattatagtagttgttccagtgtagataatagcagcgactactgaagatgcaggtaactttcacagagcatctatggtgagcgtgaggtgacttgtcctaaaaagtggaagatgcagattgtgtaagttgatgctgttggctgctgcaaagctaaccaccctg

SEQ ID NO: 78660 - DNA, 18232 bp, Oryza sativa
  unsure (1)..(18232): unsure at all n locations
ccgagtcaaaatatgcattgtttggaagagctgtggatttaggagaagctgcctaaataggaacaaaatctgcattcaaatattgccaaacggcatgacgcattttagttttagtttccatgtcaaatttgagcaaaccgaagttaatagtgattagtgtactaacaacgcgtcgtttttaagtgagagtgattatagtgataattaacagcagcaatgaaatggaagtgaacatgtcccaggtggcatatagagccgtgaacaaaggctccagtccagccaccggcggcacgccggcgacaccaaccaccagcccaagcgttcggcagcggcgacgtcggcagccacgcgtacagtggttggtcccacagccgaggattcaccccaagacgcgggatccactggaacaagaggccggccgtcttcttccagtccagctaccctcctgcaccggaagattccaccgagacacattcacctcgccagaaacggacatcccaagattctggtccacacacacagctgcatgcttggaagccaagcaggcaggcagacaccggccagctggcagtagctgacgtcactgctgctctcacagcagctctgccgttgacaacttggcattgcttccatcacanagatctaaaacaaggacacaggttgtagattctgctacagccttctctccacaatatctgggagaagctggaactaccttggaaaagactatacactgtttttacttttacacattgcagcctcctgagtcaagctaacagactccagacagcagaacagactccccccagcttacagaacttggtgggggtgtgagtaccggtttctgcagctgcgaagaattagggctgtatttacaatgaattgaattaggttggacaacattgtacaatgatgcggtggcgctgttaataaagaacaagtactgccaccgcctcgagctgccaccccgggtggcgagggcgaatccgccacggtcgtacatgctctgaatctcctcccggtaattggggagcgactcgtgaggaagggccggtgtcagctccaccacatcccccatgctgagcttccggttcagatcgcttatgggctcgtggttaaccttcggtcgcagatcttccttcatggggatgcggtagggactccatcttggagtgttggtcccaactcgatccatgaggttcattacagttgagtttgcttggaattcttgcacagacatctggaatcacagggacaaacttagtgagaactataatcaaaggcgatacggttgcaattttctaggaatgggtttaactggagactgcgctcaccttgtcatgttccagtaggatgacaaatatcggtccatcatggtcgcattgccgagtatatgagtaagggcagtcttctgaatgcatgggaaatggacagggtggcctaattgcatcactgtcgcctagagatgcaggtcgttctttgttcattgcttcacattgccatgtaagcacccacctagcccattccaccatctggagtacaaaggagtgcctacaggtgccttccttgtacctccagtgtgctgcgaatccatactcagcttgcaggtgcatctcttttgtacggatctggacttcaaatgggtggacattctcgctcatgacaacagtgtgcaatgatcgatacctgtagaaagcaaatcagtgcaaagtatagcagaaagtgaatgaagaatggtcatatcaatgttcaactcagcgtacccatttaattttggacgagatatgtagtccttaaatcttccaggaacttggggccatagttcatgaacaacatcaagtgctcgatagcaatcttcctccttctcaaacacgagacgcaggccatggatatcatggatctcatccattgtcaaattcttcctgataatgtgcgaagaccagttagcagaaagaaagaaaaatgtggttcatcgtcaagttttaaaaccgtaaataatgcaaacagaaagccttgtaacatactttagcatcttgttgtgaatactgtataggcttttgtgcctcccagaaagattgtgatatgagaggcctgcatccctcagacctctatctagtttgtccacagcagatgtgattagcacttcgtcaaaggatttggttagtttagatgatagatccttgtgctcttctggattcagatgcttgaagcaaagattttccaactggtctttccagctggcaatccctaatcgattagccaaaggaacaaagatctccatggtctccttagcaaatctttgttgtttaccaagaggtaaagcttccaaagttttcatgttatgcacacggtcagctaattttattagaactgcccgtgcatcagccattgcaagaagcattgtgtgcaatcgatctgcttcaacaatcctgcttgctgtgttgttatcacgagcaagtttgctcaagtggctcaactttgagacctgaacatattagatatcaaccattagttttgcaacaatacaatctattttctctgtacacaatgctatgacgtatttcactaaatatattgccaattgtcacaaattcatcatatgagaaataatgctacagagaaagtgaccttttaatgcactagacttagtacctaagctacttaaatcatatcatagaagtcgtacattgaccccaaatggaggaacctttattagtgagggatgtaaaatatagttgtcttacattagaaaaaatgcagacacatgataattgactttaagtatataaagggataaaccatggtaattcagatcaaataattcaagttggtcctgtcagcagcgtgataatccaaaataagttcaatgttcatattataaaactcattaaccgatccactgggaacaattatcaaaatccaaggaaactggaacacgtaccccctcaacgagatcggccacgccggctccgaacatgtgaaagatgtgatcataatcaatgaatgaatcgtcaatggtgtcgtgcagaagcccggcggagacgaccgtcgaattcccccaatattggccagaagcacggctgtctctacacaatgttgcaagtatggatcgccactcgcccgggtctaatcacaaatcacaaactgaacaagataagagactgatgcagaagcaattcaagtgttccaagaaccaatagctaaagattgtgtagctcgcggttttgacctggccacggtgagccttctcggcctcgaagaaggtcttcacgacgagctcctcgtggaagatgcggtggcgagcctgggcgccggcgaggagcttccgggcgcacggctcgcaggcggggctcgcctccgcgaggttctcgtcgagctcgaacgcgagctcgccgccgccgacctccgaccgcgggctgagtgccggggcgtagtcaacgcaggagcccagcgcgttgcgcacgaagccggcgaagaggcgctcgcggtcgcggtcgcggccggcgagccacgacgccggcgggctgcgggaggccgccggagaggacgacgggccctggaacaccgacacggggctgtggtgatggtggtggtggaggtcacgccacttgagcggcgaggacgagtagccgccgccgccgccggcgaaggcgggctcgtcggatctatcttgccacagcgcaccgagctcgtcgtgcggcggggcacgaggcggcgaggccgccgcggccggggaggagaagaggcaggacagcccgcccgcggcggcgggcgggcggtgagaggtggacggcggcgcggtggagcagggcggcgacgagccgcgggagctcggatcgaactccgacgagtagacggcgcccggtggtgggctggtgtacagggaaatcgccggcaacgacatggccgcctgaccccgagatccctccgacgagctcgaaacacgcgaactcgcaaactaaaaaaaaaaaatcacgaatttgatgtcttggcgaggtgaactcggcgcattcggggttcctggaccaaaaattgaatgaaaaatggccaaaattcggtcttggcgcgattaaattcggcggatttggatgctgcctctcgcgggacgagcaacggcaagggtaagaaagaaattggggaaatcttcttcgctcttgtgacttgtgagcgtgtggggttgcttctactgctgcgtttgcggtgtggatttttgtgaggaatctgggaccctttgctccccagttatagaaaggcggccggtttcgaaatgactctattgcccctgtccgcgaggaatcttcttccatcagtttattgcttgagcaattaacctttgtttaacctcacatttaacaaatataaaaaatgcatattcgtaaacaaattaattatcgggctaatcgattgcaaaggttggtgtcgcctggttagataattggcatcaaactctgtagtggtgttactgtaactactactttaggcctaatctttgaacaaatcgagatatgcctttttgttaaagttctgccctatccaaaacttgatgctccattggccaaagataattgtggttgatgcgatgccagttgcccaactgataaaccaagggaacacaaatatcatctcaaagtcctatctggaatgtactaatccactaagcccgggaggagctagtggtggtcattttctaatccatccagtatttttctccagtggcacttatatgcatgaaccttttattcgacaagaacattggcaaatgctttttatttcgtatgataaaattctccactaagtaacatattgggaaaaagattatacctaacactgtaatctttgtatagccttgtttaatgattgccactggaaataaagagcagttcgcggctcaaactgaacccaatcatcagaggccactatatatatatattccaaattatgtaatgctgttttagtattatttagtttgagctttcaaacatgtgcagaaccaatcgaacagcaggtgcggcactgtttgtaaaacgggcaacgcgggtcgcttacatacatagaattaattataacaggtacagctactgatagtgattagtacgatatttaagcgccgctgaaacggtgaccttctcatggcctttcaatagaagcttcttgcatgatcgtttctgctttctacaattctacgactagtccactttctagagcatggacttcagactcccaagaaagggaaaatcactataaacatctttccatgtagtagcacatttttttttctcacttattttaaactataaagtgggatagaaacggtaacataaaatttttaaccaatcgagtactctctcccgtaataggttgattattttttaacggagggagtattgttttataaattaatacttcctccatttcatagtatatcgtttttacgttttctctaatcaaacttttttatgtttgacaaaatatatagaaaaattagtgaacatctatattactaaattatcatatattttttttctacaaacgactaagaaaaaatcaaaacaacttataatataaaattggggaagtattttttttacctttttgattttatctgtatgtaaaattttaatttcttaaattcctttcgacgtactacagtcgatgataaatagttaaattagcaggtatagaaattccggaccgactagagtagtttccgacaaatatttttccgacgggttttcatccttagatgtaataaatgagatttgaaattgggtgatgcttcgtgtgcattaaccagtttttttctccaataaaagttagatgaagattaagatcacgtttttcaaattgctaaacggtgtgtttcgtccgaactttctatatgaaagttgctctaaaatatcatattaatctattttttaagtttgtaataattaaaactcaatcaatcatacattaataccacctcgttttgcataaaaaacttaatcttcattttcatttttaggaaaaaagaacatgtttcgatctttatttattctctctgttttgtctttacattaacaatggtttactccctccgtctcacagaaaaatcaatttagtaccgggcttgatatgcatatatctagatttgttgtattaggatgtgtcacatttaatactaggttatttcttatgtgacggatgcatgatccagaataatacttaatccagccatagggcttcgttcatttaaagaagtcctcaccgaaagataaaactactcctttatttattttagagtatatttcacagaacttttcaaactatcataaaactataaatttaaatatatatactttatataaatttaaatatatatactttatattaatagtgaaatttggtaagtctggagtaatcatcggcttagagtcagtatcggcttcagagtcctggcattagccgataagagttatcaagtcaccagcagtcggattcttggaggattcggttaaggacattaatctattcaaggaaccttatccagaagagaccgagttcaaggaggatgcggcatgatagtttatctattaattaggaatagtttgttagttttcttttatctttaggaaaatgtgtttagtgtccgataattgctttatgttttccttttatccttaggaaagtttctttcttatcctacaaggactagtatctccccatgggtataaatatgtacacccggggtcattgtaaaagaatctctcgatcaatacaactactctcgacgcattgccaccctctttaccgaggtttttacttatcattcggtagaacttggctcttgacgcggggctgcatcggctttcgatctccggcgaaggggtaagccctatgttccaccggtcctggtgaatctatcggctacattggtattgttcaaggctgcattgcttcgatctcttggatcgctctggtttggttgatatatttgcctacctgatatctcaattctatctctaattgcattgtgtttagagacgcatcggtttagttggaactgtctcggttaggtccgatcttctgtcttagccgatatatctctacaatcacaatgctgttctaaatagatttgttatatccatcacattagatagatcaatcagctcatcgagtattagattatcatatacaatctcatgctgcatcggttaggttcgacctactagattgttattgataatataagtcttgttaagccgataggttcatgctaatgttttatcggggtgctagccgataagttatctagacgttgcatcggcttataaggattgtatatatataagttagatttagccgatgataacaaatgtttcattgatctatctaatcttgtggattttatgacatcggaacttcagccgatgtatgctttaactttcggatcaatatttgttctatcatatcattgttagccgattagtttctactggattatattattgttatttatcatcatcagccgatcgcctttatatcattatctacattgaacatatagccgattactcaaaactctatcgttatcggctagtatcggcatcggctgggattgctctatcggcttgtcagccgatcggctatttgatctactgtttacatatcttgtcagttgtaggatcaaactgactggcacgcccgcatctcaccaagatttggacctgcactggagctaaacagatctccagaccagtgtgtgcttttcgcgtcaacacattatcaaactatcacaaaactataaatttaaatatatatgacataactacaaatttaatgtcaaagttaacacataactttagatgtaaagtatcatatcacaaaactacaaattttagagtttatatccataacatattaagatcgtaaaatttgtaattatgttgataaaattaatgttgaatctgtagttttctaatacgatacattaaatctgtagttttgtgaaaatatgatattaaatctgtttggatttttatacacatatgtttttaaatacatagttttacgatggattaatcaaattagtatgaaatttactctttaggaggaaccgagtgtcgctctcacatgctcatctcacgctatccgtaggctttgttgctgatctgaactttatgggggtgtgtttgatagagggaggatcaggtagtttgaaaagatacgcaaaacgatgtgagctattagctcataattaattaagtattaactattttaaactttaaaaatggattaatatgattttttttaaagtaactattttatagaaatttttgaaaaaaacgcaccgtttaatagtttgaaaagcgtgcgcgcgaaaaacgagtgacaatctcccaatgaacgaacgcagccctgaactgtcggcggagaagatagacacggccggccaagcaacgtggacgcgtggagcgggcctcgttgcctccggcggaacgatccgccggggcacgcgtcgcgcgcgctccgccccgccaggagcacgtggctgcagaggcgaaccgttctgcggttgagccgaggtggcggcttacggctgccgctggccgatggcctacccgtacatgcgcgcgccggtatttcggacgcatacgccgcgccgtcgctggcgggcgggattttacaggtgaaaacgtgtgggaaatgtgcgtacgacgactgggtgtgcgtatacgtacgtactagccgtttactttggcctggttactcacttgctccggtggaaggacggaaggtacgccacgctcggcgcgggggcgagagggacggatactcgatcgcggatagtgatacggtgggagctcgggccgtgcacgtactgcgtttctggtagatgcgtgcccccgtgcccggtttctggtttggtctcttgacccgtgaaatggattttaccgggggctttggttggtgccggtggcaagcgtacgactgttcgtctgttcctactccacgggcagagcatacgtgcacgataggatcaagtttaaaaaaaaaggtgagaggtgcaagaagaagaaacatgattaaatggttagtcttcaaaaatgaaataaaaaaggtcaactatgaaatagaaaaatgaattaaaaaatcttcagaaaatgaaataaaaaacagtatagtttttgggtttatgttgccgtactgccagaatgtcaactactccgtattttctatagcaaaaggtctcacaatgtttcccctgttgcacagggaaaataaaagtagtcaaatggttggtaggatacagaaaattaaacaatccacagtttgctgagtattttttccttgtataataaataaataaacaatagaaaaagaaaaaggaagcgtcaaagggagttgagggacgcaggcaggatactgtcgtgggccgcaaacttgctccaaaaactgtgttcgtttgcagccttgtagcatactcccccgttcaaaaaaaaaaattaacttgtgttgtttcagggcttgtttggtttggagccaattttttccctactaaaatttaggtagtactaaaacattggcaaattttggtactaccaaattaggtagtattcaatttaaactatggtgggtaaaatttggtagcaaaccaaacatccacttgctactattgaagttgccaaaattttggtagggtagtaaattggtatcaaaccaaataagccctcaattttatcccataaaaaattaatttatactattctacctatcctcaacatataaacaggaagttttatcccttaaatgtcctctatctatcaccattactactttttctaataataaaaaacattgatcatttttactcttcactaatttcactttgaaatgctaagaatggtcttattagggactctgcatatagggtatgtttggttcctagccacacttatagatggccatttgggccgcccgacacagcatggcccaagcctggctgtgcctcggccgaggcttgtcgggctggcacggcccaaccgactcaccgtgttgtgccgtgccagcccacgggcggcatatacgacccaatactactcggggccagctcgaaggcacgaagacccatcgtgcttgctctcagaaaaagtctatttttgggtccctcaactctgcgggctgtgtttaaatggctggaaaataagtctattttttatacctcgtgtcttgggtcttgccttacatgattatataagtctattttgcatccctaatttttttttatttgatcgggccgtgctgggctggcccaccccgtgccgagggtgtagcccaggcacggctcggctgttggatcaagccggcacgggcacgaccccaggcgggccgtgtcgtgcttgggccaggccaaaactgtgggcttcgggccgagccatgggcctcgggccatatggccatctatagccacacttgaccacgctacaatttatttttgttaagtatgtgttttgactcactatttcacaattatagtcttggcttgccacacttagtgaaggatccagaaaattagttccttgatgtcataatgtgtctatcagagtcatagtatactaattatacttaaattatagtattctaatttatggataaacagtttaaatataggttttactgaaagtcgtcagtgtcatctgacaccggcccaatacacggtagattcatccctgaccacacttttttaatagcatgtctcgtatatcatagatttaacttttttttaacacagtttgtgactaaaatttgctcaccacattttttgtgatcatcataacttatctaattttagtcgtggtaaagtgtgaccaggaacaaatacatcaataacgcggctttcaattaatagttacttcctccgtttcacaatgtaagactttttagcatagcctatatttatttagatgttaatgaatctagatatgtatatgtgtttagatttattaacacatacatacatacatatacatatatatatatatatatatatatatatatatatatatatatatatatatatatatataagcaatgctagaaagccttacatcgtaaaacaacagagggtgtacccataatgcggctttcaattaaaagctgagtctctgacctactctaaaaataacaaacacacccatagtatttcaagagcaaacctttacaaacatcgctcggtaacaagagcatcacttcgtgtagatttcgtcaacatcccgtaaaatcagaaacgtagtacaagtattacggtacacgacgactttacctctcccaaaccaaactcacactggaaacccagaaacaacaacgttcacagtattacgcgcacaaagcgatctccagttaattctccaaccaaactcacgtctgcctgtaactactccgtggccgcaggttgtacctccggccagccgacgtcgtgatggagttctcgccgacgacctcctccggcgaggcgcagtgcctccggcgaggagcgaccaccgccacctgccgctgctcatcccccggcaaggcgtagctcggatccgcattgctgtccacctcgtcggccaactcgtcgaacacccacgagtagtccatcaggctcctctcgctctccgcgccgccgccgccgtagggcagcatcttctcgccggcggcggcggtttcctccagcgcccggaccttctcgacagcgtttcggagcaggtgatggttgagtagttcgtaatccctgaagaaaagtttacaggctaattaattaccaggagattgagatgaatcacgaatgcatgcaaagatctgatcgtgatgaacatggactggatttggtggttacctgaatgtgaatatggcatgcaacatctgaacggtggcaagtgcaaggaacactgatctgacaaggaacaccttggatatgacccagaattgcttgtcgatgtcgtcagctccgagcttgatcaggccaatttcgagcagaagcgtgatgcacaagcctgccaggagagtaaaaagcaatagcaattgagcattttacaaggtgtaaatacaggtagtaactgctaatagtatgtgaaatatcctgagatgtttttttttttaccaaagtaaagatgtcccctgatgctgaaagtttgcttcgcgcttgtgagcatgtagatgagaaacacgatgcagcagtagaagaagaacgccttgatgaaacgtgactcggctaagatggcgttgtggaggatgtaaagtttgtccagagcagcaaaaatgttggcctgctttgctctgaactcttcctgcaggacaaaaggaaaaaagatcagttgaaaaagaagtcaatcctatgcctactgattgatcatggttaagcagtcaaacaaaaggaaaactattctcgtattctgatatgcaggaggagacaataacctgagcttccagtattgagtgtgaattatgaatcaggtgttcatgagcttgccggatttcttcctgcctggacnnnnnnnnnnnnnnnnnnnnnnnnccaaactgtgcaagtttttgcacagtctccctgaaaattccagtcaaaatcagtatattttacaatgaaataaaaaaagaataatggaagcgagaagttaaaatacctgctttcctcaagagcttgtgcctgaaagctgtacagattattcagaccgtccatggccttgctctgtccatccaaaagttgcatctgattctccaatgatttgccagccacactcccaatatcatttgcagtgctctgcaaatcctgcatcttggtggacatggaatcaccaacagttttgatctccctctgaatatcaacagcctcttccttcagcttatccatcccattgccaaggctctcatacgactcctgaatatgcgtcatgccggcatcgatcgtctccctcatctcggtctgcccttctctgagctttgcctgagagtctgcaatctccttggactgctcaaagatggccttggagtgagccagcacgtcgtcgatctggtctccgacattcttcgacgcctctgcgagatgatctgcctgcatttcgatcgacgagatcgtctcctgaactttgcgtgattcttgtatgatctggtctgacctctcctcgatcacctccagcttctcctcggctgacttggatgtccttgtcaggtcgttgacaagcctctccgtgttatgcttgaacgcttcagctctacacaaatcaacaaaacatgaaaaattcaagaagcagaagtgaattgcaaactgaaaatgggagaattgcacttactgcaattggtggcacagggtgttggtctcgaggaagaactcgaggaacacctggtcctcggagacgccgagcctcttgcggcagtgcaccatgtcggagacctcgccgcagcgagggaacggggggcggccggagtcctcctggaagcagctgctgaggtgccacgccagccgcgactgcatctccttgtcggccatgatgtcgccgcagctggcgaacagcctccggtacgcctcctgccagcagttgctcggcccggcgagcttgctcctcgcgttctccagcagcttcaccgccctcgggtcgtcggccccgtccatcaagaagtcggccaccgcgccgtccagctccagcatcggggcggcgcggctctcgccggccgtcggcggcgaagacgacgacgacgaggagaaaatgttccacgagaagccgctgctcctcccagggcacagccataggcaggccaagatcaacaacaggataatcgtccctgcgtgtctcctcatggtgaaatcggtgaactttgcaccgggcaagaagcgatcttggtgagtaaaatcacgggttaattgcagttcctgccaggaaggaacaatcaagaaggcaagaattaaagcctattcatttgatgcagattgttacgccccgtgttaataacattctgaaattcttaaacccaaagaccccaatcgaattgaatcaccgaattgaacagaataggaattaacttgcaaatttgttcagactaaaatatgattaatcgaagccagtaacaacctaaaattctaaatcaaatcgccggagcaagatgcaacaaggggcagtgacaaaatagctgcaactttcccctgcggtgtgaagggctccctgataaatagcacccggtgttccttagccggcaagccagagagatccagatgagcctgtcacatcacatgcaggggaagattaagagagaatcaccctaaactaaaccaaatgtttagaacttttgacaccgaaaatgacagcgacacgcacgcaaacacacggtgaacagcactgaacttgatattagtaatggcggtttacatttggaatgtgctagttatcttacacggttacaccaatggaagtgtggaaagctacttggatgccaagttgaatggtggggcacagatctcttgccgtttctatgttccgttcccagcaaggaagatcttgatcagttaatgacaaatcaagtcggtgctaatttaagtcggttgcatgcactggcttacaccacaagatactactccaagaggcgcaagcgcttggcccaccatgccagtgacagagggccaatcaaattctcctctcctataccttgcgggctatctttactgacatgaacactgaacatataccgcgaaattctgaaaagttcagaacgaacgaacctacaacgatggttcaattttgttgcaccggtgaagttcagagagaagaaagaaatctcgctgtattttgattcggaaaagagaggcaagagcagaggaaaaaaatggaggaagaacttactcaccggatcgcctgacgttggcagaggttgaaggcgacggagcgcgacgggaggcgaagctgtaggaagggagagcggccgccatatatgtagaggttaaaccggccgtgatttcactggcggtagttcgcggtgaaaacgcgcgccggttaactcgaaacggcgcgaacgggcgaacctccgcgtgagaaacagacggagatcaagaggcggcggcggcgctggccgtgccgtgtgccatgcacgcggttgggatgtagtagtacaaaaatttggcaactctttacgctcgttgagtgagcactgaattggcaaaagtttgaaagtgttcggtacagcaaccgtctgaaattggcaaagtttgcatttctgtttggagatgctacatcatgcgcaaaaaaaaagttggttcacatttctccaattttatttttctttcctgtttgtttgaactttgaaggatactaaactcgacaggaatttcacaggaacaagaaaagtcacccgcgttccaaatggatcatgaaacatccatgcggtgaactgaactgaacttcagagagtagagagacaagacagaggctgtgtttagttcacaccaaaattggaagtttgattcaaattggaacgatatgacagaaaagttgaaagtttgtgtgtgtaggaaagttttgatgtgatggaaaagttggaagtttgaagaaaaactttggaactaaacatggcgagaataataagagatttgaaggtcctccagtggtactaaaatttttagtataaattttctagtaccggaagtaccgagagttatcaaattttataccagaaactataatagatggctgtaaaatcactcgaataataatgtacacatgacccggaattttcgtaactgcactatgaaatatgaataggccattctgtcgcataaataggaatttacagccatgtaatgagtactctgaaaccccaattgctggattacctacacaaccatacaggagaagattacatgcactgggctaattcatgtccttatgatcttatattcacaagaaagtttcagtttctgtatacccatcttcatccttggacagaaaaatatattattgaggccaactaaattgacacaatggaactaatccgtgggcacctcatgcaacaatagggtaggatgcgcaagtagcaatacctgcataatttatatcaagtcaatattgtgatgcagtgcaatatatccagcgtaacaaatgcgatatcagttcatcgtagccatggacgtcaatatggaaaacttaccgcacatgttcttgcccatttccatcttgaagtaaccattgtcaccccagtctgcaccccatgagttcttgatgagccagtagggaacgccattttcgacaccatagccaacggccagaacagcgtggttcacatcctagtagtagcattggaactcacaattcagggtataattggacagtaatcatacaaagaaaaactcgacacaaacaaatcaaatcatatactgaaaaatgagctagatctcttgtacactcaccattggagaagttccacaatggtcacttgtgtaaactccactcttgtacatcctgaaaccgttgatcacctgaaggcaacactaactggacgaacaagtccaacagcattcttcagctcatcctcagcacccttaccagagcaataaccaaaaaaagaggatcaataaatcagaacagtatattctagatgctcccatcaaactttacaacggggttccttaccagggtgatgttaacggagtccaaaaccttgactccaacgttttcaggcttgtaatgacagatgccattgacacccgtgtaagggtaagcctcttcagtgtcaaggccaccattgtatttgatgtactcaaaggcctgagatggtaggcctccactgcatccgaaattattgtatgcagtagcacaatcaaccagctgctgctcagaaagagagacaggcttcccagtggcctgagtatatgctgcctcaagagaaccagtggtgctgccagaataagttaaaggtcactcaaatgatctgattataggaccccccccccccacccgtgactttccttttttctactttgtctgctataattgaaatgaggcaccttttctacaacggtcacactatataaagttataatcgaaagtaacattccaggaacattttcaacataggtttgtcaattggtatgtgaagcatatttgccactatacttgtggagtagcaagaatatatgccaaatggacgaaaagtaacagaataaattcatgaaagacatatgataattgaattgtatgcttatttgagagtagtgacagatacctctccgtccaaaaaaaaaagtccaattctaacgataaatctggacacctatttttgggacggaggaagtacaagtcaaatagacaggagatatgaaaggctccattatcagcaaccgaaacagattatgcaagcagcactagaggggtgttcgtcactactgccggttccaactttcccctctcgttttctgctcgcacgcttttcaaactgctaaatggtgtgtttttttacaaaaagtttctatacaaaagttgcttaaaaaaatcatattgatctatttttttttaaaaaaatagctaatacttaattaatcacgcgctaatggaccgctccattttccgcgtgcaccgctcttggttgggaacctctagtagcgaacacaccctagttagacaataatgtcagattctccattattttattactcgcatgtcacacgagtgcaataatttaagtcccatgcttaacattttcaaatatttttgtaatcgtttctgtggtgaaagttctccagttctcacctactgtactcgagagttagcaatctccagcttaaccgacatactgatctgccagtccccattcaacgtagtttaaaactatttaccaaaaagcagcacaattggaaagtgcatccaccccgattactttcaagaccatgattgaatcagagtttgcgagtcctgacgccagacaagcagactccaactggtacttcctgtctggtaagatagccttttacacgtaatttcgaaagttcagttcaataattatcaaagcaacccccgtttgttagcacactttgccgtaacttttttttataggttcagtagttcagggaagatatttagaaaaatagcacggattctttctttttcgttcgatggattctattgttattagcacaacaggattaccaatacatgttgcacctcaaaagatagtactaagtaattttatcatccttaaaaaaatactactccctccgtcccataatataagggat

SEQ ID NO: 78661 - DNA, 694 bp, Oryza sativa
gtcgcagaatgaggaaggtgaggccggcgtgggcgcggtggagagcgacccagccgcagaggcgcacgcagcggccggcatcaccggcgccgagctcgtcacacagctcgtccctcgtaggccactgcagcggctgcagcctctcgagcttcgcctcggccgcggggtcacggtgttggtggccgctagggttcggagcggagacggtgagcacgaggcctacgtggtggaggtggtggtggagagcagaaggaggcggaggaggtgcgaggcgggcagcctagggttgagcggctttaggcgggagaggaaggagagcggcgaggcgcagagaagagaggaagccattagattggacttggagacggtgggaaagcgagtagacgaagagaagggggcctgggttttcgaggaggaagacgagatggcatcggatccggcggccttgaggtcatggccatcagatccggccactccgatggcagcgagcgggtagaccagcaagttgaagacggcggttgtcagactcgtaagaagaatggaggaaatttcagaaagttcagagtttcagttaactgaagatgcaaaggagggagaaaacgtttcatcctgggtaatgaagatctaagagatgagacaaagccacgtgttcgagagagggatccgacggtgttaacgtcatgagaagccgctg

SEQ ID NO: 78662 - DNA, 1646 bp, Oryza sativa
  unsure (1)..(1646): unsure at all n locations
tgcacccccttagctgaaatataaatatatcatttgattgatatttaggataatgaacaactagcagattatgccgtgcaaatttacacggactagacagcatctccagcagagcccctaaactaattaacccctaaatagtttttggggtgaaaggagaaaaattgagatccacaggacggcaggaccgctattaaagcccctaaaatagaaaggcaccgaaatctctgtccatagccctcaatcctagaggctctacacccaaccccatctctttttctttttggtgcgtgtgaaaattccctagcgcgcgcttctcccgttgttctcgcgctctcactgtgttgctaccctcttttcttttgtcgtgccgccggctattatctgatcaccatcttgctaggatagtccaacgttgccctgtccgatgtcgttcgtcaacctacgtgatctccacactgacacgtcgcaggtcgttgacctcatgcgtagcaactctagcaatgtctcgcgctagtagtcggttgtccggattgaaccattcatgtttgtagtatatgttattttaaaaaaatcatataattcttgtgaacttgcatacgtgtgtgattgtgaaaattgaattttattatgcattttgcaatgttgaaaattttgaatttaaatttgaattatggtattcaaaattataaatttgaatacggttgaattctacgtgtttgaattattctggtgttaaactagacataaatataatgtgcgtactaaaacacacacacacagagatggagcctaagaaatggggtttgtagctgaagatgggggcaacccccattagacctttagaggctttacaatagggggctaggggctgttgctggaaatgctaattggacttattgtacaacactatttaacttttgattccataaatataattatatttaatctatcttgtcaactcttaacttttaattctataaatttaattgcaatttatatacagtcgaaacgtggctacgaaccacggtgtcgggggttcgaatccctcatcgcccacagccttccaaagggttcacattctttggctctacctatctattatagagtaaatagctcttttcacaataagagttatccatacagtgacagcgtttaattatgaaagttggcctttcgtggttcaaaaacgcggaatctcgtctcaatcatcatttgtcaggacttttcgggggtaagttctttggcttggacaggaccccagtagtcctagccgtaaacgatggatactaggtgttgtgcgactcgacccgtgcagtgttgtnnnnnnnnnnnnnnnnnnnnnnnnnnnnnnnnnnnnnnnnnnnaatgaaacggctcattcttcaacaggcacgcggtcagagatcactttcccctcccactgcttgggagctcagcactgtttcacgttctatttcactaccccctaggggttcttttcaaaatctgtacgattttaccaatctaaattgagcaggtttccatgaagaagatcttgttcaacatgttctattcgatactggtaggagaagaacccgactcggtattcttaaaaaaagctcctcggtggaggagtagaagcgttggtccccttcggtcaagtg

SEQ ID NO: 78663 - DNA, 1133 bp, Oryza sativa
ggagggctggccttctatttataggcctcagacgtcggttgtgaaggtcggttgtagaggagaagatggagttggtcttggtggcggcgacgtggagaaggaaggcgacggcgccggctgtggcttgtgattggttggagatgtcggtttgctccagaggctgacgtcggcggcgtgaggtggcagatgacgtcggcggcgatgccttagcggcgacgacaggacgttggcggcgattgcttggcgtcgaaggcaatatggcggcggcggtagctgagttgtgcacggcggcagtagcgggcgcatggcggcgcctggaagcgcccacggaggaggaaggggcggctcggctgggctgggccgaagaggaagatgggccaaaaggaagagataaagggattttagcccaattaaatttagaaatcaattctaaattttgtaggttatttgtatgatagaaattggatgagattagtatttggaaggaatctgaatagggaattttgaaaggaaattatatttggatataatttccaaaagagatattttctagtttgagtgcaatattttgagagatagaatataacggaatttatttgatgcactcaaatgagagggagaggaaataaatggaggaagatagataggatttttagcctcaaaatatatggcatgggtttcaaagaattgtctgaggctaataggatatttggatagaatttgaatttaaagaagatttggatgacaaggatataatatattatcttagcacaagagcaattattcacaatgtttgtaataatattattcttgtgccgagaaggaaatcaagccacagaaattagatcaccggctagatcaaaaggaagaatttggatcaagaatcaaaggatatgtttaaggtcaaaggatgggctaacaaataatcccgataaaattagaattactttggtttaggttcaatggcaaaattgggaaggtttcttggatcataatccataaaaaatagtaagggttttgaaactaaatttgaataaaagaattttagtcgaaggaaggttttaaattaaaaccaaatcaagaaatacctcatttaaccaatatatttttaaatgaaaaacacaaaagaaatt

SEQ ID NO: 78664 - DNA, 1506 bp, Oryza sativa
ttcctgcagccctggcatttgagctcactcgatcgcctacataaagagcgggatagcttcgagctacggcatgcaattcgtctccagcgccctggcgacctagctagctccctcctccgccattgccacagaacacaccttggtgtcgtgcaatccatcgctcatggcgctcaccaagctttcctgcctcctcgtcgtcgttttcctcgccggcgtgacgtcgacggccaccggagccaggtacttcccacagaacggcacggcgttccgcgagaacatcctcgtgctgcccaccgacctccccgcccaggccgctgcgacgaggttcgcctccacgcaggccggcgacggcgacgaccgcgcgctcgctctcagcgtctgcctcggcgactctgcgccggcgcagtaccgcgagagcctcgccgccgcagtcgcggacgtcgtcgcaggctgcggcgccgccagccgccgcgccggcgcctggctcgacgggtgctactgctacctcgccgccgacaccaacatgacgacgtcgcccagcggggggagttccaccggtggctcgtcaccggagacgtcctgccgttcagcgacaacctgtacgcgacgttcctcgacatgagcaacggcgtggcggcgcggatgctggcgacgacggcgacgcaggcgatcgacgtcggagcagccacgacgacggggctggcggggcgcgtggtggcgcagtgcgccgcgggcgtcgcgccggcggactgcgtgcagtgcctggagggcgcggcgcgagagatgccgagatgcttccgggaggcacgtcgggaggagcagggagagggcgtcggcatcgtggtgagcgacgactgcgtcctgcgtttcgacatgacttcttcgccggcgcctcggacgtcaaacacctgtgatgggacttgcaagctgttagccttcgccttcggagcagcactagaatgatcgtgtcagtgactttaatttgtgctccctccgtcccaaaataagtgcagttttagcactgttcatgttcaacgtttgatcgttcgtcttatttgaaaaacaattataattagtatttttattgttgttatatgataatacatgaatagtatttatgtgtgactaatatttttaatttttttcataaaattttcaaatacgaatggttaaaatactggacacgaatatctatggttacacttattttgggacggaggaggtagtagtaataaccatcgctagctagcttgatggaatcatggtgcttgagtggtagaaataatataatgtctgtctggggggtagaatggttgcctatatgttagcaacttagtagtactaccatgtttctagtgctttcggtgacactattctagccggttgtgtgtttctctttgtgatttgcaatgctatgctcagctagctgaatatatatgccaaattgtcaccttgggaactaaatagagctatgtgatccattgtattgctgggaaaaatatatgg

SEQ ID NO: 78665 - DNA, 589 bp, Oryza sativa
atagttattctagaatcaggttgaatttgataatgacgacgtataatcaactcaaatatggatgacgtactaaaattctggtggaaacatcttcaatttttttaatagtagagatagagatatcaaaagacatctcttattagcatgatgggagtcattgatctatatggaaactaatactatctttttttaagatgaagaagctaatatttttttcaacaacaacatactccctccgtttcacaatgtaagtcactctaacatttctcacattcatattgatgttaatgaatctagacagtctagattcattaacatcaatatgattgtgggaaatgctagaataacttacattgctagaatggcttacattgtgaaacggaggaagtaattgtttttgctgttttgaataacccgtagcaacgcgcaggtatttggctagttatgagataaggaaaggatgagaacttgagaaggggttaggagaaagaacatagtggattagaggtattctaaccatctagattgtcacatgatggaactgctgccatatgagtaccacataggatcaatattgtcttaagatagg

SEQ ID NO: 78666 - DNA, 651 bp, Oryza sativa
actgctagatagcattccaaatgaaaacataactttgcattctttttggtgttaggactaatattacttcagcatcacaaatgcacacacaaatacacaacaagctagaaaatgcaagtacagaacacaggagatcacaagatacaacagatccataaacaaattcattgtgttatttacatcatactgatgcattgcatggatatgttcctgacaaaatatgctttggtgaattcacttcctgaattggaattttatttagtattttatagtcatttcatagtaacacttcaattgtcagttatcttgtgcaattgtttttgtactgctgaagattgatgtatctatttctatttatgtttgttaacagaaggaaattgagggcaggaaactactccaggctcatttggaaaagaaggcagcagctgagtcagcaactggttcatcctcatcactctcatccaattctttagaagagactccagaggttctgaagagcccagatcaatcttcagtaactatctctgatgctgatattaatgcatcaccttcaaagtttggtgccagtaaagaagtcactccagtaacaccaaccaccatcctaagcactgagcctgtgcctactgttgcttccaccctgagtaaagatga

SEQ ID NO: 78667 - DNA, 548 bp, Oryza sativa
gttcaagaaatgttatcctcacgtcgcattattttatcatttccggtggaaactgagagagaaacattggttaaagacaagtttgctcatgaacccacttgtcaatatcacatatcctctctttctctcttcctcttcttcctcatgttgttgccttctctctcttatctctctcttcctcttcctcttccccttcagtcaggagcgaggcatcgccgatgagcagcgatgggggcagaggggattgcggcaatgagcgacgatggttaagggagcgaagggagccgacaaccccgtcctcacctcctccatcgccacgccctccactcatcttcttccgcgtcactggatcacgcacccgcttgctggcttcgtcgccaagaactgcaagcgcatgggggaaggtgtgtcccagctgtcttcgtgctcctcttccacgaacgcctgcagccgccggaggaagggagtgaatgggacttcttcctttgtccgttggcctcaccacgtctcccaccagctcatcggcctctccgccattagcatcctct

SEQ ID NO: 78668 - DNA, 820 bp, Oryza sativa
caccgcggtgttttgtcgctctccaactagggatccccccattttctactttgtgttatacaaggatgtctagttcctttggtgtacttaaatacttgcctatttgttactggagaaaagatgatgtgctcatggcaatctcccaagtcccaatcattggtgctgcaaatccttcttctccattttattccactcttttctttatccagaagactgattggaaaaaaacaacccatgctcaagcaagccaagcatgtccataaagcatttagcttagggtttcctattgatcaaattcgttaagaccctattgtatttgaaatttcctgtggagaaaacagtctcaagttgtgaattccttctggaatatttttaatagggtgtgttatgctgggttacctggaatatgtactgaatgctggaaagaggtatccaaaagaatgaaagagaattagtgcctgcttacgttagcagtcatgattactgcttaatgatatttcctacttagttgcttcttttatcatcacataagactagttagaaactgtcttatctatttgaactttgcctgcataagagatattatagcattaaaatgatttaatgggagcacttatggaacttgattaattgccctttcaggtatgtcccatctgtgctacaagggttggagtggacttgataggtcacttgacaatgcagcatggaagttactttaagatatccttttttcttctctataatgctggcaatgaacatatgcaattttacatttttacatcatattcagttgaagatacatggcattattggtacttgg

SEQ ID NO: 78669 - DNA, 1532 bp, Oryza sativa
  unsure (1)..(1532): unsure at all n locations
cttcctcggctggagccagcagttcagttgttcggctgccgccacccctgttgccaggctccctacgaaggccacgagcctggnttggnaaacnnaaatcatgnacttnatagtttggtttgcattatgcattaagagaagtgatatgttatgtattgtaggaggtagtgtgcatactagttccatttcattagaacagtaggctagtaatgcagctcgtgttgcacaaacagcacaaaagttagtaaaacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttcttgggccaaagctaacagagcccacgacagcgcctggggcgagggacgacagcacgcggaaggcctcctgtagcccgttgacctcgcgcctcctggtcatcgacgccgcccaaggcaccatgcccactggatttgtgcgtgacgaggccaagggaggcaaatctggtggcgtcgcgcccctccgccgcccggcggcacatgtcccgtgctccttcaccgctaggagtgcttcgagcaagaataggggtggaggagtgctcgcgacaagaagtctacgaaaaggcaccgacaccggcgagaggtggcaagaagtgctgtaacgcatgtctttcaggctctcatcactcacctctcgtctcgctagcaatgtcacaccaaatcctcaacacctcagcacacattcaccaccgcgccctgcatcggcgacttgccagtcacggccaagccttccaggatgttagcagggaaaatcaccattggcctcttcggcgacgaggtccccgccggtgcgtcccggctcctgtcgcttggtgtcggctagttaagatagtgtggggctacatgcaagcaggacggtgtggtgtcacacccggccatcccggcgctgaccgaccggctagcggcgaagatggacgccgcacgcgcgcgcaatgcgatggggacaggagtggcgtccacccaactcccacggcatatggtgacggccggcgaggcagcggcggctgaacaactgagcttctagcttccgtcgaggaagaagcgaccgaacgggagagggagagagagaggaggaagagagaagcgaggaaaaagaaaaaaaaacaaataagtgccacgtaggacatgtggggttattgttttttcttttcactgacatgcgggtcccctaagtgccacataggatgaaaccgctatcaaacagccgagggactcat

SEQ ID NO: 78670 - DNA, 1384 bp, Oryza sativa
cgttccgcggccggggggctcgcatgcaagcctagctagcttcacattcccttcctttccccgcattgctgcgagcgacgctgcttctgcttgcttggttcgcttggccgccgccagatgcgatcttctccttcctctccgatcctctccttggcctccttcctcccgttgctagctcgtgcatggtggcttcttcttcttcttgcgccggtttggtgatccttgttgcgccggtttggtggtgatccgatcgaggacggaggaggagcgcgcgggggatccggtgatgggagaaaagctgtgaaatgagatggtggtgatgcgctactccccgaggtgggctgctgcatcacagattgatgattgagtagaaatctattatactacgtcgtcttttcttgtagatggtttctttgtgctgtttaatctgctttttctgtagagctttagtttttattttattttatttttacatatcacgtagaaagattacaggcttttttttagaaggtgaaaaattgcaaattttttgaaagaacgaaaaattgcaaattagcgtagatgcatttttttactctttatcttggtcgtctgatccatccacggattcgtttgggtctagctaagaccgaaaggtatcaagaagctgggaatatctgcttttttggacaaaaagacacaacaagattggagtttttgcatctactagttcatttattaggatagttcgattcttgcatatgagtggaaaagaacttataatagactagtcttgactcttgactatgactcttatcagttagatggatgcccaactgcgttgttattatacagcagtataagaaaaatatgtacttttgtcatttgtaggggaactctaatttataattactttctaccttgcatgtatgctatgatatgaacagaaaattttctttttgtttatctgttaatcttttcaaagggtcctatttgatatgctccagtgtaaaagaaaaacagactcatgccatatgtcctgcaaataatcctattatcttttagctaaaaaaaaaatcctcttatcttatagtctactgaaggcatatggtggcattcaggtgcaggtgtaaatgcagtcataatattcggcatgagatctgtctctgagctggtgtggtctccggatgagggtttgagcattaaaattgcagcgtccagcttaagtacaaggaaaacttctcttcattggaatgcagataccttgagcatagtaatatcttcacctcaacagagtggtgctggggagagtggtcatatcatagatgctacagtagaagacgcagaaaagatgccatcccagttacgaactcgcagtgacagttcagcgagagtattcatgtct

SEQ ID NO: 78671 - DNA, 1694 bp, Oryza sativa
cccttcagtcccctccccccgcaagcacaaggaactgcctactgtcatcgatctgtgtacgcatgtcttccactccacatgcttgatgagcccatgactcatcatcatgtcaattaataaccgctgccaccaccgctaacccgatcagcgtcttaattaactttctatgttttaaaatatagctatcactaaaaaaaaatatagctgccattttaagttcaaagttgaactatatattttaagatggagaaagcacatttataaatatttgacgtttagagtagggttcgatcaaagttttaaaatttaaaccgtcgaaagtttctcaaatgtgtagtttaaaaccaaatgaaattgtatatatatagatttacctcgaaaagtactaccgtgatattataaacctattgaatcttataattaaactgattctaatatgaaattgatagaagtgaattttaaagtttgaccaaaacttactgtaaacgtcaattattcattgccggagggtgtatttcaatttcttgttcattttcactagctatatatactatgtcgttgcttggtaatttggaagaaatcaaatcaataaaaatttcagtatagtccgttttagcgatatttcaataattcaattctgcatataacctaagccatacgtcacaattaccagaaccagacagaactcgtctaccatggtagaaaaacaagcacttaatttgatacgaatcattctcatgcgagctcaaagctcactggaagcaactgagacatccaaagtacatcaaggtccagcatagtcaacaaaactaggctggaaacttaagaacttaaccaattaatcgatgtccagtttaggtgtgatttgtgcacactccaacacaggaccaagtctaggaaactagtgaggggtagttggttcttgtgtaccaaacacctgcacagaatggccattacccatgtcatgcatggtttttatagcaattgggactagcttgcaatcatctcccagtgatccatatgcctctgcctgaatattaactcaccaaatggttcaagggatcacattttgcttcatattcagtagccatccagagttccccaagaagcaaggctgccatgcttctttaatccagtgctgcattttataagcagctttgttgccaattcagttgcataacctgcacatataaagagggactgcaggctaggtgtgctagaagcagaatctcaagctgtgagggagtagtaactgaattttgatcagttcattcagttgcatgtccttgcatgccatggcctgtctcaagctcagacatgtgtgcctcactgtggtgctcttctccattggtatctccagctgtagaggtaattaatctatcttagatccacttttaattaacatatgggatgcatggcttcttgtctttttgttcaaaagtaggactttggtcttgtttggaaatgatcagctttaaatttgaaaatgccatagttttaacgtttccagataggggtattgagggatttttcagcatatataatctgaaggaattttacgatccttgcattggaagtatcatcactccatctgtttggttctaagtaattaagtaactgtatttatctgaacaatgcagggcaaggaggagggggagcaggtggtggtggtgcagtagttccagggacacagg

SEQ ID NO: 78672 - DNA, 1897 bp, Oryza sativa
aaatagacacactattaactttttttgaaaacaaacaatgctcatagccaaaaaggtttattttttttataataagttatcagatgttcaattcgctttttccataattacagcgtggacaattgttctacaatttggtcagcttaggataaaattaacataatagtaatactgcattttttttcttatatttaacattattattacaaattatgcatggccggtgatctcctctgtctgtatattaccagtgtcagtgacttttgagtgtcgtacgttcgctcatcacccaactaaatgaagaaaaaaaacgtttaattatattaattaatcttgtggcaggtgatcaacgggtgcctgcaatcgatgggcatcaacgtcaccaccacaaccggtggcagcggcgccaccacgtcggctccggcggcggcgaacgggtcggcggcggcgaccatgtgcagcgcgccgtgcttcgggcagatgaccatgatgatggggtgcgtgaacggcatcttcggcaacttcgccggctacagcccgggcctcatgcagggagtccaggccgtcttccagatggcctgcggcaacgtcaatggccagggcggcgccggcgccgccgccggtggcggtggcggtggcagtgcaggagcctccggcggtagtggtggtggtggcggcggcgccggcggtgctactggtggtggcgctggatcggggaatgcttctcctaattcaggtaaaaatgttgggctagcagattaccagctaattagttactcttaactctccatttagaaatatattcgatgtttgataagatttgattaaatctttaaaattttgacctgtttaagacaagaaataaaaagagtaaaatcggcttgaaaatcactatcattactccatccgtcccaatatgtcacgtctggagatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgatacacaactctccaatagtacaatgcaaaagaaaggagttgaccttgttaatcatatttaccacatctttttcctcaaaaaaaatagaacatatttatccacggatataaacatatttattaagtgccacataaaaataatacaaatataaatcattctcaaaaggaaaaagtacaccgaaggtattgttccccaaccacaaaaacagatatatgacattccttaacttataaaaccgttcaccacaggtcttttggtgggtttgaccccgattttatctgatgtggtagctgagtcagcgtaggatccacgtggaccctaccagtgaacacatcatcatgctctccttctttcttctgtctctctcttgctctctttt

SEQ ID NO: 78673 - DNA, 807 bp, Oryza sativa
gggacttcactaggtagcgcgccttgacgtgctgctggttgtagccgcgcctgttcgatgggaagcagcgaaactcccagtcgacttgaggcatagccgggaccggacaccaatagtggaactccggtttggccacaatgatgtgctccccttgggtgaggaaatggaaggctccatggtggtgcacgacgtccaccgcatcccattccctgcgcgggttcagtgggccgctgaacaagccagggaccaccggatcgaagatgcgccagaacgcaatcattggccggccttgtgggacgggaccgacgttgatgattccggcgaagacgcatcgtccgtcgacgtctggatagaatgagagggcggcggcgacgatggacaacggcaacagcgctccggtgtggtgctcgatgtgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttagg

SEQ ID NO: 78674 - DNA, 3438 bp, Oryza sativa
tccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacacatgctcgtgtcgatcgatctgtataccacgtaccactacgactacgcaacaacacatgagtaggtttttgctctcaacatgttccgttttttcccactagaacgtaggttgtgctagcttttaattctggcacaaggttgttgcagcgatgtgcatttatgtgccagtaccgaccatgtgtaccaaactaatcggattgatcgatcgatcggtccaacgcgcgaggtgccggcctgtgcacgcgcctatccattggccgcgccgcggaatcgtacgtaccgctagctgctgggctcgatcggtcgatggaccggccggttccctttcgttgtcccactccgccggcgacaactgtgcatgccggaccgagacacgccggatcctcggcctgagccagcggccggccggggcggttccaccaggtgcatctcctttgatcgatcgatcgatctcctagacatcatcgttgttagtgatcaaagatgtgatgggcggtacgtgcagcattgattgctcggcgtgacgatctctccaatcggagcgatggagcggcacttacgacgagcagagacgggacctcctccgtgtcattaggaaaggatcgcacagtggacagatgatgacaattgacagtctggtaacaatgatgatatccttatattaaaaaaaagaagaatgataggtgatatatatactactacgtagcatcacagtataattgaggagaaggattttaatcactcaacggccggtgagccgtccagaactacgcatcgatcaatcaacgtcttttaacatcgactaaaaatgtttgcgtgccacggttactagcgacacgaatatatcgagtatatagtggagtactacgtgaagggatcaaatcaaggtggatgaagacgtaccgacacgccatcgccttcacgttattacatcctaacgctgtgcacagtacgtgcccggtgcccctcgatcgccctcgtcttataaatgcagaagttgacgcctggcgtacgtgacgggctgaccggcatgcatgcatcgcgtgtacacaggtgagggccggccgggagctagcaacgcactcgggacggcgcgctttaacgcgcggccaaattaagcagcgccgcggaacacacaggactcgaccgatcggcacgggcgggcgcgcgagctaggtgccgaggtggcgacgtcgcatgggcgcatgcaacgcccagcaggcacgcacgcgagagacccgaccgatcgacaaacgtgcgagcaattcgatccgtgggcccgaatcgggcagggggatctctcgcgatatcgatcgatagcgatcgagcgccgccggccacgcgaaacatgcacggtcgttgattagctacgagagcctacgactctagcaaggcataggcacacggaccactggcgccgcgccgggcgcgcgcgcggtgccgggtggccgatcggctagctataggctgctgcatgctggatcggaagggaataatcttaggtcgactccagatcgacgacttaggtaagcatatgcatgggaatgtccgtttgctgctggatggtccagtagatggtcctatagctcgcaacgtacgtactgccattaccagaaggaatggaatgcgatcgatcggtcgatttgccggaacactgcaattaatgctgcatttgagcaagttcaatagtatagccaactgttggctctaaatcatatatagccaatttaatagcccattcatataatagttatctataaaaatatacacattattaatacctagtcttacctctcatacactcataatgtattagagttcgtgttgcagccgacttcaaatctgtagcccgatttcttctctctcttctcttttcttctcgatatgtgattatagctggcttatagcctgctattgtacctgctcttatgctcttgcgacttgcgaggccggtttttggttgctattgacttgatttttagtctttaatctattttttttccgtttgaagaaaaaaaataaaagcattatttatcctttttattacatagaagatgcacacacatctcaacacacgcgttcaaag

SEQ ID NO: 78675 - DNA, 712 bp, Oryza sativa
aacattatagggtgtaaagttttgtgatgggataattgctagcgctgctgctccaacggcaccgaggacaaacggacggagagctccaccaaggcttgccgccggagataggccaggtgcatggtgaactggagcacgcagtcgtcgctcagcacgacggcgacgctctctcccagccctcgtgtgttccagcagcatctcggcatcgctcgcgccgagtcctgcaggcactgcacgcagtccgccggcgcgcggcccgccgcgcactgcgccagcacgcgacccgccagccccgtgttggcgccgtcgtcgaactcctgcgtcgccgctagcagcacaatgagtagctactgcctggtgttccggtcttgcctgcctgtagaaataatggcatatgagcgacagcatcagcgcgagcacgagcgacggaaatcagccagagccaggcctcggcacggcggcaagctgtgtcagcacgtagtcgtagggatacgactggcgctcgcggccccgactccatcgccgcgcgcccttcctacccggctagctccctgctcgtcccacgggcgtacttgcctgcctgcctggtgccggtaccccctagcctcctgtccggcgcaccgcgcacgcgcgacggccgcaacaggggagtcagggtctcagggattcggcgagttttgctgtgagtgctctcaaatattagcgagatgcc

SEQ ID NO: 78676 - DNA, 2598 bp, Oryza sativa
ctgtctagctatctcagttccagggtagcaccctctgctctataatcttgtagagatttcgtggcattaattatgtttcgagttgttaattagattttcaatccagccattattagtttgcgcaagtgcaaaccggcctgcaggctgcagctagaatctccagtttttaattaataaagtaaatatcaacataggccgaccaatccgtgctactggatttgcgcacagctgcacgtgtacgaccgacgaacgtgcgtcgtacttgcgagagtgtataccttcacatatgttcaaccatatagtaaactccatattgtagcatatctatttttacaagcaatatataacatcattgacttttatatatgttttatcattcgtcttatttaaatttttacaaatatatacaaatataggtaatgtttaaagaacatttcaatgataaattaagtaagaataaaataaataataattatattttatgtttaaagaacattttaatgtttacgtgcgtacgttcgtagtagtgagtgtacgtgcgttgtgagtgtctgcattgtactgtgtaattcttaaaaaaaataataatcatatttttttaataaaataatagtcaaacatattttaaaaataaacaatgtcgcactccctccgtcccataaaaagcaacatagtattaagatgtgacacattttaatacaacaaatctgaacatataggatgtgtcacgtcgtagtacgaagttgaatttttttggacggatggaatatattataaaaacggaaagagtacaatatatcttaggtgtagctatatttatggcgccatatttttcatcaaaaaatagtcggcatgtatttatattgtaagtccctaaattacatatgtaattttagtgtatttacaatgtaagtctcaaaattacatatgtaagtattaaaattatatatgaaaattcaaaaattacatactaattacatatgtatgtggggtataaatgaggtgtaactactgtgtaagtgactgaaaaaaaatcaactgtaacatatggcgccatatttctagcaactccgtatatctttagttttcgcataagaatacacgtatatggtcggtacaattatgcaactccgagggcaaagctagcgctgctgcatcacggcgcgttaggtcacgcaatgaactggataaccaaatctcatttttcatggcgtataatttccaaaatctcgatgaaagtgactggagtactatatgctagtagcaagtagtacgtatattaatttattttctatactagtacagctagctagggtgtggtgcagtgttagcaacatttcttgccgacatgtacacacttgaactcctatggctatggcgttcatttgagtatctttctgcatgcagctgtgtaaacattatctgtaattgttgcgtacgccaataagattagtttgtgctattattctctacaatcatctctgactaatctgtcaatttttctactgtgctactgcgaggaattaatgcacggaatgatcatcgtgttttcttacgacatattgctggtggcggggtgatcgtcctcacatcctgtgttgatagatttggctgatcagatcgactagtcgtttccaaatactcttttactaattggtacagttaatcgttaacatcgtcgtgcaggaaccccacacatacatacatacacacacatatatatatatattttttacctcgtttttcatatatagcaccattgatattttaacaaacatttaactattcatcttattaaaaattaaatatagaaaactaagttataattaaaaattttgatgattaattaagtcacaataaaataaatgataatcaacggcccctactaaaaatgacttttttgaatgggcaccccaatagtttacggacggatcataagtgttcgtgtatgtaaaaatcgaccctcatttttccatacagctccttaagatattcgtatgaaaaatatttttttcgaacagaccacttaaaatatccgcacatgaaaataagggtattttcacatgcgggactcttatctcacccgattgcaaaaaatacccctagaagtttcccactcctttttttattcttcactctctcattctctcccccccctcacccccactccactcctctcctctcccgctctctctccccatccggcggcggcgggcaacgatgatggtgagggcttcctcctccccccctcctcctctcccttctcctccatcccgacgttggtggagggttcgggcaacaggggagggaggaggaggggcgcgatggcgtggattcgacggcggccaccctccccccatgcaacggtggtggatcgacattggggaggcactggaatggcagattcggctctggctctagctccagcaacaggagcgggcagacccggctgcccctagccggcttcgaccaacgacggcgacgacgaggagggcggcggtttctagggttatgttttcgtgatttctagtttctttttttcggatttctatttttacgtgcagacgacataagcacccacacgcgaaaatcgtactt

SEQ ID NO: 78677 - DNA, 2388 bp, Oryza sativa
gcgattaaaaaataatttgttttaatttttttatatgtattcttactatttaaaagctaatactgaaaaaaaagtggtgaaaacatattaaaattaacttcaaattaagttaagtttcaaacttaaattttactttgacttattatttttttatccttttaagaccaccaacggggctcttgattttttttattacccatatatacgtgcagggacgtttgagattagggagcgtaagcagtgcggcgacgagtactaccactacagccaccacgagcagacgacggagcagcaatacggtgggtactatggcagcgaggagggcgaatacccaactacgactagtacgcttcctgcttcagactactgctacggcgccggcgccagcagcctaggccttcgctacagcctgctgcagatgctcatgctcttctccgcttctatggtgcttctgctgcttgtaatataaggaatacaatactccgatacagttcatcgttttatatctatactttttactattttttagaatatgtaaaaggattacgcacttttgtattaagaggtataaaatttatacaaacagcagcaaagaagagacgggaaagaaaggggaaaaggaaaatatatgaacttaagcctacttgctattacaatgtgacgactgaatgaccaaacaccctaactaggaaactttggcgataggggacaggcgagatgccaaagggtggcctcttgcaccatggccgtgacaaccttaggccagaaccgagaacggttgttgaacacacgactgttcctttccttccaaatagaccaagcaccaagagtcacaatcgtatcgaacccatgacgacgctccctcgaaactttgagccggcaagagtagtgccactcatggaaggaatcagcgccagaggggaaacactgagggaggccgaggctcgaaaggacagtccaccatagctggagggattcagggcacccaatcagaatgtgatcgattgtctcttccagttggtcgcagaagacaataggttgggttcggcagcccacgcttctccaatcggtcagtcgtccagcagcgtcggtgagcgaccagccataggaagtagcgatattaaatccaataaggcaatccagcgaaagagaaaaagaacgggaagaaaaacaaaaacatcaccgggaagccgccgccgacgtcgccgttggatccgccgcgggaagccaccgccaccagatccgcccgtaggaagccaccgacgctgacatcgctgccgttgctcatggtgggggagggcgctgtcgccgacagaaacaaagaggccgagagggagggacggccgtcgaggagagggagaggggaagggacggccgtcattgtcgtctctgctgctgtacctctctacggccgcaccgtgttggcaagacggaagggagagggagaggcgccgccagtagggaaaagagaggggaggggaggggagggggagaagcgccgccggtagggagtgggaatgatctagggttagggtttttttttttgcatggggggttttgattgatttggaaccgatctgagtcgtttatcaaaatgaacggctcagattgatcgagcgttgggccgacctccattgtcgaatcgcagcattgctgggccgcacgcgggccagcagtccaacacaaaacatggttagattttcggttacggcccacacggcaagtttgaggaggagtagggggatatcaattagactttagttgcttcctgggctgaacgcttgctcgcggcctgaggaaagcggaccggctcggttgcgggttgaaaaagaaaatgggctaaaaatggctcttataaaaaggaggatttttatttaaataaatattgaaattatgtttgtattatcaaaattagcaattaagatctggaaattctaagaaaatttcaaaaagtgtaagcaatatggagaatttaataaaaattaaatccaaccatataattttatttctcacacttattttacttgtaaattaacttaattatatacctacctacttagaaaatacccaaaaattctagaaaatatgtattttaattaattagataatgtaaatctttctcaatctttcctcaattttctcgtcttttcttcccgttgtaacacacggacactttttctagaatgtatgtcatagtttctaaaagaatattttaacaaaaaattggtaaacttttaaacttttcgctacaattttagtgcagtcatctgtccgccactaacttgatgcctgctgcaagacaacgatcaattatttttttaatgaactggcgagccgccaattttattgaacagagaaggagtaaaactgtacatacgcaaagcgcaa

SEQ ID NO: 78678 - DNA, 2330 bp, Oryza sativa
tgttgacgatcgttaatactgattttgatactcagtatcataataaataaatgtgaaaactttcgatggcctgtaacaaaattcaaagatcaactttcgatgatatgaaaccaattttgcttataaactatatcagtgatgggatcctatggcccctaggtatccctcaccggatccgcttgtacgccgatggtgtggtcgcattccttaggccggttgctggggaactagctgcagcacaagggatcctggctctctttggagaggcatatggtcttcataccaacttcaccaaatgttccgcaatcctgatcaactactcgaaggaagaggtcgcagccctcgatgactccctcacttgcccggttgaggagttcccatgcaagtatttgggtttgcctctctccatcaaaaagctgcgccgtgaggacctccagcctccaattaacaagattgcgcagtggctgccactgtggagatcaaattggctccagccagccgggcgcctagcacttgtcaaagcaatgctgagtgcgatccggtttacttgctcatcgccattccccccccccccgcgaaatgggtgctgaaagccatcgacaagatacgacacggctttctctggtgcggtatctttgcatgcggttggcaaccgcatgggggagaaggtctgcaaaaatcacccttttcgcatgcggccggcccaaccacatgcgaaaatgggattttcgcatgcggttgcttatacctaaattcagcaaacaaaaaaaaaataaaaataaaaaaacctaaaccctagcccgccaccgcacggtgccggattcgtcgcccccgccgcctgccggagttgccggcaccggatccgtcgcccccgccgcccgccatcgtcgccagcataggatccatctcccccgccggccgccgtcgtcacgggctccggatcggccgccctcgccgcccgccgtcgtcacaggctccagatcggccgcccttggcgccggatccgcgcggggcggcgccgcccgaggcggcagagccgcccccgccgccgtccgaggtcgtcgtctggtgaggaggggggaggggcggtgaggaggggatggcggtagtgccgccacccgaggtcgtcgccgccgcgggggagggcgccgccgccggatccgcgttgaaggagtacgggggagtcgccggcgacgacagagggaggtagaggcggcagatccaggcgagcggccgctcccgcccgccgccgcctcgcgccgcgccgccctcggccgccgctgttagtgatatgccctagaggcaatcatagagatgattgtatcacatactatgtttacatatttatccgacattgttccttgaaatagataactccttattggttaatgaatatgtgattctttcatgagactctttatgttgttttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttcgatagacccaacatgagacactgcaagagccatatgtgttgtgtcatcagtgatctcatttagtgttggtgttgaatctttagacctgagattatcatggttctcaacatgtgtagtagcttacttagggactgctaaacgctactccgtaaatgggtagctataaaagtagttttcgggtatgctatgaaacatatagtgggatatgaataatcaagatgggatttgcccctcctatggagagatatctctgggcccctcgatgttgtagattatgaaagtgcatggccatgccaaaggtgattgaggagtcaatcacaagttatataatctatcaacaggttcgagtgaatgattgagctattagaggatgacacatatctagccttgagcttaatcgatatcgtgaggcaaaggggttcatacaagtatacactagaggttcagccgatatgatctttatgtatgccaggtgggtcaatacgttctgctaggggccgctgttgacgcgtggaccgaaaaggagttttcgggttacagctgagtatatatgaacctatagggtcgcacgcttaatgggccggaataaggggattggatagagatccaatatgagcttaattcggatagggatccgaataggagtcctacgggccttggaggcccgagtgatggatcctatatattcgtgaggggcatgaccggcggaggcataacatcacgtgagaaaccctagccgtcactt

SEQ ID NO: 78679 - DNA, 708 bp, Oryza sativa
  unsure (1)..(708): unsure at all n locations
aaaagaaaaaaaaagagattagtactgacatatgggtcccatgagtgccacataggataaaaccgctatccaaacagtcgagggattcgatttgctccggtttttgaagatggaggaggccttacatctggtattgcagttgagggatactaatcaatcagaggcaagacttgagggaggcaaaatagaattattccaaaaagaatatacctccgtttcacaatgcaagtcattctaacattttccacatttatattgatgttaataaatctagatagatattaattaacattaatatgaatgtggaaatgctaaattgacttacattgtgaaacgaaggaagtagatatgattggttcgactgcagaggatccgtttccgttaacagtctactgaatatatccacatgttcgattaacgacaagcaaggcccattagtcgatcagtcgcacaccacaaatattctagggctgcttggttggcggttggaatgccacgccatggcgtaaaatgtgaaacagagaatgagaaatctgaggatagaagctgaaaaatgtgttagtaaaggaggatcatcagacaccggtctacgtaactatgataccccgcgtattcccggagnnnnnnnnnnnnnnnnnnnnnnnnnnnnnnnnnnnnnnnnatatttcttaaatggtgccttcccctctgcacgaattgtgtgttcag

SEQ ID NO: 78680 - DNA, 4387 bp, Oryza sativa
tcagcagtgaacctacctagcttggaatgccagaaatgagcagaaccaccaactgaaagacataataagatgaaacacgcgatcgattgatcgaagagaaccgaacaagctagacatgagaaaaaaaaaggaacataaattaaaacaatgaaattaagacaaaattaaaccaacagatatgcgggtcaccaaaatggagtatttgtgcctcctaaaagcacatagtaatgaataaagttattgaattattgttgtaaaaacaacagaaatgcgatggcagattggcatggataacgagcaaaactttgtcttcctatgtgtcctcctagattttgctttaggaaagatagacttgcaaatataagcatagacctgggaattcttttttttttccttgtgaagaaaatatacctataattatttttcacggaactaattaataccagtgaatcagaatctctcgtcgaggaattgcttgggagaaggaggattttaagcatatatggacacaataagatcgatcaaaattttagctcttggattcaaattttgtaagtgtacaagagaagagacaagagaggcggtgagatgttgaaacatgcagaaatcagggtatatttgaaatcagggtatatttattcgagtgcatgcataccatatacgagcccaaaatttatgccggttttgggccaaatacgggccttccgaacagacaaattatggtccttatatatttgcggtggatatttctataggtagaaaataaattatgttcttaattaataaatctatatactaatatatggttcgccatttttatatattaagatgccatgtcgagcacaatctaattaacatagtacagtataagttatcatatcctagctgccaacgaaatataatcaagatgttacctttcaaaattcaaacagaaaagaaggaaaatcgcagtatacatatagtagtacctctggtatcatataattaaccggaataaagtacttaccatacgacacagatacctttacataactggtgcaattaatacttttgccaaaaattaaaaaaagaaggttctgccttacaaaaacgccattagaattccataacacgatggggatcgatcgatcgatcgacgtccaacgtcgcacccgataataaacttaccaataaaggaattaggtaccaaaatttttttgtacctgaggtactactcccgtatctaagataccaaattttacatttaaaaatatgatacctttgataccttcttaataacgatgataaaattaccctaccaataattacaacgcacattccatacttatgcctataaaaatacagctccatcgcatgcagccaagacgcactcgcccatcgtcgtcgttgcacgaagctagctagctagcatcttcaccgccgcacaagcagacacagctagacgacgtcgtcaacaatggccaccggcgccgccgctgccaaccacggccgctgctccctcctcctcttcgccgccatcgccatggtgctgctggtgttcgtggcgacgacgacggccgcggcggcgcgagatgttcgtcgtcccgccgccgtggagaagaagatggcggctgtgatgaggcacgatgtccccagcagcgggccgagccccgtgcacaacggcgcgccgactcctccggccgccgccgacgagcccacggtggccgtgacggagcgtctggttcccaccggatcgaacccgttgcacaacatgcccagtcctctacaaggccgcacaccgaccaagaagacggttaattaattgagatgattccatcatgctcaattccaagtggttattaattaggaaatttaattatatagagaaattttatagttcttgagtattttttacaaatcttcgtaccttatatagtatcggaaatataaaatttggtatccctccgtaccttctcgaggaccgtaaaatctcttagatagatatgcatgtatcacagatgcttattataattattaatcaggtaccatacaatatgttttgcgtgagtaataaataaataaagagatttgcccctagttagtcgtactgttaatttatcatgtgcgtgattttgtatttggttttaatttgtgtgcaatggaagattttgagtttgaaattttcaatattggtatgttgcgtacttgcgtgttgtgttatgcgcctggccggaggtttccttgatattgattgatgatccctcttatctgacgatgtttgccacgtacgcattcaccactaacactgagaaactaattattttttttgatagactgagaaattaattattggtaacatatcgagaggattagattgcttgttcgatgtcaacactgagaaattaattattggtaacatatcaagaggattagattgcttgttcgatgtgtggaatttgctggtttactgttcattcttatcaaattcgctttaataataataataataataataataataatattattattattattattattattattactattattactattattattattattattattattattattattattattattattattattatgcgcgtgaagtactgaaacctgttgaaaaattaaggcattatattaagctgtgtgcataccttcgtctttgaacttcgatcggttttctgaactctctctccttttcttcgcttggtagattctctctttttttttctttctcgctggtaccgtttttttcgctgtttctttctctttttttttctttttcgctgtttttaccgtaccgtacgtaacgtaattagtttagattagtttttttactagtgattagtttactagtaatttttaattcttaactttaaaatttaaaaatttggacttgaaactttttaaatctcgagttgaaaattttctaatctcaagttgaaagttttcaaatatttcaaatctggacttgaaagtttttaaatcttgagttgaaaattttcaaatctcaagttgaaagttttcaattttttcaaatcttggcttgaaagttttcgaatctaagttgaaagttttcaaattttttaaatctggacatgaaagttttcgaatctcaagttgaaagttttcgaatctgagttgaaagttttcgaatctgagttgaaagttttcaaatccgagtggaaagttttcaaaatttgacttttaaatttaaatcttaaatcaaaagttttcaaatctaacttaaaaattttcaatctgttggtacaaaaatctcccaaaaaagaaaaaaaaatcttgagaatcttccctaattactagtcattagtagttaagtgggtgttaactaatagtactatagataattagggaggtgaggtgctcgctgctggcgcgcacgcgccagctagcagccccctgaggtatatatttcgtatgtatgcaaagaaataaagaaaataaacgttattgatcaaaagaagcccaacaagaaagcctagcaggctgcctccctcaaattcgaacccaatttacaaggttgcctaatttgtacattaactgtgctgtgatggcatgatactaatcgatatatacttggttggtagattgtactgcatatgttctttcacaaagtacatcataataaatcaagaaatttgctaaaaatcttgtcgcaagttctaattcaataagcagtactaaaataccatattgttgatcatacgtatcaaatattatgctcgcgtgttgtaaaatttttttttaccccctttccatttcgaatacccaatctcaaaatcttgggcccgcccggtatgaaatcgattagtccgatggtagttatggccgtaatggccccattgttttgcttatttgtggaataagctaattaaacaacatatttgtaaacgaaaaataattcataaatacaacttttatatacttgctcttagcaatctaaaagtaaaggttgaataataaacttcgatgaaaaaaccctaaaattaacttcaaatttaaggttgaaaatttaaattttagcttctattaagcgttgacttagtccaacgttagttactcatacacaaattgatctgtgcgactaactttcaaatttgaaactttcaactctaacttgaaaactttgaactcaaaattaaaagtattaattcaaaactttaaaaacctctagccaaattttaaaattttcaattcaaaatttcaaactttcagcttcaaattctactcatattttaaaactttcaaaataatttattttttcgtttttctataatagttaaataaaacgctaagtatactaggctaattagtgttctcgatatctccaactacaaaaataaataatttattatattattaagac

SEQ ID NO: 78681 - DNA, 716 bp, Oryza sativa
catatatttggatgctttcttgctgaatagggcggtaggttcaggggggcacagctctttctgttgtgtgttgtgatctttgtggttgcttcagtgtgtgttctgaaaactgcacaacttcacctttttatgcattgagatatacacaccagcatcagagcatcttgcaactgattaatttgcacttgttattatgatctatctattgattcttctcagagttcgagtacatgtgtttcagcaactgaaaagctagctagctcctttctaagcctgcattttgcatctgtttttttattctttttttattttttttgcagggtagtaccatcagcttgctgatctcagtcaaggacaagaacataacaagaacaaagtgaagctcaagatgatggtgcagatggagaagcttgtgaggcagtgcgacatggaggtcatgaagatggccatgctcaagcatgaagagactttcaagcagcaggttagatatatatcgatcaaacgcaaaccaaagatcacaatcatcatcactgcaaagaacaaaaagaaaaaactctaaaattctaccaaacaaaaccaacaaaattcttttcgtctcgatgcctctgaaggtgtatgagctgcaccggctgtaccgcgtccagaagcagctgatgagcgacctcaacaggtcgccgccggagctaacctgccggcggcggcagcggcgcaagcag

SEQ ID NO: 78682 - DNA, 508 bp, Oryza sativa
tctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaattggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctagatatgcgctatttaataatttttgatcccgaacgaaaattagggtgtgacaaagagagaccaagaaagatgggaacggtggggagtgaa

SEQ ID NO: 78683 - DNA, 1139 bp, Oryza sativa
gattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatattatgcgcactagtgctactcttatatataattgataactagagtttttttttcatttttgatggcatagcccctataaaattacttgcaagaatatatactggaaaacacattttcacatacaacaaaaatgccttttctcatgcgggtt

SEQ ID NO: 78684 - DNA, 2007 bp, Oryza sativa
atggttgagggtaaaatagggagaaatttgaatgagatatgattgattgggcaattagtactctagaattacaattatgtatgtatatatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccgggtcgtgcttgggccaggccaaaatgccgtgccatgggccgggccatcgggcctcgggccttttggccatctgtaatgtatatctaatcatcagccctcacatcattttcacaatattttaacaaatatgtctatcatttgtttgttttatgataagtattgataaaccctcatgtttcattattttcttttccttttactcctagctcgatcatcgaaaaaaatatattaaaaattgcttagtagttgccgtagcaaagcgcgtgaaatcacctagttagataaaatgttaagacaacttaaaagcaccattaaacttgagtcgtgttgtttcaacaaatttaattatatagagtagaacatcctattatcgatgggttgtaccataatggtatttgtatagtatgcgagacattgataccaagttatacgtagtcgtaaaaagatgggagttgtggatttttatactggttcaggctctaagatgggtaatagtcctaatccagtttgataccagcgatcaaccgaaaccaatgaaagagaaaactgtaaatttaccactgatttgaatcgttattttaagactgtcgctagtaaaagattaaaaaataacactagaagtctagaaccatcgttcaagtgatatcatcgcaaatttgagaaaactagcggtaaaattacaaatgcccaatggaagacaatggaatagatcaccgccccgcttgattcacccgtccgatccaaatccaacggtcatccttccatctcccccatccccacgcctcctctccttccacgagtcgccgacgaggcgaccacgccatctccatctcctccacgtctcgtcgccatctcctcatgcctacccactgctagggtttgcccctaagccccccaccctctccgccatggctctccctctccacgacgccaccacctccccctccgaccccgacgacctcggcggcggcggcgaggaggaggaggagaggctcgcctcgaagccgctgctctcgtccccgtccacctatccttccgcggggacggaggagggcgtcgaggagctggagctcgaccggaggtacgcgccgtacgcgaggcgggacgcgtacggggcgatgggccggggccccctgggcgcggcgggggcggggcggctggcggtgggcgccgccgtgctcttcccgctccggctcgccgcgggcgtgctcgtgctcgtcgcctactacctcgtgtgccgcgtgtgcacgctgcgtgtggaggaggaggagcgcgagggtggcggtggcggcgcggctggagaagtggagggggacgggtacgcgcggctcgaggggtggaggcgtgagggcgtcgtgcggtgcggccgcgcgctcgcgcgcgccatgctgttcgtcttcggcttctactggatccgcgagtacgactgccgcttccctgatgctgaggtatgtagtccttgatgattctacttctccacgggacgcctcctccgagttttgtgtttaccgttgcttgcttcatatctcagtagattgatattgtgaccaattttgtttacaaaaaatgataatatgtcacttcttaggtagcagcgcctaatggctggttggattatgaatgtcgattttgtactctggctgttgaaattggaaatacatattagagccgttctgcaatttactttatatctactgggtgagggttgggtaatgct

SEQ ID NO: 78685 - DNA, 550 bp, Oryza sativa
tttgcagcaaaagttcccatcaaaaaacatccttccaaaaagcgcaagacgcgacggtccgttcgttcatgcctgtgcacttgcaggcagcagttggcccgatctgggccgtccgattatacgccctccaaagcctccaaatatccttctccaatcgcaacgggcgcgcagccgcgcactagaaaattttcccccatatccccccagtttttgcctccaacccaagcctcctcctcctcctctctctccactctcctcactccctctccggctctccctcacctgctcaccgcagtgcacaccacaccatccagcgaacggagccactcctccaagactcactcactctctctctctctctctcttcatggctccccgtcgaggcatcccactcgaggagattggagttggaggtgggttttctagttttagtttctttgcctagcctctctctatctttttcttttcttttttttcttttttgcagttgtgcactgatttggggggttcttgatttgctcgcttcgtggcaaagatgaaagcttttttt

SEQ ID NO: 78686 - DNA, 597 bp, Oryza sativa
  unsure (1)..(597): unsure at all n locations
aacgacacaaangtccacggnataagtaagaacaaaggtgaagcagatctttgagcgtaaccaaacctcatcataatatccactaactattccgatacctccaccccccccnccccagacagcnaagtagaacgnctgatagnaaccnncnnnnnnnnnnnanngaannaaaaanaccnanaacaaccacaaacacnnncaaaaaaaaaaaaaaaaagccnncntctttttttttccccaaaanaaaaaaaaacaaggggaacaaaaaaatacgaaaaaagagaaacaaacaaaaaaaaaaaaaaaaaaacaaaaaaaacaaaaaaaaaaaaaaaacgaaaaaaaaccgaaagaaacaagaaaaaaaaaaaaaaaaaaaaaaaaaaaacacgacaaaaaacacaaaaaacaaacaaaaacaacaacgaaaacaaaaacaacaaaaaaacaacacaacaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaacaaagaaaaaaaaaaaaaaaaaaaaaaaaaaaaaaaag

SEQ ID NO: 78687 - DNA, 977 bp, Oryza sativa
acatatccaacacaatttaacatttttactgaaaggcaaacaagaatgtagaactatggtatatgatctgaaagtatatttaatacatcactctctaaattgcttcactttttatgtaattattttcttatgtatcatatgtaaatactgggctgttgcattcttctattacagaaggcacaactacaaatggtgattatctcctccctttcaagacaggagcatttcttgcaaaagcaccagtgaagccagtcattttaagatatccttacaagagatttagtccagcatgggattcgatgtctggggtgagtatcaatgacttttatatctttttattcatatacccttaaagctggcaagtgtttggcttgaaggccatgcaaggcagtgtctgccttgccaaattttacttctttggcttgtatttggccccacttggtttatcgtcaaattcttctaaggtttcttactttctttagcattggctctacttcattctcttttaaatacttggtaatgattatccagtgctatgcgccaagccatctatgtgctttttagaactttgtgagtttgatgtcatttttactaatcatatgctgaacaatttcaacttgtcgctccttcatctgtttaacttatctatatctcatgggaaacttgtatctgttcaaccttactgaatctcatgaaaaattttcaggctcggcatgtatttctgctcctttgtcaatttgtaaataaccttgaggtgatccatttgcctgtgtattacccatctgagcaagagaaggaagatcctaagctgtacgcaaataatgtacggaaattgatggcagtggaggtatatacatttatctttcaaaatcttaaaaatggttttcaccatccacattttctttataatccatttgtatcacctgaaatcttattccattctaactaatattacatttttatttttgttctcaggg

SEQ ID NO: 78688 - DNA, 6330 bp, Oryza sativa
  unsure (1)..(6330): unsure at all n locations
ggtataggacatgccttacaactcagaagggcaaatatgtattttttattttagacttaacggtcaacacacagtcaactgacggtagtggcatgagagggtgcgcaatttanagctaatgacatataagggaagagccaattttcagtggcatataagggatcaaatcaattttcagtgacatataaggaattctctcttaaatcttaggagtaaaaattttacttaaagtgtcgtggataaatctcagacgctcaatctttttgtgctacggtagtttttaggtttgccgtgaagccgtggacgcaggtggggggagacggtagcggaagcatcaatctttttcctacctcaatgcaaattataactatgatgagtagtaatattttatatttatattttttttaaggcacataatgaaaaacctccgatttattatttaatcaacaccaactgcaagtctgcaacagccgtgaacgacagcaagacagggaaaacaagttattgtgtgatcactgaaccctgtgaaaatcattttattttagcatccatccatcataggagtgcaacaaattaacgctaagttccatgctcagttgcagtactgaaataatgaatgaaagaaagaaagaaagaaagaaggaagggatgccaagacatcgttcagttataagataagaacagagcaagaattactaagacactgttcagttacatttcaggccataagtttctcagaccaaactgctctttatttcatctgaacaataaaaatggactgtgtggagtgatgcatgtggcttgcactagttaagacaaatttgtggtgccatcaaccgaatcccaagatagaagaaagtaaagtatcatattagcaagtaacctgttaaccataaagaatcagaggaatctgcagtcaccaaagaaagaaaataacctgcaatttctgcaaaattgagagctctgcataggaaatttagagcggcataaccaaacttggtaagaaaaaaaaaacaagaagtgcaaattcatggaaaataatagaaataaatcaacattcagacaattcgtaggctgcattcagcacagaacctcaacgttcaaactttcttcgggaaattatcaggaagccccgacagaaattgaataaccaaacatcaagttccatgaagataatccacgaaacgcaaggcaaacatacggccccatcgatctatcaataaaggtatgcttccatcaaacaaaatgtaagcgcacagtcatgcacatcaatccccacattatatatcagttgcaacacagggatcaataaactacttcaagtctcgaatcatccaaagggaaacagaaaggtatcaaatggtgtaacttggattgatattatctcagcactacaataccacacacagcaagagggggaaacgaacacaatgcagaggaagcacatgttagctaagatcacaaaataacttcctcttttgatagagcaatgtttccgaaccttgccgtcttctccgtctcaactctcaagggagacgccaaccttggggggagtagttcgatgcgccttgtgccgggaagcagcgctccaccatggggccaggtgattccgtccatttcccgcagtcgctgcagctgtactgcggttgctgcagcatcaccgggtcctggatgaacccatcatcgaagaagtagatgccgcccgcgatgccggcggggtagtgatccgcctcgtaggatctagagcagccacgcccgacgaacagcatccggccacccagtgagggcaccctctgccaaatgtactgccgacaccgagcccgctggcttggcaccatccggaacaccttgaacgccgacgtcggctgtccaggatgaggggagcacctcacgaccatgagcaggtcttcgcgggacttcactaggtagcgcgccttgacgtgctgctggttgtagccgcgcctgttcgatgggaagcagcgaaactcccagtcgacttgaggcatagccgggaccggacaccaatagtggaactccggtttggccacaatgatgtgctccccttgggtgaggaaatggaaggctccatggtggtgcacgacgtccaccgcatcccattccctgcgcgggttcagtgggccgctgaacaagccagggaccaccggatcgaagatgcgccagaacgcaatcattggccggccttgtgggacgggaccgacgttgatgattccggcgaagacgcatcgtccgtcgacgtctggatagaatgagagggcggcggcgacgatggacaacggcaacagcgctccggtgtggtgctcgatgtgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacacgatgaacgcgtcggggaggttgatgtgacgatcgaattggtaggtatcgaggaggaggtggtgttggggaccttgaggtggagcagtggagaggaagacccagccatcgtcgtacgcgccgatgtagcgagcgtaccgcacccaatccgggacgacggctgggtgggtggcgtagtcgctcaggatgcaggagacggcaggcccctcagcgagcggtaggatgagaaacggcagagcgggagaccggggcaggggagcgagctgctcgagggactcgcgccatgatcggcagacggcggcgaagtgcacgcgatcgaacttgcacgggaggcgggtggcgatctcgcgcacgagggcgccgatgaggttcgcccatggcggagaggcagccatgggagacgggaggggaggggaggggaagggaaggggaggttggcgactgggtggcgaatggcacgagatgctcacgcgacggtgtctgttacaagtttgattcccttttttttttgcttctggaagccacggaacggaaggggagggtgttaatactgcaaggaagagaggatggggaggagcactgctccctccgtcccataatattacaacctaagattgaatgagatgtttcatagtacaataaatctgaacatgcatctgtccaaattcacatctatctagattcgttgtaccatgaaacgtaccatccagtcctaggttttaatattattggacagagggagtatacttcaagcaagggaggatggcggatggctcgtttggcccacttgaacatattgttcatgatgggcttgtgccgcaagaaagataaggaaagttcgcttggcacttgagcccattgttcacttgttctcgatgggtttgtagcggcccattcggttgggcctattagattattggatctaagttcattttgactccctcaaatatagctccaatctgattcgtgtcccccaaccgtaatatcagatatctagacacccccccctcaaactattaaaacccatacaatttgactccctcaatagttttagagtgtatttttgctgacatggcatattgacttagtccactatgttgacgtgtcagcccagtcacaaaaatacaggtgaagcccacatgtaagtgactaggaaaaatatataaaaagtgggacccacttttcatccctcttctccttctctatcttttccccaacaagcagcagagcaagaagcggtggcagtggtggtgtgggcagaggcaacagaaacagtagtgacgttcctgtgggtgctatgcgtgtcgacactgcgggcctcaatagcggtagtcacctcctacctcaacatctaggaagggatccactacgctctctttgtcaccgtttgccacctcttcgtgctcctcttcgcctttaacttcctttgtgacgtcctcaacggcgccagcttcaaccttaccgccatcgccaccttccacgccaccaacctcgattggcacttgggcagggtgcaagggcagtgggtggagcgctggcaatctcagagctgatgccaacgcagtacaagcacatactcgagggccatcctcaaggtggatctccacactggtggtgccgttgagttggtgctcaccgcaatcgagctcgtccatggcgtcgccgcgacggtggggagaggaagggccgccgctggatcgaactgcaagagccaccaaaagcagccccaccgtattctccaccgccgctctgcatccccgctcgaccaaccactccgcgacaaacgctagggcgaaaggggccagggtggagagagaggagagccctacttgtcgtcccgccgctgccgcttcccatcgtcatcctggcgccctgctactatcgagcctagaagaagataggcagagagggaaggagagagagattagtacatagagggtgatttgatgataggtgggccccaccttttttaaaaaaatatttgatgactagggtgccacgtgaatgccacgtcagcacaaaggagtaaaattgcaacggttttgataatttgggggttgagatatccagtattgtggtttagggatacaaatcggattcggccaatagttaagagagttaagtggacttattcctagattgtacctagactaggcgtatgatgactgtacaagaagagctaaaacaactccaagtatgaagcccattctaaatttagaaagaactatctaaatcaaaacgaggtataatagcttttggttggaaaaaagacagacgagaaaatagcttttttttctctgtgtaattgtgtgttgctaaatagttatatagttacgtaaaagtattatattattctttataagtaatgaatttatttatttaataagaaattttaattatgttcttttaagtttagccatgtttacgatattcttttttaagataccgaaaggtgttcttcaaaaatttgattattatagatcacgtttcttttggcaagggaatgatcataagaaaaagtacaaactcattagatgggatatcatttgccaacccaaagaccagggaggattagggattcacaatctggaaattcaaaataaatgtgttttgagtaagtggttgtttataaattaataaatgaagaaggtgtttggcaagaattattgaagaggaagtatctttataataagtctataatgcaagttgataggaaataaggcgactctcatttttggtcaggtctcatgaaggtcaaaagtgatttcttaaatatggtttcctgaaatgtgaataatggggagcaagtaagattttgggaagataaatggctaggaaatttggcctttaaggataaatattcatctctatatgctattgtccgaaggaaaacctcttctattgctaatgtcatgggagctgttccgcttaatgtttcatttaggagagccttagttgggcagaaccttgcatatgggcatgaattgtgtgcttctaatgtgcatatccagttgaaccattcttctaactgttttagatggaattatcatcagaatggtcggttttctgttaggtcaatgtatctagctttaattaataatggttacatcgagaggaataagtgtatttggaagcttaagatgccacttaagattaagattaagatctttatgtggtacttgcttaaagatgttgtgttaactaaggacaatttggcaagacggaattggaatagtagtttaagatgtttgtatgaaaaatgagactattcaacatctttttatggactgtcattatgcaaagtttatatgaagagcagttcagttctcattttgttttaaccttcttactaacatatctcatatgtttgatgcttggctaatgggggttgacaagaaaatgagtaaactgatacttgtaggagcatctgtcatatgttgagctctgtggttgagtaggaatgatatggtttttgacaaatcaccatctatttcttataagcagataattttcagagcaacacattggctttggttttgggcacaattacaaaagtgtgaagcagatgaagagcatctgaaagttgcgtgtcgt

SEQ ID NO: 78689 - DNA, 1619 bp, Oryza sativa
aaattcaatttttggcttactacggtccaataaatccacttggatcgacttccattttatctatatttaacaaatgatacataaaataaaataaagttgaccgaagggagtacttatgccatataacaacaaaaagaaaaaaaatggcaagaaacattcaggataaaaacacagagcaatgataaaaataataaggaaaaatttaataaagaatgttgtgacttagcggttttagctgtagaacatcgtacaaaagtagcttttggaagaaaatactctacaaacgtaaaaattaactcatggatgccgtacctattaaaatattgatttctaatttgatgggagagaaacaatagttcacaactttcacattgttcctctcccctatttaatcataaatcacctttatagtgtttttttctaaagtcacttgtgtaatgtcgtacggtgaagatatcgaagtcatgatgtcatgtactcatgtaccaaattttgccaaatacctatgtttacgaaccaaagtcattgataagagtcacgtacgtgtaccaactacttaggcacttgggtagtacaaacaagacaaaattttgagctattttcaagtacttggacaatctacctatatattatgtccgattttccaatctgtccccacaaatcgagagaagggggagagatcagtacaagccgcaccatggcgaaacaaagcaacataattcttcgtgcttatcttttcctctctcgctcgctgtggatagcgaaagaaaacgaaacgaggaaaagaaaaataaaaaatggtccccgcgagcccatctgggccgtccggtcgattccgcctcgtccccgatgcacggctgccgttccaccacgtcaccccccgggtggtaagcggcgaccagacaccgccgtgggcccccacgtcccgccatcgatgacaccggggacccaccgcgcggtggtcccacctgacagtgacgtggtcgggtgacggggttcgttgagtcaaaaacatgtggcctaactaataagctggtaaagttctacacgtacacgtaaacgaggactacgtgtcaatgactcgtgggccccacggccttggctggtgaccacgaatccgctcgggtccacgcttgtggctgacatcggggccccgcacgtgagccgccgcgccgcacgtgcacgacgggcgagaaagtcttcacccaaccccactgacacgtggaccctcggaatcattcccggtcccaccgtcagtgagagggggacgccccacgtgggccccacgcctccccgaggaggaggaggagaagcatatgagagagaagagagaagggcaggtgaggtgaggcgaggcgaggatgtcgtgacgacggaaaaacggagcagccgaggcgaggaagccgccaccgccaccgccgcgaccccaatgcgcgcgcctcccgccgcctcagatccccacccctaaccctagcctccgcctccgcccccgccctcgggccgcctcctgctgccgcgacgagcgcgccacggccgtcgcgggcgaccccccggaggcggatgcgatcgggcgccctcgcgtagcgcccccgggcttcaccttctcctaggggtagggg

SEQ ID NO: 78690 - DNA, 857 bp, Oryza sativa
gcgtgtaatatgatacgactggatatatctatatatatatacacacacacacacacacacacacacacatatatatatatatatatatatatatatatatatatatatatatatatatatatatatatgtgtgtatatatatatatatatatatatatatatatatatagatatagagggggatatagagggggatatgggggggtatggggggggggtgtgggggggatgtgggggggagagggggggggagggggggggggggatgggggggtgggggggggggtgggggggggggtggggggggggaggggtggggaggggggggggagggggggggtaggggggggggggggggggggaggggggggggggggggggggaaaggggggggggggggggggggggagggggcgggggggggggggggggggggggggggaggggggggggggcgggggggagggggggggggcggggggggggggggaggagggggggggggaaggggggggggggggaggggggggggggggggggggagggggggggggggggggggggggggggggagggggggggggggaggggggggggggggggggggggggggggggggggggggggggggggggggggggggggggggggaaggggggggggggggggggggggggagggggggggggggggggggggggggggggggggggggggggggggggaggggggggggggggggggggggggggggggggggggggggggggggggggggggggggggggaggggggggggggggggggggggggggggggggggggggggggggggggggggggggggggggggagga

SEQ ID NO: 78691 - DNA, 3244 bp, Oryza sativa
tctctccctcttttcccctttttcctcccgccggcgtcatcctcctccctcctccctgtcgccgctttggccgcgaccgccgaacgctagccctctcctttgaccgccctaagtcggttcccaaaccgacattaccatcctataaacccaagcttccccctttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgcccactccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagcagttggctcgtctcccctcgtcctgtgcaaccacccggtgtgctcgctttcgcctgtatcgccgtggttcgctccgccgctcgccgctgtcgtccgccgtccgtttcggccggcgtcgtcgtctacctcccgccggcccgcgtggcagccacgtaggcgccacgtcggcgccagctcggccaaaaccgggtcgagtcgaccccggttagccgctccctccccatgcgcgcggtccaccgcgagccgtgaggctgcgcgtgggcccgccgcatccgcgtctccgcgaaccgcgcgcgtgcaccgcgtctctcccccatcctagcgccgcgccgcgtgctccctccgcacggtgagccgagccgctgacaagcgggtcccactcgggaccacgcgaggtgagcccggtccaccggctctctctctcctcccctcccgcgcgcgcgtgccttgggccgccttgggccggccggcccatttagctcggccgagccgccccttttctctcgggccgcgccctagccgtccgagggaagtgtaatttccctccctcttttcttttcttttcttttctttttcaaaaaggatttaattaaatccttttcctgtagaccaaaaatccaataatattagaaattcaatatcttcccaaccgtaaatccgtttgactccgttcaacttccaaaatccctcaaatcttaagatctatctaatggcatgcttagaggtcattaatagggctttattttcgccgtttgttgagttgtcccgttctgcgcgtagtttcggagcccgaagacccgcagtgcgaggatttcgaggatcaagctcaagatctcgagcaaggcaagccacctttgaacatttcgagcctatatttgaatttaatcatgttgcttgaaaaatattatgcattgataggatcgcacttaatctgtttgtcccgtctgcaaggcagattgtcggacctacctagtttgttgcatttgatccttcctttgttaattgttataccatgttcccttgtaaccacccagttgcgcctcgaaaatcgtgcactctgcacgagtatcgacgatcgccttcaaacttaaaatctgaaaaacttcttgggtaaaacttgggttttacaaaagacttggaaaacccgacacctgggtcggtgcttgcgaactaaatgaattttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggtttcctggcacagtatggtctgggacctaatctgttgttggtctgggacccctctcgtcggcatatggtaaacctgtgtcggctttgaaaatgccttgtcatgaaagcttggaggtctcccgacgtggctgatccacacgggctgggtgatccgggttagtaatgtcgtgtgggtaaagtgtaccccctctgcagaggttaacaaactgttcgaacagccgtgcccacggtcatgggcggatgtgaggtgattcctagtgtagttttgtttgactactacttgtgaaattgctgttgtggaaaggggttcgatgtttaaaaaatctgcagctgatgggatcagctaggcccgggtggccatttgaaagttgttggcccgggtggccgtttgaaagttgttggccgggtgccaatcttgatcaattctaaagactgatacatttgcacatactccgaccggacgagacgcactgtctcatccatgttgtttgagaagcactcacttagttgctttcagaaaagagttcaaataaaatcaattgcaaaaacaacagcctttccttgaagcctgcattaaacacttatttcccatggcttgctgagtactcccgtactcacacttgctctatataaataatctcccccccagttgctgaagaagatgaagcggatcccgctgacgagaagttcttccaggagcaagccggctacgatgagttttagggtttcggcctagttcccaagtcgcgcctgtgttgtttggtccaagtcctggcttccgcttcccttttgtaatgcagttgtgagctcgggatctgtccacagcctgacttgattgtactcctactctataataaagagacctctgttgctgtgatattatgtcttcctgtgataccagcactgtttcctgggactggtatcgattaacaggttaatttggagcgtcacgggctagtttcggtcggtactagttcggggcgtgacaagttttcaactgtatgtgttcaggtgttcgattacatcagtgtttttgtcaaagctaattcaccttgctgttcatatctatccatccattataaaagatttgaaaatatttaacaagatataaatatgcgatatatcgct

SEQ ID NO: 78692 - DNA, 666 bp, Oryza sativa
tccgtgtccatttgatctcggctcttgggccttagctgggtgctacggtgccagacaataataattttgggctctctacgaacggtctgcacgtcactggagctttgtgtttgttctgtccagcatcggctccatctgggaatcgttgtcgagccctattcaacgactgggtctccaagagagaaaatgaagcatttcttatggttttgttatacgtttgtcgataattatttcattaaaatcacacatatgttggtgtaattaaaatatactccagcatgcaactgtaactagcatgtagtaaatagtagaatataagtcccacgtaaatacagaaacatttctattgcgtaactcggttcttttatttgtatgggactatatactacctacattgtaatagttatattattattattattattattattattattattattattattattattattattattattacattcgtatgattttaatgaaatgaattgttgataaatttatagacagtcccaagtatcctctcaaaaaagaaaaaggtgaacatcaactattttgtttctttcgatcctgctgtaaaaaaaaaggtcttctcccatcaagccgcagattgtagtagttatccttttccactgccattttaggtaaaagctgttaaaa

SEQ ID NO: 78693 - DNA, 14570 bp, Oryza sativa
ctgcacgggtcgagtcgcacaacacctagtatccatcgtttacggctaggactactggggtcctgtccaagccaaagaacttacccccgaaaagtcctgacaaatgatgattgagacgagattccgcgtttttgaaccacgaaaggccaactttcataattaaacgctgtcactgtatggataactcttattgtgaaaagagctatttactctataatagataggtagagccaaagaatgtgaaccctttggaaggctgtgggcgatgagggattcgaacccccgacaccgtggttcgtagccacgtttcgactgtatataaattgcaattaaatttatagaattaaaagttaagagttgacaagatagattaaatataattatatttatggaatcaaaagttaaatagtgttgtacaataagtccaattagcatttccagcaacagcccctagccccctattgtaaagcctctaaaggtctaatgggggttgcccccatcttcagctacaaaccccatttcttaggctccatctctgtgtgtgtgtgttttagtacgcacattatatttatgtctagtttaacaccagaataattcaaacacgtagaattcaaccgtattcaaatttataattttgaataccataattcaaatttaaattcaaaattttcaacattgcaaaatgcataataaaattcaattttcacaatcacacacgtatgcaagttcacaagaattatatgatttttttaaaataacatatactacaaacatgaatggttcaatccggacaaccgactactagcgcgagacattgctagagttgctacgcatgaggtcaacgacctgcgacgtgtcagtgtggagatcacgtaggttgacgaacgacatcggacagggcaacgttggactatcctagcaagatggtgatcagataatagccggcggcacgacaaaagaaaagagggtagcaacacagtgagagcgcgagaacaacgggagaagcgcgcgctagggaattttcacacgcaccaaaaagaaaaagagatggggttgggtgtagagcctctaggattgagggctatggacagagatttcggtgcctttctattttaggggctttaatagcggtcctgccgtcctgctggatctcaatttttctcctttcaccccaaaaactatttaggggtttaattagtttaggggctctgctggagatgctgtctagtccgtgtaaatttgcacggcataatctgctagttgttcattatcctaaatatcaatcaaatgatatattttttttcagctaagcagatagggattgaggatgtgagcgagtgcccccacctttgtgcactagcttacggttatctgaagaagactgagggttatgaacaaaacctactcgcgttcttccataacaaaataaactcggacgctcttctcgtgctgttgattgaggagctagacaaatgtatactcggctacttctccttccattggaaatttgccactgaagtaatcacacaggtaggaaagatttactcatcccgtgttctgcattaccaatcaactgttagtccttgagatactctaaacactgaaatgttggagccacttaatttcttaggttctaacagcagagcagcctagaagaaagctcaaaaccatggtgttagaagccactaggtaaataatcatgctttattaatctggaatattttttgtaagaattaaccaggattgattctattgattttggtacaattatgatcaagaaagaatgaaatctggttcttaattgttttgtttcttccttttttggacaaaaagaaagatgaggtttgagagggtgtcaaggaagctgaaggtgacgaggctgttctccacgctggtggaggaactgaaggtcatcggggtcacctgcaacgacggccagctgcgcgacgccgacgccgacgtgatggtcccggcggctcaccgcgaccgcagcccggtcctgctcctgatgggcggtggcatgggcgccggcaagagcaccgtgctcaagcagatcatgaaggggtcagtccgttcgtccacttcgatcacggactcgagcaggcacgcgtgacgcggcgattgagctgaccaccaccgtggcgtacgtgcaaaatgcaggttgttctggtccggcgcggcggcgcacgccgtggtggtggaggcggacgcgttcaaggagtcggacgtcatctaccaggccatcagctcgcgcggccaccacaacgacatgctgcagacagccgagctggtatacgtaccacgcttgccctgaacctgctcaatcgtcagccggatcggtctgtgtgggtctggatgtgtctgacacgtacggtgtcgcgtgcgcaggtgcaccagtcgtcgatcgacgcggcggcgtcgctgctggtgacggcgctgaacgaggggcgggacgtgatcatggacggcacgctgtcgtgggagccgttcgtgctgcagacgatcgccatggcgcggtccgtgcaccggcagcggtaccggatgggcgtgggctacaaggtcgccgccgacggcaacgccaccgagcagtactgggagcccgtcgagggcgcccccgtgcccagcgggaggaggccctaccgaatcgagctcgtcggcatcatctgcgacgcctacctcgccgtcgtcagggggatcaggtaattaaccaaccaactacaattaacgtgttcacgcgcctgatcgagcctagctgacacgacacgatcgatcgatcgatctacccgtgcgttaggcgagccatcatatcggggcgagccgtgcgggtgagctcgcagctcaagtcgcacaagcggttcgccggctcgttccgcaagtactgcgacctcgtcgacagcgccagcctctacagcaccaacaccatcgccggcgcgaaggtattattcctaacccgttcaccgatcgattccccgtgtgatgataccgtgctgtgtgtttgagacgttgtacgcgtgcgtatatatgtgcgcgtgcagttgatcgggtggaaggacgtggggagcaggctgctggtggacgtggaggagatcgggctgctggacagggtgagcaggatcaacgaggaggccaacggcgtgcacgagctgtacccggacggccacccgacggacggcgccgggtcggtgtgggaggatctggtgtcgtcgccggccagggccgcgatacagcgggagctcagggaggccatcctcgatagcgaggcctgcttcccgtcgccgtaggctgcacagcagcaagaggctatgtaccgatgcagatttgttggttcgttcgttcacgttcgctcacgacacgatcgtactatacgtgtcgtggtgacgtagtaggtaggggtgatctctttgtttttccgtacaccaactctactgtttgatgatggtatcgacgttgactagtcgaccgatgccatccgtcggcgatggacttttcgggaatcgtgacatctgtcacgtgctgatgcgctgatggggccatcttacacaggcagccctcgacgcttagggccatcttccttgaagaggttagaaacgtattaggcctgaaaaggggcccgagtacagcgctgcaagagaaaagaaggtagcagcaacagcatttcggccctgtttcgctatttgaaatgcatgattttttttattttatttttgtgaggattgaaatgcaggattttttttactttggtcaaacattgacatcatactgtatctcacacgttttctttgagtaattgtctatatgattcacatattctagaactgcactatagtaaaaggggtattttttaagagaaacagtaaaggagtaataagaaggtcctttagaaatttatggattgtccactggaggttttcactgatcttttctggaactagccaggttcccttggcttgtaattctgcatccaatgtttttggagagcacgcaaagtagtgttgatctctgtgaaaaccagtttcttttgacatccttaagaggaatgcgacaaatgctaactcaatgttcggttgcaaaaccaaaagaaagcaagaaatggtaagaaaatgttcagttacaacggcctattcagaatgcgagtcttaagggcctcaaacaaaattgctctctatttcacctgaaatacaaaaatggactgtgacctgatgcatgttgcaagcacagttcagaatgtttacatacttacttacctcagacgaaaatatgataccaacaaaatgaattaatcatgaacgtaatatactatgcccaacttagcaagcatcatgtcttgtgcattgcactaccaggtaacctcttaaccataaagaatcaacagaatctgcaggtaccaaagagcaaaaagacaacatgcaattctgaattctgcagagttgagttttcaataggaagttcagagagggataaccaagcttgaccgaaaatttaatcaatccatcatggtaaagaatacaaaagaaatcaagattcaaccattttgggttctgcattcagtttagaacctcaatgttcacgcttcattcagtaacttttcaagagaaccagagaagccctgacagagctacataaccaaatatcagaaaccataaaattccaattcgttcaaggcaaatgtgcacaatcatctatcaattaaaacgttgtgcactcgtcaaagaaaatataagcacaagtgcacaaccatatgcacatgtccacactgaatatcagttgcagcacaggatatagatatactaatgactgaatcatccaattaagtgggaaacacacattagcaaacggtgcactgcaattgtagtacacattgatcatagctgcaatagccaagagatttatactagaaaaaggtgttctgcttctgctaatggttggagactaatcagaaactacaagctcagcactacaatactatccaaacttccaaactcagcaaaaagaaacaaagacaatggagacgaagcacacgtcggggatcacaaacaagcttacccgttgagcaaccaaacttgagaggagtagttcgatgggtcttgctccgggaagcagagctccacctggagtgcaggttttcccgtccatttcccgcagtctctgcaggggtaaagcgccggtgcgccgccgccctgcccgggaatccgatgatcgaagaagtagacgccgccctcgaagccggggtactgatccgtgttgtacgatctggagcagccgcgcccgacgaacagcatcctgccctccagcgagggcagctccctccagatgtatcgaaccacgtcgccgtcggatctggagcagggatccccgacgaacagcatcgtccggccatccagtaagggcgcgtcgccgtcgccgtcgtcgtcttcctcgggctgtgccatccggaacaccttgaacgccgacgtggactctccgggacgaggagagcacctcacgaccatgagcagctctccgctggactccacgaggtagcgcgccacgacgtgctgcccgtcgtagccgcgcccctgcgacgagaagcagcgatactcccattgcacttgaggcggcgcgttcgcttcgtcatcgaagcccggattgcccacgacgatgtgctgcccgttggtgaggaaatggaaggctccattgtggcgcacgacgtccaccgcatcccagcacgcgtcctccatgaagaagcagccgatgaccaccttatcgtcaattcgccagaacgcaatcttctgccggtggtggcccggtacgggagcacaattgttgacgaatccggcgaccacgcatccatccataaatgggtccgacgagagggtggcggcgttgatgaacagcgggtcgcgcgggcgcagccgcttctgcctaggccgcaatacaggctcttcgcggtccaactggatccagacggggagaacgaaggtattcggggtttggtggagattggtgaggaaataatctcgataaccctgagctcgaggatgagcagtggagacgaaggcccagccgccgtcgtacgagccgaagtagcaagcgtggcgaatccactccgggacgaagaaggggtgggtggcgcagtcgctcaggacgcaggagaaggccagctgctcggcgagcggcaggatgagatacggcagcttggggggcgggagcaggggcgggagccgctcgaggtgctcgcgccatggtcggcagacgccggcgaggtgcacgcggttgtacacgcaggggaggcggttggcgatctcgcgcacgacggcgtcggtgaggtccgcccatggcgggaagtcggccatgagagacggagacggtgggggagggaagaggaggggaggttgcggactggggtggagaagaagaagaccagagggatgggaaggtttgattcctcttgtagcttcgggaggagggagctgtgtctgtcttcggagtggattaagggttggtttggtttgttgcctaaataggtcttactaaattttgtcagtgtcaaattttggtaaggtaaagttgtgtttggattgaagccaaaatagcctaagttcactattgaaatgacctatttttttaggcatgtcaaatttggcttcaaaccaaatagacactaaacactattaaaattgtcaaatattgataagcctaatttagacctcaaaccaaaccagccctaaattactttttatactgcaatgaaatgggccggggaagctagggctgtctggacccacccactagggctcgtgtgggcccgtactgcccataattcaagaaacttaacaaacccattcattttcatctcgaatcaaattaaaagagactatgtcgtcatatttttcacagcatgtactgtacctaaattacatgtgtaattctaatgtaagtctcataattatatgtaggtttataaattgcgtatataattttagtgtatttacaacttaaataggagaattactaatactgattaattaacaaataacataaataagggaagagacaaatcagaagagaggagcgagggatatctctgtccatgccggccgtgatatacggatgtgagtcacccacgacgcatgcaaagcgcatcctgcaattcggactatccgactgaaatcgaaccaaaatgtggcgacagaaatttagcgatatctaattaaaaaaatgcatattacacattttctcgattccaataacttatcgaataggcagtctctgcctctctggtcatcaggctgccgtgaggggtaggggcgggcctacttcaattcaagctgaatacccaagatcttttttaagaaaaaaaaatatagtatgtactatgtatatgtgtgtgaagaaaatgaaaaaaaaatgatgtattcagttcatcttcttcactgcttgggcctgcttgccgcctccctgctttcctggcccaactcgatggcctaaacaacccaaaactagctggcagcagtgttcactcaccatcgtagatggccttgcctgcctgtgtcacatcgagtagctcttgaaaattttccaatgccacacgccgcacccctagacgcaactgcgatgcacgatggaggagtggagcacgggacgtcgccacattttctttgagtaatgtctatatgatccacatattctagaactgcactatagtaacaggggtattttttaagagaaacagtaaaggagtaataagaaggtccttaagaatcactgtaattctgcatccaaatgttatggagaacacgcaaaggagtgtcggtctctgtcaaaatcagtttcgtttaacatcctttagaggaatgcaacaaatgctaactcaatgttcggttgcaaaatcaaaagaaagaaagaagtggtaagacaagaacagagcaagaaatgctaagacaatatttgttggaattaatagatgggctttagcccactcaaagattaattctttgagtaatcacaaaagcccaactcataggatagcatgtatggggagtttagtaccaccttacttattctaggagaggaggacctccttaaaagggaggatgccctcctagccacttgaatcatgtgtggtggaaagaagagaggaaacacgcgtgtgcacgacgatgccagcctccttttgcagggagacctatctctatataaactgagccaacgccttcacgcaacacacataaaccagggcgccctgatcatgcacgacgatgtagcctccttttgcggggcgacctatctctatataaaccgatgtagcctccttttgcggggcgacctatctctatataaaccgagccatcgccttcacgcaacacacataaaccagggcgacgatgctagcctccttttgcagggcgacctatctctatataaaccgagccaccgccttcacgccgtcgctcgtacactactccatcctctccggaacctctaccttcgacgtcctgcactaggtttttgggaagcactttgcaccaggtttttaggaaacactttgcgcgactgctccctgttcgtcctgcaccgggaaaggcggcaataaggtttttgggaagcgctttgcgcgactactccctgctcgtccgcgacggctcgtcttcctctccgctcgcgtgctacgaggcggcaataaggtttttgggaagcgctttgcgcaactaccccatgttcgtccgtgactgctcgtcttcctctccgctcgcatgctgtgcggcggcaataaggtttttgggaagcgctttgcgcgactgctctctgttcgtccgcgacggcccatcttcctctccgctcgcgtgctgcgcgccttcgtcgacgcccgcaaccacgagtagttcctgctgagcaaccggtctttccgtaacctcggtacgtgttcgacatgttgcgcatatttgatctgttcatgttttactgcttagtttacacgtgtagatcctataatgcatttatgctagtttacatctgcaatatcatgatttatttatggaataaattaaatcattatgtgcttataatttcaacaatattcagttacaaggtctattcagaatgccataagggcctcaaacaaaattgctcgctatttcaatctgaacaacaaaaatggactgtgacctgatgcatgttgcacgcacagttcagatgagaaattattccggcatcatggttcatgagaatgtttagctactacttacctcggactaaaatacgataccaacaaaatgaacaggttaaacatgagccctaaaacagatgagggtaagataccatgccaacttaattagcaagcattgcgtctgtgtatgacaactttttgagaggtgtcttgtgtattacatatcaggtaacctgctaaccataaagaatcagcaggttccaaagaggaaaaatatagcctgcaattctgcagaattgatttgtcaataggaaatttgactaagccagcagaatctgcaggcaccagagaggcataacaaagcttgactgaaatttgataaatccatcatggtaaagaatacaaaataaatcaagatccaaccattctgggttcttcattcagtttataacctcgatattcatacttcattcagtggcttttcaagaaaagccctgacagagctacataaccaaatatcagaatccatagaaatccaattcgtgcaaggcaaaggtacaacaccatctatcagtcaaaacgatgtgcacttcacaaagaaaatataagcacaaccatacgcacatgtccgcactgaaaatcagttgcaacaggaatatactaatgattgaatcatgcaattaagtgggaagcagaaattatcaaacggtgtattgatcatagctgcaatagcaaagagatttctactagaaaaaggtgttctgcttcttctaacagttggagactgatcagaaactacaatctcagcactacaataccatccaaacttccaaactcagcaaaaagaaacaaagacaatgcagacgaagcacctgttagacagatcaaaaactagcttacccgttgagcaaccaaacttgagaggtgtagttcgatgggtcttgctccgggaagaagcggtccacctggagtgcaggttttcccgtccatttcccgcagtcgctgcaggggtactgcgccggcgcgtcgccgagctgcccggcgatccgatgatcgaagaagtagatgccgccctcgaagccagggtactgatccgcgtcgtaggatctggagcagccgcgcccgacgaacagcatccggccttccagcgagggcagctccctccagatgtaccgaaccacatcgccgtcagatctggagcagggacgcccgacgaacagcatcgtccggccatccagtgagggtgcgtcgtcgtcttcctcgggttgtgccattcggaacaccttgaacgctgacgtgaactctccaggacgaggagagcacctcacgaccatgagcagttctccgctggactccacgaggtagcgcgccacgacgtgctgcccgtcgtagccgcgcccctgcgacgagaagcagcgatactcccattgcacttggggcggcgcacccgcttcagcgaagaccggattgcccacgatgatgtcctcccccttggtgaggaaatggaaggctccattgtggcgcacgacgtccaccgcatcccagcacgcttcacccatgtagaagtagccgacgaccaccctatcttcaatttgccagaacgcaatcttctggcggcggtagccgggtatgggagcttgatcgttgatgagtccggcgaccacgcatccatccataaatgggtccgacgagagggtggcggtgtagatgaccaaccgatgcagcagcggcttctcctcaggcgccaattcaagcgcttcgcgttccaactggatcctgttggggagattgaaggtgcccgaggtgccggccagattggcgaggaagtacactcgattagcttgaggatgaagagtggagaggaaggcccagccgccgtcgtacgagccgaagtagcaagcgtggcgaatccgctccgggacgaagaaggggtgggtggcgccgccgctcaggacgcaggagaaggccggctgctcggcgagcggcaggatgagatacggcagcttgggaggcgggtgcaggggcgggagccgctcgagggactcgcgccatggtcggcagacgccggcgaggtgcacgcggtcgtacacgcaggggaggcggttggcgatctcgcgcacgacggcgtcggcgaggtccgcccatggcgggaaatcggccatgagagacggtgggggaggggagaggaggggaggttgagaagaagacccttgtgctggtttgattcctcttggcttctggaagcttcggaaggagggagctgcgtcttacggagtggagtactttttatactgcaaggaaatgggacggggaaggtagggccgtctgggcccacccactagggctcgtgtgggcccatattgccgataattcaaaaaacaaagaccatttttcatctcaaatcaaattacaacgattatacatttgctcgattcctataactaatccaataataattcaagaaacatatggctcatccgaagttaagaacatcctacgtttatgcgagtgattatgacaacttatggcattgactacagggctccacaacggtcaacttaactctagcgggaactttatcctcgatgtatcttccgatagccacaagcgctgtacgggcttccctcaaaatactatgcgcatggttctgcaccgttcaaatctttcgtcagaacacctaaaatcatacggatacagggtgtccaaagtaagacactcgagcgacaccgagttcttgaggatataacaagttagctcaaccaagctcttagcagagctaaaccctgtgatctccacattcttgaggtggcaatggtggtcttcagccatctgcctcaaatgtgactttgaggaatgtcctagaattgattcatgcttcataggatcatttgttacctgaagatgaaaacaaagtatagtcaattgacctgacacagtgaccagataactttgcaggataggatgaacagagctttacatccaagttcaaagtctccaaggaaggagacgcatcaaggaaagaaaccagagaaaaatagtcataggacggcgaaaaggttccggagctcaaacaaatggtcaggtgcttgaggtagaggaatttggtaggcagcattggtgtattaaccacctgcgcaaccaatatgccacgtctcagatcaattattcaaaagccatgtgatacacatacattgctaatcgacaacacaaagttttagagtatacctcatcataggagcttaaggcaagagtatcaatatttggcatactggatggaagctcagaacgagcataacagacaacatttggatggcgcatgcttaagttcttcatttgcaatgtttccccaagcaacagttccgcctttccgctaaggtctaaagtggagagatttggaactttgctctctatcaatttcagcctcacgcatccatgaaccctcaggcagctgaaccgctgcagcacacaaggtatccttaggcaaattatatgatcgcagtgaatgagtgccaactgctctaaagcaagagagtttgaaagaaggcactctaactcatcccctgtaatacgcacgtattgcagatgcaactttgttagtcttctgaaggggccaagttcagttgcgggacggaagatacaaaagccaagttcaagataccggattgagttccgaaccccatcagataaaagtgcgcagggaaagttgtacgttatctccagtctacataccataagggtgagttcttcaatgcctggtgtaacagcaacttgaagccaattgtcaagattgtgatatgcggtaccagataattcaagcttcaatgtcttcacaccaatgcctgagtggtttcccagaatagagtcaattctgtggctgatatcccctccatacgtaaatgctttgggtctaaacacatacttattgaaggtgaggttgggatagcacctccaggaacatagaaaggaatgagacaggcaagcagtgcgagcagcatcacgcattggcattagggaatgtatatgacgccagatatcctgcatggacaaacataggaagagaggttcaaatttgggattgtaaagccaaatggttacttaaaccagataaagaagaacagtgcgacgacatggagtactagctctccacatgatgcatgcaaggtgcgctgccttgcttaggtacatagtgcagtggaatgtaaccttcgtaggtaaattgagccttgcatagaaaagtttatcactaacagtgttatcacttatcagtgattctctgaaagaaaagacagttactggtgggtagcagtgattaactactatgaaatatactcaattggcattagagcactgagtagacaactatattagttgctgtgcaattgtgtcaaacaaaaatgcacggagatgatgttttattgtgcaacagaaaaaaaatgcaatttctgcatagggtagtacacctgagagcctaaccaaactggagcccaataaatagaaactagcagttttgagttttgacagttacagagtaagatagacataaacctcattaaatacatgaaagagataatagatcagaaaggaccatacacatcatgaaattcgctattcaacccatcagatagcatcatagcaatatggtaaaatcaatgccccatagtgaattgtgaagccagtgacaatattgatcagttctcctttccattttttttatagaaaatgaaaatgtcaatcaatgtccccaggaaattggtgacagcacaacattttcaccagggtatgacaaaagcatcccgcttatgttaatctaccaacagtggactttttttttccgattcttctggaatgaacacacatacctgacatggttaggtgtgctaatacttggcatacctgcttgtatttggagatcacaagttacagttgctagacttttgaggggaaataggacttaatgatgcttgccaggccttctggccattggccaatctaaaacacaaccatctcataagtttaccttcttgggaagctaaagacaatgttcaatgttataaaagtgcaccagtacatagggggctgatgatgatttaacaaactcttggtgtaaagacatgcttaatatgtatctatggggtaagggtgattgagatctcaatatgcttaagaataaacactggagtatattactgtttttaatccggaggattaaagattccagtgaagctgctactgtaactgttctctgcaaaggttggtaataccagtcgcatatctccagaatttgtgagatggacagctcacaaggtgggaaatcttatattaagagtttgcttaacagtaaaattatatatctttattacacatttaggggaaaccgtattactcaacagtcatatgcttcattattagtgaatacacactcaag

SEQ ID NO: 78694 - DNA, 1073 bp, Oryza sativa
gcgcccctctacctactctccaccggggaaaggggggaaaagaccccacttcacctttttggccttcaagacgtgccttctctcggaagctaagccataaccgatccttgagcggaacccagcgccgtcccccgcctgacacggtggtcagcccggtcattccctcataaatgatcgaagacatgcaacagcccttcctcgagcagcactcggatgtgacgggtcacacctacccccattccgccggggtcaagggtgacgtgatgatatgattaccctatccatcggatgtgacggaaacgggccggtcacagaccggtcacatccgactggcaggggttagccagacgcaccacacgtctgccgcgagggacagttggggtgctgtgcatttacggctgttcagcctgtgctcccctctgccgcgtggcggccaggcgagggcctcggggcgaaggtgcgatagggcttgagggggcgatgtcataccccgagggggcgacgtcgtaccccgagggggcgacgtcgtaccccgaggccccccccgctgcttctatgatacgcgtggcgtgtgagtggggccatccggccaagccacgtggccagaggaagagtaattctcctctacctcacatacccccgggcccatatctccgatagagggagtatttctttttatgacggatggtggcctacgtaacatcaatactttaaagaaaaaatattaacaaactcggttttagagattgtgtcgacaacaatctccccagaccgcccgcaaccactaattgccacactatgcaccgccatcaccgttctttcttcatgagccaccattgttcctaggggtgggtaaaaaaaagactgaaccgaaaagatcgagactgagaccgaattttgtttggtcaattcggttagtctcctcagttaaccgaatagaccgaattaacaagaaatgtctaaatgcaacctacaatccactaaattcaataggattaaactctaattttcacatccctacttcttcaaggcatgcaacctaataagagtttttattcatacgtgtacaacat

SEQ ID NO: 78695 - DNA, 4440 bp, Oryza sativa
  unsure (1)..(4440): unsure at all n locations
atgaagttgcnnnnnnnnnnnnnnnnnnnnnnnnnnnnnnnnnnnaatcatagcttgcaactgcatatgtagggcttgggatccgttccatcaattggtccgcgggacatggaaagaaaaacttggatggaggtttcattttccagtgagtacatgcatgatccaaaattatattgaattgaatctctaattacagttaaaccggcacttcaaccatttttcccggtccaattacacacgtggggtgtgtttgcaaaccctttttcccaacccatctccctcatttttcgcgcgcacccttttcaaacggctaaacggtgcgttttttttaaaaagttttatacgaaagttgcttaaaaaaatcaaattaatccattttttaaaaaaaaatagcaaatacttaattaatcacgtgttaatggatcgctccgttttccgtgttaactgtgcacgttgggaaactggagtagcgaacacaacccatggtgggtcttttaactgaatcggatcggccgagtttccagttcagatgggaccgccggtctggtctgatcctcgataaccagtgacgatcctatatatactttcctcgggtactcggacctcggataaattaaccaattctaactaaattatatcatgttaattagtatatagataaaaaaattagataattaatatgtattggattcccgataataaaaccagtgttgtggtagacaagttcattaatacatcaacgtcaaacaacaatactgcagtgttcagcgacacagtaccagcagatttcatatctacatataagcacggctcatcactttgccatccaacaatgtgggcaatatagtatatatcgaggtgccacaaataaatggaaggtatccatgcagggacggtgacgatggcctgcagctggcttgttctcacggccgccatggctgggctagcctcttggttgatccgtttggtttcactaaaatggaacagcagccacccatgcaaagctgatgaaggcagcaggctgccgccagggtcgaggggccttcctcttctcggcgagtcgctcgagttcttcacttcgagcacctctcttgagctgcccgtcttctttaagcgccgtcttaataggtaaataatatgtgttctctccattaatctaaaatataagcatttctgactatatatacatgatggatggagtttcaacgtcgtctagacaggtaaatatacatcttcttcctccattcctaaaccaatatcttcttcctccattccaaaacctcagcgaaaaatgtttaattatattttaaaacagagaaagtttaataatgcacgtaagcatacatcacgacatcacgtacagctccgccagtttgtttccttggttgaatgcaaaactgtgctaacatgatcagaacgtcaatatcttgagcgcccatcgacgcgagaaagttgcatcacaatatcaacatcaacatgagaagatgaaattattacgtagctaaaaattcgtccacttttaaatgatatatccttaacatggcattcaaagagagcatgtactgctaccgaattgatttttctggacgacactttttaggacgcaagtggaccaaaactgttcctctcagtaaaaaaaaaaaggccacatgcgaaaatgtatttttacatgcggctgattaagtggtccatctacgaaaattgacttattttcccaggcgagcctcctaagcgaccacatacaaaaatgcattcttgtagacgggtctcttaaaagcctgtctaaaagtctaacatcccccctctcttctctcttagcatcttcaaaattttctaagtctctcaccttatctcctcatctctcattttttccttagcatctcctctctctccccactcattttatcccccctctctctccaaaacatctcctggccactaacctctcctctctctccccaacctctcgggcggcagtaggagtgacgtcggcgaggacgagtggcagcggtgacatcgacgagggctcggcctccaaccgtcgtctaccccgccacctctcctctctctctctgtgtgtttcttctctcccaccagaggtcgcagggtgctggccaacggatccattggctgcaaattcgaccggcacgaatctagcggtggttgcgatggcacgcacgagggctacggcaagctcgggcggtggcatgctcggcctcgtacggtggagagcgcagcggtgtcggatcgggtgatggggaggactgctacagcagttaggaggtgtggtgacaacagatccgatggtgttgagggcggcaacggttcggacgcgcagcgacggtgacgatgacaacgagtagtggtggattgcagtgatgacgatgaggagttgtcgggcctcggcgacgatgagtggtggcagatgtggttttcgggatttttatttttttcgtgatttttattttcacatgcggatgacataagcatctatacacaaaaatcgaaattccgcgtgcgactacaccaaccgcatgaaaaaataatgatttttacagacacttcagaaaagatgatcggtccaactatataaaaaaataggttttaatcgcatgaaaaaaatagatttttaagtagtgtacataagtggacatgagcatttcgtgaaggacaagacggcgaccaccagcgcgtgagcaggtagatgtaggccgaccccacacgtaccatgcacatgtcgttagcttggccgagaatgtccattccctgtacgtcgtgtacaagggacatgtatggcacggtcgctctcgtcacgggattatttgcgcccgctgcgcaagaagacggagagatggagaggcaggaggagggggagaagagaaccgacatacgggcattaatttttatcgcaagccaacgaaggatggggtaaattagtattaggcagatgaattttgttcggacatgttttttcccaataaatataatagttgagtggtttatattatatactatatgagacccgtgctttgctgtaggagtttaataatatacttcttccgtttcacagtgtaagtcattatagcatttcccacattcatatcgatgttaatgtgagaaatgctaaaatgacttacattgtgaaatgagggaataatagtaatagtagaaatagcgtgtaacatagctagacaacgtaaggttatagaatttttgatcgatcatttcaaaaggctataaaccacttaaattgatgtgatttatgataatttaaatagtatacagtaaaagtaaaataaggtgatgtatttttataagagaaaaaaaggaataatttggactatagattaatcaactaagggctagaaacaattaaagtgacgtggtttaatgagagcgtatagaaaacattaattaagtggggataaagtatatatgatattctagaaaatgatagagagatatatgttaaaatattactccctacatccaaaaatataacaaattttagccatcaagatttgtccgaaaaaataacaacttctccaccaacattctcttcccaacctgtcggtgatatgggcccggggatatcatgtttagagggaggaggccgccccaaacccacgtggcgtccctagaggagggtggcgctcgggaggagcggcggccgccccctcagcttagggtatcgaatttggagcaaggaggctgccccctaacccacgtggcactcccctgagggggtggcgcccggggtggagtggcacctgcccccttcttgcttgggagtcgggcccgtcccgatcaagactagagggaggaggctgccccaggcggcacgtggccctccaccgaggggggatcgggcccgaggtagggcggcggccgccctctcctgtgactaggggtcgagctcccccgaccccctctctaggtcaccacgtgcgatgggttatgtggctgcctccaggcggacctgtcccaatcaagactagaaggaggaggctgccccaggcgccacgtggccctcccctgaggggggatcgggcccgaggtagggcggcagccgccccgtcctgtgactaggggtcgggctccctcgaccacctctataggtcgccacgtgcgatgggttagatggccgcctccaggcgctcacctacccgcttttatggcgatctgagcggttgcgccacgccgcatttaatgtggcgtgcagtgcactcaaccgatctgtgataggtccgtgaccggtcgaacgaccgatgggacggcggctgtgtaccctcgcccagtcaatttgaacccagcgtgcggcgtgctccgtaaaatacaatcataacaatgagggacttaacagcttctcccnccggtcagagctggggggcnnnttcaacannnnngnnggntnnaacgtcatgcgggatcgtatgagcg

SEQ ID NO: 78696 - DNA, 1185 bp, Oryza sativa
tataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatctaaactaaaagagcattactaatatttgtaataatatttcttcctacatatccacaatgactctcatttggatgttaattaaccaaacaatagatctctcagcctgccattaggcactgaaaatgttgcagattcatctcctcctgacacatgtagtgtgtggccaatactgacaatgactgtcaggtaacaaatcagctcaaacatctgtaatcacaattctgacagtgactaagcaacatttaaagagctcacacattattagcactaattaattttatttatcctaaaaaaaagtgcagtaattagctagcaaatccagcctatataatccccagccaaaactgatcatatcctccaagcttgaacgccaagatcgagatcgccggagatgaaggcgccgccgccgccgtcgccggtggccaagagggcgcgcgtctcgccgttcgtcttcctgctcgtgctcttcctcctcctcttctccttcctctacggcgaagacctcaaggagctcctcggcagccaagctcaagcgcggccgagcctccacttcaatgccgccgccgccggtgatgggatcgagctgccggccgccacggcggcgacgaccggtaatgtcaccacgcatgcatggtgcatctcgtcgcagttgatagctagctcgaatttgttttgacgtgttgtgcgatgggagcagaggggaggacgacgacgaggaggtggcgggggcggctgccgttcgcggcgaacggcgacggcgaggaggaggaggaggagtgtgacgtgttctcggggaggtgggtgcgcgacgaggcggcgcggccgctgtaccgggaggcggactgcccctacatcccggcgca

SEQ ID NO: 78697 - DNA, 3069 bp, Oryza sativa
  unsure (1)..(3069): unsure at all n locations
cggtccagttttcaggacgaacatggtcgggcaagacctgatcgtgtgtctcgatccgaaggtgaacagcttcgtgttccagcaagaggaaaggctcttccagtgctggtaccctgattcgttcatgcggatcatcggcgccgacaacatcatcacgacgctcgggtcgtcgcacaagtacatcaggaatctgatccttcggttgttcggccctgaaaacctcaggcgtgcgatgctccaggacgtgcacagaacggctcaggccagcctgctctcctggctcgatcgaccgagcatcgaactcaaggatgcagtctcaagcgtatgtctgatggaatggctattacggattcaccccctttaattttttgcgattgcgaatatttcagttgaagtttttctcttctttttcagctatgtgtgaattaactctgactagagaaaatttgagtatgttccagatgatattcagcgtcacagccaagaagttaattagctatgactccttggcctcagatggaaagatgtggaaacaatttgatgctttcattcgaggtctactggcatttccaattggcattcctggcaccgcattctacaaatgtatgcaggtaaatatctactagtatatggtgatagatggttcagctacatgcatgttaacaaaaaggatacaaaacatagctggtaattggcagaaataaatcaacttgcagaggagaaataaatagaggaatttagccgctaagttatagcataattatatatccacttattattggtaaaaaaatatatccacttatcgatacagaggccggaatccattaccttaaaaaaaagttatcgcacagttttctactctcttcaaagttgacaatagtgtcctatatatatatatatcaatttgtaatcttaaaaggagatcccacatggagatggattcaattcttgcaggggcgaaagaatatcatgaagatgctgaaagaattgattgatgagaggaaggaggcatcagggcgacggggaagcattgacttcattgatgtgctgctcgaggagctgaacgaggagaagcctttaatcagtgagaacgttgcgctggatttgatcttcttgctgctatttgccagcttcgagaccacggcatccgctataaccgcagtggtcagatttctaacggataatcccgaggcattgcaagaattagcagtaagtacaagtcataaacttcttttacagtagatatatttccatcattttcaaacagtagtgatgtttagggttcattattaattaaattactagtttaggccagcatattgttacatgcaaataattcaggatacattttgttgaacaaaatgagattgatttgttgtttacaggaggagcatgataacattcagaaaagaagggtcgacctgaactctgaaatcacatgggaggaatacaaatctatgaaatttacatctcatgtatatgacttaaaattcctgaagcattatttatataaaagatcagccatcctcgcgcacaccctcatctccttaattattcgtaggttatacatgaagctttaaggcttgctaacattgctccagtgatgtttagaaaagccacagaggatgttcatataaaaggtaaaaaaaccattattattattaacaagaacttgtacaagagatacataacagaagtatgcatagagtaccaatttgcaaaaaaaaaaccattttataatatcttcttctgaaatatgtttgtctaatatgtgcaggtttttttatcccaaaaggatctaaaattatgatttgtccttccacggttcacctaaaccctatgatttataaggatccaaatatattcaatccttggagatggaaggtttgtaaaattcataacgtatgttctatcatgtttcataactaaccatgcatctatatatacactaaaatttatatgtaattttttctgtagcttgtactgtccgtttaaaaatatagggcgtatgtatttttaccacaaatttcttacactatttttcttacatttacaatgtcagtcataagaaagtacgtttgaacatcaatccataaatatcatttttatggcaatacctagatattattgaattagttggtcaatactcaaaattgaacagtcaagtgagtagtgtatatatgtatgtattttttttctatgtcatatagtaaaaaaaacaatattgagaaatctggagtgacttgtatagcattatgccatctataagttctcatttgtaatatgcatactgctctgtacaggatactgctgaaccaaccggtggtgcctccaaggatttcatggcctttggagggggactgcgcttgtgtgttggtgcagatttcgctaagctgcagacggcgatcttcctccactgcttagtcaccaagtataggtaaacctacttgtactcatctacggtacctcagtattgagatatacttttgtaaagatttacttagttcaaaatccatcagagaacttcgatcgagatcatttaaatttcatcggtattaaaagatgtactgttttgaaaaaacaaattctgttatacaagtaatgaatacattaaagattgacatctatagttgtttttctactatgtttaactctgttaaaaaatgatctttggtttatgctttgcagatggaaagcgatcaagggaggaacaatggtgcttggtccaggactacgattccctgaaggttttcacatccaacttttcccaaaaccttgaagtaccggggccagatacttctagcccctacacaatatatgtagctcagaagcaacgtttgagatctatattgttgatgattggtacttcgatgtaatttccattaattttctgctgttcccattagttcactgctgaatgagctatgcttattcttcactttgccataaatgttgtgtgatgtccaaatatcacaaataaatgtagatatgtttgagtnnnnnnnnnnnnnnnnnnnnnnnnnnnnnnnnnnnnnnnnnnnnnnnnnnnnnagctaagtgtctatatcc

SEQ ID NO: 78698 - DNA, 2926 bp, Oryza sativa
taagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagctatatatatatatatatatatatatatatatatatatatatatatatatatataaaattgcccaaactcacttttgaggggaaaacactccataaacatgataatttggcagtagacaccgcgccgattaaaataataattttcgattaaagaggagggagaaatcgcgtgaaatttctaaaatacccttgggcccacaagccatatcttccatctctcttctctctatccctatccgacacggctgaggggatgatggtggccggccgacgactcctcttcacgtgtgcggctagccgggaactcctctccctgcgtggcgctagccggcgaggtccttcccccgcgtgtggccagccgacgactcctctccccgggcgcgaccggctatcgaacaactatccccccccccggcgcacggctggccagcgagctcctctcccgcgcgcaccgaccagaacgaggaccaggatctccccgcgcacacggccggtcgacgagctcccccccacctcgccgaaacccacaggacgccccaccgctccgcgccaccagatcggcaagcgtgacggctcgtcgtcttcttccctccattaaatcggcagatcaactcatcgtctgcatttctcagttctccaaccaatttcccgattcatcgatctcatcgttcgttcgctctagctatcgagagtgatggtgtggtctgttcccgatgatggtgctgctgccgaccatgctgctgctgcggctgaggctcccgggcgacggatcgtggtggccgtggacgagagcgaggagagcacgcacgcgctcacctggtgcctcgccaaacgtcgtctcctcctccagcggtgacacgctcgtgctgctccacgctcgccgcccccgccccgtctacgccaccatggacagctcaggtacctcaatcgaaatcactggacacgcttttgtggtctctgctcctaattcatcaagccaacacctgggttgttgttgcagggtacatgatgacctcggacgtgatggcgagcatggacaagtacgccgccgtctccttccaggtgcgacagacatggggcggcgccggcgattgcaacggcatcggccatggaagtgtgggaggaggggatagggagatggaagatatgacatgtgggcccaaggacattttagaactttcacgcgctttctctctcctctttagccagaaattattattttaattatcgcggtgtccaccagcaaattaccacgtttatgaagtgttttcctccaaaagtgagtttgggtagtgtcctagggctaaaaccacatataaacagtgtcctgtagcaaaatttgccacatatatatgaccatcaagataatgagtaatattggcggctttgctttagtcgccaagaaaattaactggctgccaaaaaaattatgttttcttgtagttatatactcccttcgtctctaaatatttgacatcgttgattttttagcatatgtttgaccgttcgtcttattcaattttttttgaaataggtaaaactatatgtatatataaaagtatatttaacaatgaatcaaatgatagggaaaatattaataattacttaaattgttttgaataagatgaacggtcaaacacgtttaaaaaagtcaacggcgttaaatatttagggacggagggagtactagcttatgatagttataccttcctagatagatgtttgcgccgagcaacagtgagtccatgacggtggtgatgatgagcgagagcgagttgaacatggaagggtagatcggcccgcgacgcgtgattgcccacgagatgagcacgaaggtgataccggtgttgaacaccccctgccacaccacgaattacatgatacatcgataaatttctttagataacggaaaattcattccgacctttactttaagaaagctatgaccaattattattatgattcattatctaaaaattattattattacgatttaagtcaacaaaatgactatgaattatcgatataatgcaactaaggcatatactccctccgaaaaaaaaaatctaattgtaggatgaatatggacacatatatatcctataattagatttttatttttttggagtgagggagcatatacataccgagtaggcgacggcgagaaggcgcaggtcccagctgagcttccactccgaccagtcgccggtggtcaagacgccg

SEQ ID NO: 78699 - DNA, 2761 bp, Oryza sativa
aaattaatttgcagtatagctagtgaacattacttggatatagatatttttgcaaaacattttttgtgtgtgccaaactatcatatatatatatatatatataggaagaaattagatcctatatacagctatgatcaaacatgcatttccatatgccaaaagactcaaatcgattaattaataatgctaattaacctgcacgatgaaccacaaggcgtagctcaggcagctgccgcacagtagcagtgtgccggagatcgtcgtgccggcggggctcgacgacgatgacgacggcggcgccaccgcggcggcatgggaggcgcagcaggtgggtgggccagaggtgcagcagctgacctctgaagaggctgacgaccatcgtgccgctcacggacaggaccgtgcccaggaccttcatcttgccggcgcagcttgctatcgccagcttctcagcacttgatgaaaaagaaaaaaaaaggatgaaaaattgcaaatatatgttgaatgtcaccatatattgacatgacaactgttgattaattattttgtctattagtaccttgtatatggtgagtattaattgtatattttagtattaatatatatcacgaggtaaatttaaaaagtatatatgatgtcatacttctatatatagtttatatatgtgtgttgttaagttttttttaaaaaaattatatattgtgcatagttaaaagaaatgtaccggaaaataacggcgataatgaaagtgacgatagggatgagattcagaaagttggcggaataggcggcgttcgtgtcacgcagaccgtagtagtacatccctgttgccagtagaactctacaaattgtcaaaaggttgttagtttcaaaatgttagtttcaaaacatagaggaaattatattgtgaggtttggttttttaatttcttaaataaaagggcaattcacttttggtttttgctacaaaaggagtcgctaagggaacagacaaggtggcggcatatagcattcggagacgatggtgatggaaggatatttcaagcatgcatggatgcaattaatagcttttgtgctttagatggttttcattcaagcttggagtagcattggtatcattcaagcttggagtagcattggtatagcatatggctaaaacagtaaaacttttcctcccaataaaaaagaggtaaaactgtgtgatattagtagtggacggttgaatgtaggccttattatgcagaggctagaataaaaaaaaaatctctgtctgaaaaagttataatttaatgcaaattttgcgatcatatataagagaataatgttgagcatgacaagtaaaaacttagccttgtcgttgagtataacagtgctaacccgaacgttgcgttgatcgaaatccagccacacactacggcgttcatctttttcatcattcctctgaaacatacagaagaaggaagcacaggtagaaaaccagaaatacaagcacataaatctataaacgagtagcatacatttttccacacaccaatgcattgtacatcgctacatatatatttgtccaatactcaccccagaaataaacaagtgtggtcatttttaagtattgcttccatacatcgtcaaaactaataaatttctattgcatcatggtatatctttagaagccataaagttcatctaaatttgaggcatgtcatctttagatgatataaatatatataatgtgcctggtttatagttagttctagactccattatcaaaagttctacaagatgagtatacgttaattacatttagaataactttagatgcatatgtcctctatatctatatatacttcccctttaatttctccatatttatttatctatcaccatttggctagatgtagaaatcaaacggcctgatgcgtcacgagcttttgcgtgtttacatattattgatgcaattaagagcaaaagaggtgatcatcaagaggacggcccatggtttcactccacctacatatgcggcgaccatacaatgcagggctgaattcaagtcattttttgtctctttctaacttagtgtttctgttgagtgtttgacacatgcagtgagatgatatttgtccgtatccagccaagtcaattggctcttttcttttcttgcaatttttctttctttaggctgtttttgacacacgaaacgataggatgtattagcacataattaattatgtattagtaaaaaacttaaaaattacattaatatatttttaaagcaatttttctataaaaaatacaatgtttaaccgtttgggaagtgtgcatacaaaaagaagaaagtgtgagttggcaatatagacataagaatacaaccttaaaatcgtcaactagttgggtgggcggctaaaaaggtagcctccagctacgaatgctctcgaactttcctcgactggtagtatacgtacaaagaaacatatatagacaaagataatagcgtaagccatgtatagtattactctagtagtgcaattaaatatatttattatttctttttggaatgaatcaattaattagaaggcatgaatgctatactatgtctttgctcacggctggcactgagatttcgcacgtttcccacgagtttccaaagcacctctctctttaattctcaatttctcatatagtaaatgaattggatcaggcaaataaaatcgtcgttcgatccagcgtggattagatttttttttaaaaaaatggtttgatttctt

SEQ ID NO: 78700 - DNA, 10644 bp, Oryza sativa
ctgcagccctaatttaagagaaattaagataactcttgggagtctactcatcaagataacatgtgacctaagactcatggcagacaggaaagctaccaagttaggagcgtaggggctgtagcctttagcaattggagatccgttccctgcttacagatattatttagctagcatagtccaaagaacttgtttgttaaaggccattatggtgaaaatgtgcttgcaacataagccccccatcttcaaaatttatgtggcatacctctggaaggtctgggattgagcaacccttttgtttattcgctgaagcagccgattcatctgcaacccaacaaggtaacaaccatggttatgacagcccaatcccagacatgaatatattttcttaagataatggataagaattcggcctctatatctgaacatgaaccccagacatgaatagatgaaaggaaaaaaaaaaagaaacgaactcagcaaaggcaatgacatcttgaatctcctcccaatctctcttttttgttcaaggaatcaacgtatttgttcccacatgaaatttctcattgcttactcatgtgaaagagaaaattttggttcaacagggggaagcaacgacactagctaattacctctacagctctactgtgaacaagcgtctagtttttttttttagataataagcgcctagttagcaaaacaaaattatttttttctttaaagaaagagctgcatatatgaggttaaaaatactagtagaacacaagaagatgatttccggaacatatgcacgtaacagaagagagggtgctaagaggagttggtaagaggagaggagaggaggcttactccgggcaaggattttccggcgacgccgctgctggttacgctggatggacaagagccgctgcaaccccatggtaggagtagacgacgcttcttccttcttcatatcactgctcctcttccacctttatctatctgcagccttcccttcttcaagtgcgcctcgcggcgggatagcacgcgggcaatcgggttgggggtgcgcggggaggagatgagggggagccgtgcccgtgacgaggtgggatggagggaggcgcgcggcgacggtgaggtaacgccgccgagcagtgttgatggcacgatagtctaatcggaggatgccgatttgatgagcataggaactgttagccctctctgtatttgatttggtttggaactcaattcagactacagtacgattactagaccagtcttgggaaatttaactatttgtcacttttacgtttcacaattaaccaaataccctccccttcgttttgtttaccagccacaaggtagaggatacgcctccgctacagccgcgcacgacaacaagacatggaaaacaagttattatatgatctctgaaccctgtgaaaatcagtttattttagcatccatccatcataggattgcaacaaattaatgctagctcaatgctcagttgcaatactgaaagaaataaagatatgctaaggcgttgttcagttataacatataacaacagagcaagaagtgctaagacacacaattgctaggaaatgtcggcaccaactacaattccttgatttggaaatcttggtcacctgcgaaatgcaaattttatgcgtggcttatgatacaaatagagtttggacatccgaccggctaactgcaagagaatggcaaaacaatggattgtgccccttatgtcgggagacgaacgagacggtatgtcacctggtcgcctcttgtagatacaccatgagtatttggaggctaacggccagctgagttgcctatcagcaattggatctgaaccattgggacccatgccaaagcgttcaagagtggtgggacatgctaaacaacaaaaaggaagtgcccaagaaagaactgtgatccttgaccctactcattgtgtgggaaatttggaaggaaatgaatcaacggatcttcaagcacaaggaaacaacggctcccaatcttatggcgaaaataaaggaagagacaagaacctggatcatggcaggtgcaaggcggcttggagaattcctcccttcgtagcaatagcctctttgtttttgtgtacagtttcccttttatccataggggctgtattttttttacctctatatccaatgaaatagcacaatctcgtgctgattctttaaaaaaaataaaagaagaagtgctaagacaatgttcagttccaacttacaatggtctattcaggatattaactgtgtgggggtgatgcatgttgcttgcactaattcagaaaaaaatatggtactgccagcaaaatgaacatgatcaggatattagcaggtaacctgctaacagtaaaaaatcagaagaatctgcaggcaccaaatagagaaaacaatctgcaatttctgcagaattgagttctgcataggaagtttagaatggtataaccaaaacttggtaaaaaaaatgtgggcaattaatggcaaagaatataaaataaatcaacattcagacaatttgaaggctgcattcagcacagaacctcaatgttcagactttcttcaggaacttctcagaaacccctttatatactgatagaattgcataaccaaacatcgaattccatgaaaatataatccacttaacgcaaagaaagaaatacaccgccatctgtctatcagtaaaggtgtgctcccgtctaagcaaaatgtaagcacacagtcataagcacatctccacactgaatatcagtggcaacacaaggatagatatgacgggttatcaagtatcaactatttccaagtcttgaatcatccaaaatggaaacagaaatgtagcaaacgatgcacttggatcgaggtacacattgatcatatcagcaagagatttgtactagaacaggagttctgccttctgctaattaacagctaatatctcagcactacaataccatcacactcaccaaaacagcaaagagggggaaacaaacacaatgcagaggaagcacacgttagctaagatcataaactaacttgacctgctgatcgaccaatgttcccaaacgaaacggccaaaccttgctgtgtggtccgccgactcaactctcaagggagacaccaaccttggggggtgtagcctatcgccgggaagcagcgctccaccatggaggcaggtgttctcgtccatttctcacagtcgttgaaggagaatagcgtcgcgacgcccagcggcagcatcgccggatcctggatgtcatcatcgaagaagtagacgccgccctcgaagccagggtactgatccgcgtcgtaggatctggagcagccgcgcccgacgaacagcatccggccttccagcgagggcagctccagccagacgtagtgctgatacgggaacacgtcgtccggcccggcttgcgccatccggaacaccctgaactccgacgtcggctgtccaggataaggggagcacctcaccaccatgagcaggtcttcgcgggactccacgaggtagcgcgcctcgacgtactgatcgtattctcgcccaatgtgttcgaaggcgcgcatctcccagtcgaccggatccccaccatggaagtccggacctgccacgatgatgtgctccccttgggtgaggaaatggaaggctccatcgtagaacacgacgtcctccacatcccatggtggattatgtgtctggaacaagtgagggatcacccgatcggaggcgcgccagaacccaatcgtccgctggccccgggggacggggtcaacgctgatgatgccggcgaagacgcatccgtcgacgtctggttgggacgagagggtggcggcgacgatggagaacggcaactgccattcctgcccgggcgctccgtcctgctgcgcgatgaactcggtggggaggtcgatgtgagggcgggagtcttaggtgtcgaggaggcggtgctctcgaggacctcgaggtggagcaatggagaggatgaccagccatcgtcgtacgcgccgatgtagcgtgcgtcgtgcggccactccgggaggacggcggggtggatggcgcagttgctcaggacgaaggagacggcaggccgctcagcaagcggtaggatgagaaccggaagagcgggaggcaggggcacgggcgcttgctgctcgagggacgcgcgccatgatcggcagacggcggcgaagtgcacgcggtcgaactcgcacgggaggtggttggcgatctcgcccacgacggcgctgacgaggttcgcccatggcggagaggcagccatgggagacgggaggggaaggggaggttggggtggacttggtggcaaattgcacgggacgctcaccgctgcggtgtctgttacaagtttgattcccttttgcttctggaagccacggaacggaaggaggaggagggagggcttcttatactgcaaggaagagagatggggggattgggggatggctcgtttggcccactcgagcatgttgatcaggatgggcttgtgccccaagaaagaggaggaaggctcgcttggcacctgagcacattgttcgttcctgatgggcttgttgcggaccatttcatggcctgatttgattaaacatgataaatggacatgaaggtaaaacaacccaaatatgaagccgattctaaacacagagtatatccaaatcaaaacgagtttttttttttggaaaagttagatttgttttttatttgtgtaattttatcgttttgaacaatggtgaagtcaaactataaaatatttgactatgaatcatttaaaaatatttctcttataaatatgaagaccatatgtgcatattagtcttaaaaaaatacttcaataaaattatatatttgttcatatttgtatgtatattataatagaaaatagtggttaaagttgcttgatcgtgcccttataaaaaacaagtattatcaatccagagaaagtactacataaagcatttcctatgtcccaaaatataaacatttatagttatgaatctaaactaatgtgtgtctatatttataactaaaagttgatatgttttgggaggtagtaatatattgctttgtaactactggatttatttatttaataagaaaagctgcattcttaatgcagttctttctacgtactaattaatactctcgccggattataatatatgcggcattggcattttaagatatttttaatcattcttatttaaaaacttttatatagttaataattattttttatctgatttatcgttaaatattctttaagtacaatgatttgtattcttttatgattgcgctctacacaattagtagttctccacaaattttaaataaaaacaaatgatcaaatgtatattaaaaagttaatgatgagttcatcacaacaataaactagataatccacgagaataatttgatgaacaatatatttctcggtctcgcgtaatcgtgttcgtttacatatatacaactcgtcccacctcgcgaacagcacggggacaaaaacacgcaagcaacggcttttccagaccaaaccactgcacgtacgttaggtgacatggcgtccatcggcccattgctctaccggcgtgcgtacgtacgtcaacgtgtggcatggcatctcgctaatatttgagagcactcacagcaaaactcgccgaatccctgagaccctgactcccctgttgcggccgtcgcgcgtgcgcggtgcgccggacaggaggctagggggtaccggcaccaggcaggcaggcaagtacgcccgtgggacgagcagggagctagccgggtaggaagggcgcgcggcgatggagtcggggccgcgagcgccagtcgtatccctacgactacgtgctgacacagcttgccgccgtgccgaggcctggctctggctgatttccgtcgctcgtgctcgcgctgatgctgtcgctcatatgccattatttctacaggcaggcaagaccggaacaccaggcagtagctactcattgtgctgctagcggcgacgcaggagttcgacgacggcgccaacacggggctggcgggtcgcgtgctggcgcagtgcgcggcgggccgcgcgccggcggactgcgtgcagtgcctgcaggactcggcgcgagcgatgccgagatgctgctggaacacacgagggctgggagagagcgtcgccgtcgtgctgagcgacgactgcgtgctccagttcaccatgcacctggcctatctccggcggcaagccttggtggagctctccgtccgtttgtcctcggtgccgttggagcagcagcgctagcaattatcccatcacaaaactttacaccctataatgtttgaacaccctgtcacatggagtattaaatataggttaaaaaataactaattgaatagattgcgactaatttgctagacgaatctttttaaacctaattgctttatgattggacaatgtggtgttacagtaaatatttgctaatgacagattaattaggtttaataaattcgtctcgcggtttactaacagattttgtaattagttttttattagtgcccgaacaccccatacgataccctatataatttccgatgtgacatgccaaaactttacacccctggatttatacacccccgtagtaatagtaatcacgttcgaatcgagtgaattgaagacaatttgtagtaatataactgtgggatacacggtacacaccgggtacccaaggagaggcctttgggccgtacgacatagggtgggcaaagagccgtaggcacatgcggcatacttgtaaataaagaaagagaaatttccagaataagatataaatctgggggatcatacatatctttatagatagaatagggagatctagttacaatcaactagatactttacttgtaacccccctcatcctatataagagggggcaggggtcccgagagggggaggtcggattatctccacaacctaggcatacatcatctccactccataccggacatagatccgatacacatacaactggattagggtattacctcacatcaagacagttggatcatcgagacaactggatttgggtattacctcacatcaagacagttggatcatcgagacaactggatttgggtattacctcacatcgagacaactggattagggtattacctcacatcgagacaactggattagggtattacctcacatcgaggacctgaaccaatataaagctttcatcgagtcatggtgctcgatcgagtagtagaaataaatcgtcatatgtagtagggattatgtgttaggataacagtagcttatcatgtgtgttttgtttgcaaaatgctatgcccagctagccgctagcgttacgagcgtccaccgccaacccattctgcagggtgaaagattggacccctttgtgcggcccatggggcggtgaacagaatcaccccgcacgacgcacacgcgttcgccgcgcgcgcgcgcgactacgcgaccgtgaccgcgacgcgggcatatttgaaaaaaaaaagaatttgtgaataaaacttttatatacgtgtttttaccgatctaaaagtaaagactaaaaaataaatttcgataaaaaaacccctcaaaattaactttaaatctaagatagaaaatttaagttttggctgataagtataagtataagtgaaaagataaggcttttgagggccagtcgtggtatcggggcaaggcggggatgtgccggactgccggtgcgccaccatacactgtgaaactaaaagaaaatctcacaattcacaactatacgttatgaaatagcctgcggctaactcacaccgtttagtagtttaggaagcgtgcgcgcggaaatcgaaacaaactcactcacaatcagccaggaaagaacacagccttaagtttccaatatttttgatattttttttcagcctcatcgttatcgttcccgttttcaagaaatatatgattatttaaacggctgatgttgttttccaaccgtttcatccctagccatggctagcaatgcttggtacgtgaaggtgcagtagttaatgacccatgggaaaaggtttttgaatggccaaacatgatgattggtgttatattaataaaagaagtttatgtacatagcaagaggtggaagaaaaggaaaaaaaatgtacattacttactgcaaattacatgtcagtccatcttaggctgtgttttttttaggggttaattaagaaccccttccctacccacagaaaacggaatgatagattaacatataattaattaagtattagtctataaaacttgaaaaataaattaatatgattttttaaaacaactttactatataaactttttgtaaaacatataccgtttaacagtttaaaaattgtgcacgcaaaaaatgaaaaagatgggttgagaatcataggaaagaacacagccttactgacttactcctcatggcaataatctcgcaacgtgttttgtgccagccaagctccagcgacccaactcatgaacccatgagaaatggttactaaactggtagcacacaccatagtccgtaggacttaattgcaccggagtttcgtgccgaacagacctgccaggaatgacaacgcttaagaccgtaagctcacgaaaatagaagagcatagcgcttaataagcgagtaaagggagagaagtccagccaattcgagcaacgggtgaactagctagggaaacaactttcggctgagtaagttcggagtgacgccctcttgattagcgaattcggcggagcttttcgccgcaattacccgttggccattcacagtgcttacttgcagctactgcaatgacgcgtgctaacctcccgtgccatttcgagtagtggagcgtgcgcgtgtccgcggttatagctgcacagtgtggtggcatttgagctcactcgatcgcctacataaagagcggtatagcttcgagctacggcatgcaattcgtctccagcgccctggcgacctagctagctccctcctccgccattgccacagaacacaccttggtgtcgtgcaatccatcgctcatggcgctcaccaagctttcctgcctcctcgtcgtcgttttcctcgccggcgtgacgtcgacggccaccggagccaggtacttcccacagaacggcacggcgttccgcgagaacatcctcgtgctgcccaccgacctccccgcccaggccgctgcgacgaggttcgcctccacgcaggccggcgacggcgacgaccgcgcgctcgctctcagcgtctgcctcggcgactctgcgccggcgcagtaccgcgagagcctcgccgccgcagtcgcggacgtcgtcgcaggctgcggcgccgccagccgccgcgccggcgcctggctcgacgggtgctactgctacctcgccgccgacaccaacatgacgacgtcgcccagcggggggagttccaccggtggctcgtcaccggagacgtcctgccgttcagcgacaacctgtacgcgacgttcctcgacatgagcaacggcgtggcggcgcggatgctggcgacgacggcgacgcaggcgatcgacgtcggagcagccacgacgacggggctggcggggcgcgtggtggcgcagtgcgccgcgggcgtcgcgccggcggactgcgtgcagtgcctggagggcgcggcgcgagagatgccgagatgcttccgggaggcacgtcgggaggagcagggagagggcgtcggcatcgtggtgagcgacgactgcgtcctgcgtttcgacatgacttcttcgccggcgcctcggacgtcaaacacctgtgatgggacttgcaagctgttagccttcgccttcggagcagcactagaatgatcgtgtcagtcactttaatttgtgctccctccgtcccaaaataagtgcagttttagcactgttcatgttcaacgtttgatcgttcgtcttatttgaaaaacaattataattagtatttttattgttgttatatgataatacatgaatagtatttatgtgtgactaatatttttaatttttttcataaaattttcaaatacgaatggttaaaatactggacacgaatatctatggttacacttattttgggacggaggaggtagtagtagtaaccatcgctagctagcttgatggaatcatggtgcttgagtggtagaaataatataatgtctgtctggggggtagaatggttgcctatatgttagcaacttagtagtactaccatgtttctagtgctttcggtgacactattctagccggttgtgtgtttctctttgtgatttgcaatgctatgctcagctagctgaatatatatgccaaattgtcaccttgggaactaaatagagctatgtgatccattgtattgctgggaaaaatatatggtgcaaaccatatatataatataaacatagaaattactgaaattactataggatcggaaaataaacatatgagatttgtctatgtcataccaaaataaaaatttactcctgattaaatcttgagataatcccttatataccattgaaaatcggctcttcccttatatgccattggtttaaatttgcgcaccctctcatgccactccca

SEQ ID NO: 78701 - DNA, 1090 bp, Oryza sativa
  unsure (1)..(1090): unsure at all n locations
aggcttgtnngnattgatgnccnccttgaannncactggatatccngctnnnnnnnnnnnnnnnnnnnnnnnnnnnnnnnnnnnnnnnnnnaaatagagggacacaaagtgaacgtattccaatccatttcatccttaaggcttcctttgcattagtggatttctggaggaattttagaatacttcctatcctttggattaaaaaaaaccacaagaaaatcagagaaaactttcctttgctgtcgttttcgcaggaaaaaggaagaaaaataatctatccgctccgagctattttttttcccttcagataagatcgagaagatcaatcactaaaagccagtttaataatatagctaattactatctctaaaaaactcaaatctattaccaatccaatagttaacttatacaatatctagttatagatatatagtgcattgttaatacctaatatacttatctttctcacgtactttcttcgtaaaaaaataaacatcgaataatgatatatcctagtatagcgaatctagacaaactcttaggatttgtgggatagatagagtattttattagagcttatactgtagctatatataaatctatagtctccttttctctcctctcctttccatataagtacaaatgatatggcaacttgtataacctgtttccattatcttattgcacttagcatcagtagcaggaacaagaggaagaagcagagcacaagtgcacaacagcgcaccggcgatccaacatttgcttgtgcagcagcttagttctccccgccgtcatctagcgttacgacctcctcccgcagaagcacgccctgtgcatacaagttttccggtggcccagccccctcgagcactccgcagccaagagtcaagagtagagatgaaaatgcatcgaatacggtcggaaaatagctatatcatattcgttttcatattttttttctcggaatcgaaatcggaatcggaaataaggatacgaaaacggaatcgaatactatcgaatacagatacggagcgaatacagtaacgaaatattatcaaaatatcaagatcccttgaaataagctttttaa

SEQ ID NO: 78702 - DNA, 8280 bp, Oryza sativa
  unsure (1)..(8280): unsure at all n locations
tgtatggtacgggatagataatcccggcatgcaggagtttcaagacttctttctttacaacttctcgcattgcattattgagccgtcgttgaggttccctagagggagtactctcggggtcaataggaatacgatggatgcagagcacgggattaatccccttaagatcttgaagcgagtagccaagaacagaacaatgcttttccaacacggcgagaagacgttgagtctcgtcttcaaagagcttgtcactgattatgacaggggcctctctgtcatggtgtaagaaagcataatgtaggcttgggggtagaggtttaagctcaagcggaggccaaggtggtggttccatgatcggcaggtcgagagtctcaccgggatccgcttcctctttgatgaaatcagggacctcatcttccagaagggcctcgggagactcgtgagggggaactgcaataacctcttccgttgactcaatttctggcagagggtctgtcaagacgatccttgcccgtgagaatggaattgaaaattcagtctctcccagtgttattttgaggctatctaatcggggtgtgttgatgagaagttgctcaattggcagcccgattaggatgtcaaaatcttggatttcaaagacgtggaaatccaagatcgcctccttgtcttcaaagcagacaggcacatcttgcataatcccaaatcttttgatgatatttccgcttggatgtttgaagaatttgtttgtcggggtcactgccttatcgcttaaataagcaaatgcaaaagacccggaaacgaggttggccccgacagttggactgtagagaatactngacgtcgttcccnnttccagatggcaagnngaatgattcgggngagnncggtatttaattcccgnaanattntancctntncgngnnatgnananagnncntccntngncnncntncnccntntnannacncantntncantncgncntnncatntantnnggttgnnnttaacntnncccggnnnatagtttnnnctcgtaggnannacctgagttccataggatcgggaggtggcaaaggaacgagtggtttcctcttgctaaaatagttcaaggtattgccatagtcttcatcaaaaccgtccttgaacaggattgtggcacaatccggagtctgaatttcttcattctcgacggacggctgctcaggaaccttctcatcaatcgagctagcgaaagtggatggttcagcaaggggctcgatcgttagaggttcctctatcttggacacggatgcctccggctggggttcattgggttgcgtcatgaaggaagtattttctagaatgcggtccaaaattttctttccttctgacggtgttttgtgcatgaacgattgacggagcgtggggctcctcaccgggagaccgcgcaggcccccctttgccggttcggccgggggcgctaagtgaggttcttcgccctcgatcaatctggagaatgttcgcgagagagcaagtgcacgagacacgggcgatgtagacaggttcgggccgctgagaagcgtaataccctactcttgtgttctggtggatctgtgtgtgaaggagttatagagagccggagagctagagagttcaggctccagaacccctctagcctcctttttttctttctcccccctttttggtgggcaaggtcctccttttatatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggccctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgttgggttggagtctctggatcagggatgacgggcgggtgacgcaggagcgcgcccgcagcctggagcgcgccctggggcgtgctgccatcaccgtagatgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccattgcctgttcggccatggggctgagcgggagaagcttggcgcacacgaaagagaacgagggcttagaaagacacacgcgccccctacctggcgcgccagatgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctcctttttttctttctcccccctttttggtgggcaaggtcctccttttatatctcaaggggataccacatgcaccacttctacctacttttcttctgggtggggacctaccctatcttgaccaaaacttggcttgcaccttcgcctggaagctaaatcacaacttgtccttgagtgaggctcagcgccgtcactcgcctgacaccggggatctccttgttactccctcattaatgggcgaagatttgccatggctgctttccaaatgaccatccgatgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgtgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccactcacgtggcgccaaacccacagggggtcggggcgccccagccctcggggccgaaacgggagcggcccgacccctcggggagacagagggaggggcggccacatcactctcgggcccgaccccccccgagggggtcaggccacatgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataatgagcggctttcttcaagaccgctacattacttaagtagcgcgcgaaccgggacgagccggttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcccctctgaaccgctacgacgccgttcttgaccgcctggcgggtctgcgatcccaggggctcacgggggccatggtgttcggcgactaccttcgtcgccggatcgcgccactccagcggcgcgcccggggcgcctgggagtacaccaggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccaaaccatgccggggaaacctcatctcccccccaaggtggtcgtttagccgacctcctcgcaggttcgtccccgcgcccactgtggccgtattcattctcccaaggcgagttttcacttacccgtttctttttgtcttctggtttttcttccgctttcagcgagattccgtcgcgcctccctcaccattccaagtccggccggtctgaggccgaggagacagcaaccgtggaggcccggaggcgggaagctgtccggcgagaagccgcggaccgcctccgggaagctgaggaggctgcccaggaagccgtccgggttcgccaggctgaggaggccgctcgggaggaggccagactccgccgggccgggaagtcagcccgggaggcagaggcgacgcgcgcacgccaggcggcctgccaagcccccgacccgactccgcccgaggcgacgacgacttccgaggccacccacgatgaggccgcgggcgcgccgctcggacccgacccttcgggcgacgttcgggacgagccagcctcgggggacgcccctgagtccggcacgtcgattggcgggccgagccgcacagcgcccacaccgaggcggctctctcctctgccttccgccgccccactgaacacagagcccctcctgcaggccctggccgccgcgaacacgacggtgctggacgggttaggtgcccagatggaggtcttgcaagcagagcgggcggagctcgacgcggcgtgggcgtgcgtcgatgaggggcggcgctcggtggaggccatggtggaggcgggccgcaaggcataccaccggcacgcctcagagctcgaggtccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacaccgcccggggagtccttgacgccgccactgcacgggaacggcgggcgacggagaacgaggcggcgtcccggcggcgcgaagtggcccttaaggctcgcgccacggcgctggaagagcgcgcccgcgcgagggagagggacctggcggaccgcgagaccgccgtcactatccgggaggcaacggtggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccgcgaggcagcacgggaggagcaggcgcgccgtaatctggaaggcgccagcgccgagagggccgcactggatcagcgggccgctgagctcgaggcgcgggcgaaggagctggacgggagggcgcgcagcggcggggcggccgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccatctagaccgcgccgggcggcaagcggccctctggggcgagcggaccgcgaagtacgccgccaaccaggggggcctcgcccagcgcctctcagagatggccgggactctccagcgcctccccgaggagctcgaggagacctcgcccggggggcagtggagcttgcactggcaagctaccaggccagggacccggacttctccccgtgggcagcgctggacgagttccctcccggaaccgaggacgatgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactagccaggccgggagcgcggtgaccgagggttatggggacccgattgtgggcctttgccgattcccccccggagttcaccacgtcccggggcacggctcggttctgggccccgtttggcgatttccgccggctcgggccaccgagggcagggtcgagcacgagcgtgctaattcaagccaagactcttcaaaaggaaacaatggcacagacacagtccttaggaaatcaaaaaagcttttattgaaatacggaagagaaaaaagataagtatatgcatatgtggtagcccccggccaaccctgcacgcccgaggggggtgcgaggttggccagagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtga

SEQ ID NO: 78703 - DNA, 2516 bp, Oryza sativa
  unsure (1)..(2516): unsure at all n locations
cggttannaacgttgagcgctccnnnnnnnnnnnnnnnnnnnnnnnnnnnnnnnnnnnnnnntgtggtctaccagactgagaagcaactgaaggagctaggtgacaaggtacctgcacctgtgaaagagaaggtggatgcaaagctcaacgagctcaaagaggccattgcgggtggatcaacacagagcatgaaggatgccatggctgctttaaacgaggaagttatgcagatcggccaggccatgtacaaccagcagcctaatgctggtgctgctggacctactcctggtgccgatgctggaccgacaagctcaggcggtaagggaccgaatgatggagatgttattgatgcggatttcactgacagcaattgatagttctagcgattgaagattattgatggaaggatgatctgtggtggatggctgtgagggtctgatgggtgatggtataggaagaagggagtgaacaaattgttctttttgtttactatggatcccatgttcaataggctctttagtttgcaatttgatagcgtagggttttgccaacattttcctgtgatgttgaatgaaggattataaaaagtagccttcaaaaaaagaggaggcaaaggttttgatcgaagaagtagctgattgatatgaccttgttccttgaaaataaaaatatcattagttccctgtgcattttacctgctagaaactaaaattagcgcgtggaacatattgtccttttttattttgtgtgacttcctgcatttcaaatagaatgagaaaggttggaaatgatatcattttttattatttttacgctgttgggaatttaactatgcagtgacgaccgactgatagaaattgaaaaaaaaaactaaattttatactccctttatttacaagtgatcatcatatatatttttttggggattcctttttcagaaatgattagcatatttggtacctctcccaacatctttttgttctttgatgcactgatcaaatggactgcagatcatttttttcctttttggtgttggtgtaaacatctaatataactgatcaattctaaattgagggagtatgtgactagaaacaaaaaacaaaaatggttggaaatattatttttatgaaaacgatattggtatggtacagaaattttcgcagcgttttcatcgcaactttcaaaaggataactcaagttaatgtcacataagcacatttcgtccagttcgtctgtagaggtgtttttgggtttgatttttcagtagttttgacaagaaaaacaactatgcctgaagatcccggtttaatgaagaatttaattaatgattgcacgattgcgtttatgcagaaataacaaacatggtcacggataccaaacagttaaaaacattggaatgaacgtgaatgatgagaaaacagatacaggaaacgtacaactaatgatctaacaatatattatgctatctaaacttcgtcagttccacagctctgcatcgagtatcagcctttggatccctggtgctgccgaaggaacatagaagacgatactttctccgtttcacaatgtaagtcattttagcatttcccacattcattttaatattaatgaacacagaagacgatactttctccgttaaacaatgtaagtcattctagcatttcccacattcactttgatgttaatgaacacagaagatgatacttcctccgtttcacaatgttaataaatctagatagatatatatgtctacattcattaacatcaaagtgaatgtggaaaatgctagaataacttacattgtgaaacagaggaagtaatttgctaaagcattttgccagaaaacaaaaattaggaagcatctcttaaatattctaatgttccaggtcactacattattacagtgcacagcttagcatatttcaacagtaaatcatgtagtgaaaaacagatgatggaacctccagagagtatccagatcagttctttgcagtgagggcattctgctccttgatccgagctcggttcaccagcttgacgaaccgtttcaggtcttcataggggagcgtcttggcatctttcctccgcagctcactcagcatagggcgcttgtcgagcaggtgccacagccactcagggtattcagaatctggctggagtttcggatcagacccctccttgaggatatttgccccaaacactgttgtactcttaagttctttgctgagcacaggggttttagcagcatcggccgcaccctttccgcccttctttgccttgcttgcaattgcaaatcctcttatgccaactacttgagctgcatctcttgggattacaccatgtttcagtactcttctcaatgccattgccattcctggatggaagcttttaactgcatatatcggtaaatatcagtgctgttgaaaaagtttctgcaagcaaataatatnnnnnnnnnnnnnnnnnnnnnnnnnnnnnnnnnnnnnnnnnnagcacgatgctctcatcccgcgcg

SEQ ID NO: 78704 - DNA, 1714 bp, Oryza sativa
aggtatgtgtaacttgaattgtgctatattatttgtcaataatagtgccaattttgtggtaacacatgctgttataatgagttctgtggcctattggttatatatattgtaccgttccggattctcacttcgtgagattacctgatccttatacgaattatctgaatgattgcgctcatgcttacgttcttgccttttgtagctattgcatcgcaaagttttcatcttgtaccaagctggtgcctggttcatctattgggtttcataaaaaatttctggcagctagcaataataggaaataacacaaactgttttgagcaatagctccaatgggctctttggaacatatagtggttataatacacgaagtgctggttttcctacctactaatatacagttagattgcaatctgcaatattattttggtaatggatatatcctttgtttacagccattacatgtttcagtttttttactggtcttcactaagcaacttttgctgcttagttgtcacctgcatcagaaggcagagaataacttaactttacatgagataggtgagcccaattttattgaaacaatattttccacttgcaattttgtattcagattaactaaaggttgtccccaatattttctcttctcagtatagctttcagaggtgaaaagagaaaaaggagaaataaaaggaggtagcagatcactctgcatttcaagttgctgacctagcctaatcaacatgtcaaatgtcagacgtgtattgagtttgatgtactaaccactacaacttattgaataagtatgaattgggttttttaccattaacatttaactgctgcaatggataagtacaaatgaggatatttagtattaacatattactatcttttatagacacttgtatcagtctatctccattacaggtgtaacttctgttggtttgttgatatcacaaaaggtaaaagaaaaagtcgccttaactataagtctgtaactgtacaatatggcatatggttcaggtaatatatctgtaaagctttacaaaatatctccaaataccaatctaatttgttgtccagaatttaatcttactaaaggatatcttaatgactgataggagttaggactttatccaatttggtatgttttctggagctatataaatttagataattgcttatggaacaagttttctgtagtagtagatgttgttcaaatgatctgcagtgctctacgagtaaatggctttgttctttatttttgctaataaggggttgaaagcatggctgcaccagtactttctttgaaatttaaaggacatgaacgcatttgtggtactcaacagtttgattctctaatttgactcggtctcattatgcaattgttgtaaattgggcatgacccaagctgtataaaaagagaaggcaactcgccatcatgtactttttgtttattatcccccagtgcagaatatatacttcattcccgaacatttgagtcatctactatcttgcaatatcactcttcctctccctccagctcttttgacttgagcgcaatcctctccattccactctccgcaagcagtcccatgtgagttatccatataaacctaagtctgctcatcttttatatttgcaaccctcgtgtttcttaaataaagtgttgattgttcactgttagtctatcatctaccccaaaggtttggttgtt

SEQ ID NO: 78705 - DNA, 1420 bp, Oryza sativa
  unsure (1)..(1420): unsure at all n locations
acggcnattgtagattgacttacnnnnnnnnnnnnnnnnnnnnnnnnnnnnnnnnnnnnnnnnnnnnnnnnnnnnnnnnnnnnnnncagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttctttcagatctagaagagaagctagtagggttaacgaacgcaagcgaattcaaggtcccagtggggtgggggagagagatgaatcagaaagaggctcaccaggatcccctcccctactctcctcgccagatggagatcggcagccgcgactcgtcttggcggcggcgcaaggagcggaggaagagccaacgagacgggagatttctctcttttacgcgatatactcgactactgcccaaatgggccgcccggcccggcagcgcccaagcacgaccggacctaaggcccagtcaaggccccttctctttggacagtgccttataaggctgcactaagtctattttgggtccccaactatttttctttgacttatataaggctgaattgagtctatttaggctggattttccggattgaaactacaaagcggtatttttgtttgaagctatgggatcaaagtccagtgtcctcgatgcaaactttgtctgatgaattgacaacaattaatcagataatacagttgcatatgaaaattactagttatgtatgtgcgcagataaagagatacaaaaccacacatcaagtgtttattctatccatatactgtcaggtttatattggctgtgtgtgacggggcaaatatcgatcggttgtgtgtggcggggcgacttatgactacaaaggtggagatattagggatggggggagagaaaa

SEQ ID NO: 78706 - DNA, 1877 bp, Oryza sativa
aaagaacgagtgatgagtgaaaccacttgctacactatatggggaatagatagaggtagagaaatgggagaggtttatcctctctttctcaaaaaaaaaaagaaaagaaaagaaaggacccaaccgtgatcaaccactgcctcgattcccttggtcctccgagaatctcgccggcgatggctgggagttggttactgcgccgcgttctcccaccccagctggttatttatagtgcggcggcactcctccattctcctccattccctaatttgtataatggttctctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcagaaatcgggggacacacaagacaggcttcaacgggacgcggctttgttaaagacggtggtcactgacttctacaacacaagatttggatagaatccatatgtgatgcggatacaggggataggatgaagatttatgccttctagtggctgcagtttctgttttttttttctctgctgaatcttgttcccttttgctgtaagactgttaaagactttgtattcttatttcgttaatgaaatgggagaggtctatcctctctttctaaaaaaaagcccaaccgtggtcaaccaccgctgcgattcaaaaatttcaactcaaattttaaaattcaaaactttcaactcagaattcaaaaactttgaaatcaaattcaaaaattttcaagtcaaaatttgaaaccttcatatgaaaatccaaaacttttaacccaataattattcattttttattaaaaggctaaatgataagattagagaagggattagacgacctaagcatatacaggagtatcgctaagcgctaggattagtgcgcgcagctagcttaccgttgtggcgcgtgcgcgcgcactggcagcccccgaggtttatcctttttttaaaaaaaagacaaaaaaagagggaaaaacaaccgtggtcaaccaaccaccgccgctattccctggcgcaccgggaatctcgccggcgatggccggtagtttgttacggcgcctcactggctatttatagactacagtgcggcggcagtggcactgatcccattctgcgtcgagctgcctagctatcgatcttcgtacgtaaatacgtctccctcgtctccggcgagccaccggccgtgagagatggcgccgccgtcagccatgaacacgtcgagggcggaggagaaggccatcgacgactggttccccatcacctcctcccgcaacgcca

SEQ ID NO: 78707 - DNA, 7237 bp, Oryza sativa
  unsure (1)..(7237): unsure at all n locations
gcggaccagctccacggcaacggcggcggctcgaacgcggcccgtggcgacggcgacggcgcggatccagtccgcggcggcgccggcggctcggacgctgcccgtggcgacggcggcggcgcggatccagtccgcggcggcgccggcggctcggacgctgcccgtggcgacggcggtggcgcggatcctgtccgcggcggcgccggcggctcggacgctgcctgtggcgtctgcggcggcgcggatccagtccgcagcggcggcagcggctcggtcgcggcccgtggtgacggcggcgtcgccgatccagtctgtagcggcggcgatggtgtggacgcggcctgcggcgacagtggcggcgcgagggctgtctcccacgtcgttgcttccagttgctttcagttgtgtcgttgtttcatggtgcaggccatctctttctcagccatctccatcatctcagcaggacagaagctgatttgcagccattcaagtgcttcttccttgaaggttggctgttcttcggattcatctatcctgttgttccctaacagaagaaaccatgtagggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgatgttaggttatttcaggaaggttgctttcgtagttcagttaaccctcctttcttaaggatggctcttttgcttggatatgtaatggggtttattccctagatctgttcctgcttaataaagttgatgtgttttcaaaaaaaaaaaaaaaagccgtggagtggaggagagaggaggccatttctgggaaaagggaaaaggcctgtggcgcgcgggccccgcgggcgctgaggctgacgaggaggagggttggctggcggtgtggacgtttgtttacgaaaggcgcctgcacccggcgtgttgcagcgcagcgcagctgcggctgcagcatatgactcgtgtgacatcacgagccaggttgttttcgtcgcgttcctcgcatgcagtgcaggcttttgctagcagcttcccccgccgtctcgcgcacgggagtttcgccgggcgcgcggcccggccggccggctggctcgatcgtcttctgcgccgagcgcctctccatcccgcgggtttccgccgggcgaggaggacgcgcgcggggatcgtgcacgcgagtcgcgcgcggtggagtttgcgcggccaaatcccggtaatcgtgggtgactcggtgcgggtgtgcgtggtgatcgactgatccgcgctagggtaggttggacgtccgcgcgcactcgatgtggtgtgtcacgcattgggggtgtgctttggtgagatcgctgctaacttcctggcacaaaagaaaaatcgtggtagtgagaagtgtaacacgacgtcctaacaagtgtcggaggtagcgcgagctgtaccccttcgtggtagtgatacacggcccaacattgttgtgaccgcattaaatattaacatataatcacagttttactcttatatatgaccaagatgttgtatatacataccacaaagtgcttttgtgaccgcattaataagccagttttactcctatactactccctccgtccccaaaaaagacaaaccctagatttttgtatccaaaggttgaccgtccgtcttatttgataaaattatgaaaaaaaataaaaagacaagttacgcataaaatattaatcatgttttatcatctaacaacaatgaaaatactaattataaaaaaatttcatataagacggacggttaaacgttggacacggaaacacaaagtttatcttttttagacagagggagtatatcagaaagtaaatttagtacttcctccgtttcacaatgtaagtcattctaatatttcccacattcatataaatgttaatgaatctagataaatatatatgtctagatttattagtatcaatatttaatacgagaaatactagaatgacttacattctgaaatggagggagtacgtctgcaaaggctgaatcacgtgcttagatccctgacccctcacgataggagaagctaggcacatagtagtggactttttcatgcatgcatgcagaaggagctggcagggtgaatgaagcaatatcgcatgttcttcatgaatcatgaggcaagataatggaaccagaggactttcaacttgggcagcaaattgatggtattgttattgtgtttcacgctaactcgactatttttttaatgtaatcatttgacatacccttttttttcaaacataatggaatataaatacccaattacgacaaaccggagtgttttttataaaaaaactttaaaaaaaaactacgacaaactggagttcaatccatcaatgatgagctcaaaagcaaggatctgattaaacttactagcagtactactagcttttgactgctaattgtgccgattagagggcaaaacacgtgccaaaacctaacccaataattgggcaggagtttcgttgcggcccggaagcacacacataaagattgattggtcgatcgttcgatctaaacaacccgcaaaagccaggccggagaagagagcgacgccccgggccgccacaacccgacgcgtagccgctctctcgcccacccgcgcccactggggcgttgctatagctgccaactcgaaaacaccccgcgagtcgccaactcgccaccgcgccgcaagccacaacagacactgtacatcattaacaaccccccggatgcggcgcccccctcccccatctccaaacggcgttgcgcgccgcagaaaaaatttcggcggagccgccacgccacgcgccgcgtccaaccgcgtgcaagaaaaaacacacgtccacttctgtcgatccgtggcgaattcgtcacgtacaccgctcggcttttcaccatcggcacttggaagttgaaagtgcacgcacctcctgctagcttggagctggagggctggaggctgcaacgaggggcatcagcatcggtcctgcttcttcagatcatgtgaacggtttattctctccggtgcttaagtcaatgctttttattctacaccaaaccaactaccagatgctgacacgttttacttctactgctcctacgtactcctacctgttcttggcacaatcaatgactgagtcagtcgaccattcgacctatcgccgagacctgttctccctaatcaagtccatgactgcgattcgttttcggtatcccacataaacaaaccggcctagattccacaccggcaccgcgatgtgaataaacaaaatcatcattgcgcgaaactcagtagctaagagcacccgcaatggtaaagtaatgtgctatctataaaacatgtacatctcagcaatagactagattaatagtaaaccatctcaatagtatgtctacatgggtatctatagctctttaatacattgcctcgtttttctctatagactatctccagattagtagatagctttgctctctctcttcatttaatctcttccaagtagaaaaatatgctgacatagatctcttatagagagtctatagataaccattgtgggtgtcctaagagcacccgcaatggtaaagtaaggtgctatctataaaacaaaacatgtacatctcagcaatagactagattaatagtaaaccacttcaatggtatgtctacatgggtatctatagctctctaatgcattgcctcgtttttctctatagactatctccaagttagtagatagctttactctctctcttcatttaatctcttccaagtaggaaaatatgctgacatggatctcttgtagagagcctatagataaccattgtgggtgccctaatacttgccatcggttatccaactcgttaacctagaagggcctgattgtgatgtccgtgagattgtcggtaaggcaaccaggcaactaggcagccgtttcctgggtctcgacaaaatcgagcggcggcagcagcccgaccgcgagaatcaaacaaaactcaacaacttgcatgctttagcttgcgcgatgcccagtactaatattgtccggcttcgctgacagtatacgggtgtccaggcctcgaagtccacacgtttcagcctctaaatggatgggaactgtcaatttggtgaaccatgggctttggctgtatgtgaaccagtccaacgccgacggcctaggcctctttgctgccttgaacattttaggccttctgggccagagtgattatatcattttaggcccccccccctttttttttttgccagagctatttggtcattagaactccagcactgtaattttgccgtgccataaacttgagaatgggatgtgtagtgtactaatacttactgttgatcttaaggctgtgttctttggtgtgcttgggaacaaatcccatgcaaaaaaaaaagaagtggtagattggtgaatggttaattaaataatagcttcaaaaacttaaaaatagattaatataatttttaaaagcaatttctctattattttttaaaaaaacacactgtttaacggtttgggaaacgtgtgtatgtgaaacgagcgtgtggagattaggaaccaccccacaaacgaactcagcctaagccgagttgttagcattgtccattaaaatctaatagtgtggcccgcgcaattacatggctagcgcctatataactatttttttacacataattttctttaaaatttactacctccatcctagaatataacaagctttagagttgaatacgattattaagaaaatagatagaattaaataggaaaatgttgtgattggttgagaagttgaggtacgtggaaaaagtgaatggcagagggttgtgataggttgggaatggaatgttgatgaagaagttcttatacttttggacaaatccagagcattaaaaattgttatattttggtacgaagggagcattacatagtcatctcgttcttaggattttaaaaataacaatttaaatttgagtaaattgtatattgggcctatatatttttaccagtgttacaccttggaccagagacaatctaacttttccgctatgaaccacttaattttacaatcggcttcagtttggacctctgtttcctcaagttccctctccctagtccctccccacttctccatgttgcagggacatcaccggtgaaaacctcatccgaccggcaccactgctccactcaatatcggccttcacatcgagcctccgtagcactgacgcgttcgacctcgagtcccaccagtatcggcgccggcgcaataacacccttcagccaagctagcaccacctgtgccccatggctttggcccctatcttgagctcgagctcgaccggtcgatatcatgctccatctctagctccgccagtgttgatgcaacgagcgcttgagctcaagttccatctttatccctgcaatggccaaggtcaatggagatttttttttgtgctttctttctaagctcaagtgcaaatatgtgtgggggagatattgagatgccactcaagagcgatgccggcgagctccgacgtgagcgttgtggcagtggcggttgagcgttactcgacctgctcatggtggttcctagcgtgaggaaggagagagggaaagttggaggtagaatagcatgcccatggtgaaatatttggtattttttcctagcccaacttgaaaatgtcagcttacccccggtccaaagtacaatagtggtaaaaaaaatatggcccaatatacaatttagtttttttaattttatagtttttaaaagttacanataanntcccctctactccttttcgtttgcctcctattttcgagtcacataacaataacaattcagtaaacatactcacgagaaatgaggtaatagtcagattggagaaaaacttaaggccccattgacttacctttttggattgactacttcattgttctatgtgagcacgttttctaaacggttagttttctttaagttccttttcaagttctattaaataaataaatacactttacggtagttaatattcacagtatgatgaatccgaaccaaaactttctatattttgggacggagggaggagggagtattaatatttagggcatgtttactgtgctactattttcaaccttaacaagttttggcattgccaaatttcgataaggttaccaaaattttggtaaatttgtcaaattttcgcaagatttcatatgtacttactaaaatttggcaacaaactaaatgcagctacttttttttataacttaaaaaaaaggtaaagttaaaaatggtaacaaagtgaacaagctcttaaattatacattaatgatttagctcgtcttaggtgcggtggaacagctgagcttaaccgcaaagcctgtttctattgagaggacgcaaaaactgcagtggaagaaacgaacgacagaagctgccgtgcaattcgtagttgcgtttggttctcgtcgagaggtcgagtaataactttggaagaaaggcaaaacaaacgcgttgggcttaacacagtcttacacagatcgcttcacttttacacgaagcccctcgcaattcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggagatggaggtgaagctgtggaacgacaagcgggagcgggagctcctggagagcctcgccgacctgtacgccatcatcaaggcgacggagaagctggagcgcgcctacgtccgcgacctcgtctccgccgccgactacgaggccgagtgcctcaagctcatctcccagttcaactccctctcctcctcgctcgccggcgtcgtcaccatcccccggttcgtcgaggcctaccgcctcgactgccctgacgccctcaaccgcctcgttcagtccggcgtccccgccaccgtcgagctccgcgccg

SEQ ID NO: 78708 - DNA, 1314 bp, Oryza sativa
acaaaatggatctttttttctttccaaacaagtgctgttatctggttaattattttattttgccaaatcccactttattagtcaacttgtcattccgatttttagctaaaattttccatccttgtagtccatgttttgttggccagttatattagtcgagttatggctaaggcagcattccttaggagaataaaggaaaaaatatctctcattgtccactcgtacgcttctcaaatgattaaacgggacgtttttcctaaaaaagaatttctatataaaagttgctttaaaaatcatatcaaactattttttaagctcaaataatcatatgttaatggtttatcttgttttacgcatcttctcaatcttttcatttcccctccttccaaacacacctaagtcaaataaccctatggatttttgtgcgcttatataccacttctacttttttttaccgaatgaactaaccaatgtctggatgaatttagtattattgttccactggataaaagaaaattcaattggaacaacttatgttccaaaaccacgaatgcattcccggcgcttatgtgaagcaaaaggaaataagaaacaccacatgtatctagaaatatatagtagtactagtaattactttgtcctaaaatataaaatttaatattaaatatgcatttgaacagctataaaatataatgtgtaatcgtagttttttatattttggaacaaaagtagtttatgttttggaacaaactgcaggggtgaaacgcaaaaactgcctctacggcctccggcctccgcgtcgtatctgcgaggacgaggcgtggcggtagggggaggtctcggattccggctcccggcctccctctatgcagtttgcaccgcacccggatgcgaaacgtggcccgagcctccgcctacaccgacccgcggggccctcggttcgtcgcgtggggtccaccgagcagtggcagaatcaccggccgcggggccccgtcatgggagaagccgctttttttttttttttttggatgggagaagccgctgatacgctgggtgaagccgtggagggggcacacggagaacactctctcgaaccctccctcgcctgctacagtaaaattcccctttctcgacccctcttcctcctcgattccggcggcctcgtcgccggtgacgggagggagaggggtcgtccccctcccctagtttagtatagtagtcgggctagtctcgttaggtcgggtttttcccgtttctcgtttctatggcgatggaagttgaagacggtggcggtggcgcgattgaggccggtga

SEQ ID NO: 78709 - DNA, 7208 bp, Oryza sativa
  unsure (1)..(7208): unsure at all n locations
gattactcgctgacggaggcgacgccggcggggaggacgttcaacttcctgagcgcgctgggggacgtggcgttcgcgtacgcggggcacaacgtggtgctggagatccaggcgacgatcccgtcgacggcggagcggccgtccaaggggccgatgtggcgcggcgtcgtgctggcgtacggcgtggtggccgtatgctacctccccgtggcgttcgcgggttactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtctgtaagtgtgctagcatgcactaacacacacacacacacacacttgattagtgatccaattaattaattaattaccccctccaaaacgggagaatttaccttttgccatcctctcaaaataccagttctcaaatgccactctcctaaaatttcatttccaaataccacctgggtccacatgtcagcctcttttcccattcaaataaaagtgacgtgggactggatggtgtgtgaggctgatatgtgggcccgggtggcatttggaaatgaaattttgagagagtggcatttgaggactgacattttgagaggatggtaaaaagtaaattatcccctccaaaagtattttctattataatacatagaaatattaataaatatatgattttattgaagtacttttttaaaactaatttacacatacggttttcatatttttaagataaatattttagaaattattaactaatttaattaataattactctctctgtcctcaattataaggcctatattttttttacacggtttttaataacatactttaactagtatcttttccatttcatgatccaaacaaatataaaattagcatcacataaaagtactttaaaatataaatctattttgaaatataaatctattttgaatttactgatataacatgcataaaatttactgatataacatgcataatatttagtatagatatagttagtataattattaataaaactactaagtttgatttttcttaaaaatagagtgtcctataatttaggaccgagcgagtagttgtcaattagtctatcatatgttgttaattaggatctaataaatcttaatttgtactaattttggagtattgaatttcgcagtgttcaccatgttcgttgccatcgcggtccctttctttggtggactgctaggcttctttggtggctttgcgtttgctccaacgacctacttcgtaataatctctaccattaatttctttattattagaaccttcattaaaaatgtatataatttaaaatctctcgtgcgtattaatctccgttttttctaactgaaatatgaacaattgttttttcagttgccatgcattatgtggctgtcgatcatgaagccaaagaggtttggcttgtcctggtgcatcaactgggtaagtagtattatccattaattatttagcatgtgcatggtcaattaactaacttgataattatcctcatctgattgttaattatatatcttgttaattttaattctttatatatttttggtgcctcagttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagtttttacacgatttgaacttgaaatcaattactttcaattcgactcttgcgcgagtctcactaaaaaaagttatcgagtaagaatatcgagtaagaaaaaaaaggatgttgctgtaccacgggaaagcatggcagatggcgagaaccaggtacatgaacaattaaccaaaacatcataaacatcatatgtacaaatcagcacaaagaaacttcagccacgctacaagcagttcgctgggaggaggtaaagtctcttgtacactcaagtaatatattgcagtaggagcctctccaactgtttttccgtcaaaaaaaaaacctgaggagagccgacgctgaaacaaaatttgacccaacctcacacctctgggaggagagtgccgatgctgaaacagaatttgacaaggtttaagagatcacacgatttcaaactgaggttgacgataattgcgccccattcctttggtagggtactttgccatatcagatatccattgcctcggaggccgatgaagcattcttcttcttgttctttcttttcttgtccttagggtccttcccctgcttggcggaattgctctcctttctcgcagagggtggctgtgttgacaacaggtgctgatggatcgccgcaaacgggtcgagctggaactgcggattggtcagcacagcattcagttgggcagcctcccgttgcctgaaaggagagacaaagccagtcaaaaaccataagtggaaagaaagcanagaacgcaagtggaggggcagatgaggcaattacactaaagcctgcttcgatttgcagtccagttttgcttcggtgtgcagatttgaggcatctgtttcaggaaggaactcagagagcattgagagatcatatgctttcagtttcttctggcggctcctctgtttagatttctgcacaaagaaatttaaataatcacaacccataacactgatagtgcaaagtaaagcaagtgtaacttccagaaaactacaaatggagtagcccagctgcaataaaaagaatcagttgtaaggaaggacagtgtggagagattaaaggccaagaacagaacggagagactaaaggtctcatttcagcatctacaagtatatttactctaaaatatagatgcattaacatatgaaatgaacagaattaatgttcgcagtttgtgtctagaatatatgaaaccacaagattgtaactatatgttgggaaattcatgagtcaagagccaactggtcttggcatttgtttttccatatggagttaggcacgtatgggtttcctaggatcctagtcatcccatcacagtaggagggaatacaggagacagtggatcatcagtgcaagtacaaaaagcatattagggttccaagcaggtcccaagtacaaaatccattctcatatctgtttatggatatggtgtggttattttgctagtcttcacatgtagacaagcatttggatgacaatataatactttcttacgcagataatttttagcataccacaaatacacaggacaagagactaaacatagctagcgattgagaaaatcagacttacaaatatatacttgaccaatacatacaatttggaatttatccttgaaatatctaagcattggttgcgttatacgcccacgccactcatggagcaaaacaataacagtaaaaacaagctgcaacaacagaagctacagaaaatattcaattgcaaccaaaggtgaaaagccatacacccatagaatctgctgaagtctgattcaagctagaggcatgtagatattttttgccagggcatggcttgtttctgtttatactttacagctgtcatgtgaacaagaaacagctggtctagttcacgtatggtggacaccaacacccctagtttggatttgttcagcaggtttattagatgaacgctccataatattttttggttcaattagtgaacaaataaggccataaggaggacaatatgcttaatattattgcatagtgtaattgattccccttagctaggtgttggctgtgttgagaaggattcaaaggttatggtcatcaaggccatgttaaaaacagagaatagctcctgatttctttgctaaactttttgtggcttgtgctagtgatgcattacattataccagggttacaaacatgacaaaaaccagtgagtagtaaccagtgcttggttttcttgcaatagccatacccgctatagtgaactggaacctagacaagcaatttttcgtctcgtgctattagaggaactttttgttcaaataagttttgccagaaagtgcctggttctgctcagtactggatgggttggatgtgcagagcacattccttaagaggtaaattccacctagcaagagactagctgaagagtgcacccacactatttaaaaacccagtcttgcagaaattatttactattagtatccgggaggtcctatttctttcttagctacaacctacaaatgccacacagaggttaattggggaactgtgcacagtaatcagtcatgaagcatagatatttcagttctgagtgtaacctaaaaaatatgggattacgaattgagatctagcatgcaaaactggtgtattaagtcaatagaaacagaaacgacaggacatgatactaggtagttcgaattgtcaaaaatccattttttgggcaagatagtattcaatgtttgtgtacgaggaacacacaaatttgcaatgctgaagagaattaaagaacactataataataaacgagagggtctataagcaccttgcagatagtctttgtagcatttagggaggttactgcatctttcacttctgagaaacaaaaacaaaaataaatcaattatactataaaccacagtaaacaaaaaaacatgctattccgcaaaatatagtcaacgactcaaggtagacaagaaaaaggtaggaaaatgaaacagagtccagctagcagtaagcccaatcataaatcgtaatctatcaatgtttcgactttcgagtgcagtaccacaaactaagctactatctactttacaatatacatgttctgtaaacacaagtaatctacaaaataaaaggtatactaaaaaggctacaactatttatagaaaacaaaagaggttttattatcacaaaacactaaaaacaacaagcatggaacatgaacgaagaagtatttttattcatggataagatatttccaagctttcactattcaagaaaaaaaaaagcattgccccttttacagacatattaattttcttggaataaactaataattagttgtccttctttacaaaaatgaataacaagcatttcagaatagcagtgaagtaaaacataacaagccaataccaccatcctctggtcttttgaatcaatctctatacattaatcaacatttgccttatacactccctccatccaaaatataaggcctatcagtttttttacatgttctccaacattgtattttggaaattaaattatcttacaacatattatcagcaattacaaaggtaccgttgtatacgaaataccacatgcatgacattaaacatatacattgttagttcaattactagccaaagattgcaaatgttgatttttcctggaataagggagtacagccaaaaaataatggaaaggcacacctacttgtgtagaagctgagcttcttctcaagcttctgtttggacttcagttcatgcttcttaggtgacccagtcctgaaagcaggggcggatccaacttgggacatggtggttcagttgaacccccaaactattcggtgaacaaacaaacaaacaaacaaaatgttactagctagttgtattaagagaggtttaaggctctcaaattaataaggaggaggagaagagcttcttccagatctagaagagaagctagtagggttaacgaacgcaagcaaattccaggtcccggtgagagatgaatcggaaagagggctcaccaggatcccctcccctcccctccccttctctgctcgccagatggagatcggcgcgccctgccctgtgtgttggcggcggcgcaaaggagcggaggaggagacaacgagagagagagacggcagatttctcttttcttttacgcgatacgagacgccagggcccaggcacgacccgaggtcagtcgggccggctgtgccgtgcccacgggctgcatccacggcccagtctaggcacaataagactcgggctatgccagccgatccaaaggcacgatagtccatcgtgcttttctacaaaataagtctttttccgtctcttatctctttgggttgtgtcatatatgatggaataagtctatttatgtccttctctttggacagtgccttataaggcagaattaaccccaactatttttctttgaccatgccgtgctgggcagccccaccatgccaaggcattggcccaagcacggcccaattattgggccaagctggcacgagcccgacaataattgtgtcgttccatgcttggaccaggccaaatggtcgggctgtcgggcctcggccttatggccatctatagtctactccaactttatcttaatatttttactattttaaaactagttaatagtatttctttatgatgactggtgacccacatatcatcaaaaattaacaaacacagttagcgattgtgtcgacaacaaatttctcagaccactagcaaccactaactgatactccatgcaccgtcatcaccgctctttctcctgagccaccatcgttcctcctctttgcctttaccgtcatcaccgacatttctttttctcctccactatcgttatgcacactattgttatggttgcattgaggtcggggatgtcgggcgtgaagggactgggaggcaggagttgacctaacaaaaagcgaagacgctatatccgtgctccttcttgctatacctagcagttatcaaacggagggaaaaagaaaatggagagagagagatagtgtgcggagtgattgct

SEQ ID NO: 78710 - DNA, 553 bp, Oryza sativa
ttaggcattgcgtgccttgaagttaagggcaggaacaatccgaaaaggtaaaaaggggacgaatatatatcgagctttattcgtttccctccgatccatcacacgcactcgccgatggatcagctgctgacagcggcgcacgcaggatggtggccgggttggaacttggaagctccaaacaccgcgagaagcatcatcactcagctgcaacctgaagcaccgtggtctataaatatagctccaggacaggctctcttcttactctcacccagtatagttctccattgagcaaactaccaaagggtactcatctgaaacagaatgcagtgatcgaccaccatggatgatcgtaggtacggctactcgtatccaccaccccaaggtaataagcattatgatcacttgcagagttacattcatgatctatctcctcgttgattttacttgcttgattaatttgggcttgcaatgcgtgcgtgcagggtactacaatgggcccccggtgatggcgccgccgcagtacgcggctcccgccgccgaggcggccggagcc

SEQ ID NO: 78711 - DNA, 21349 bp, Oryza sativa
  unsure (1)..(21349): unsure at all n locations
ccgcgtttagtattgtataacctcatgtctaaaacatccttgaccatgacagatcaacccaatgaaactgggggctctacggagtattcaacgccatatgctattctgtaaatgaaacttgcccatgagaacctaaagaaatgctaggtgaaagaaggataatgtttaagtgccaatcactggtgctaacgaactcaacccaacaaagatcattggtttagaagtacctaccatacatacgaaatgcataaagcagcctctccaagcttaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttccttcgcgccctcctcttcctcccccttcgcctcatcctccgctcccttcgcctccccctccccctccaccttctgcttcttggccgcagctccctccgccgcctcctcgccagcagcgccggcggcggagtcatccccctcctccctctccctcttctgactcggattcgccgcagccggctccgccgcctcggcttccatcgcctccccacctgcggcaaccaccacctcgggttcagccatggccgggagctcgaagaatccgcggagacggaggcggaggcggaagtagggttttggaggtgttccaagcgaagcgagagggttaagtatcacgcgagagaacaaaagcgaactcgatgcgagcctagcccatgtgggcccaccagaggaaggcccggcccaagagcaaagcatcgggttcgcgtcttcgcgagggaggaaggaaggaagcaaaatgctgacgtgtacataaaccgctcgtcgggaaaaatgccactcctccccgcgccgttccgacctctcgctcccgccgccgccgcggcctccgccgcaccgcgccgcgccaccgccggagaggggggccgctcgtcgctcaccggggcgttctgttcctaagcatcggcgccgccagcgccgccgccgtcgcctgcaggacggggtgcgccttctcccgccgccgcttccccttcctcgggtaaccttctctttcctctttgctcttagattttgtgtggaacccgcgaaattgctaggcacgtccgaacatgcggctgctaaaaaattgaatcgctgaagtatggtacaagagtgtagtttatccatgttatgacattgatggatgtgtgaactttggaggttaacattgctacgcttttatctagtttgaattctatcttcttgtagtgatatctgaatgcaaaatttctcagggtaagaggtctcagctctgctcggatggagtccgcttccaccaccgtgccatccattgttgtgtatgtgactgttccaaacagggaagcaggtagtactttactgtgtttttgttcttgttatattgtgtgcgcatttcatttgtggaacttgctaggcaatatatttcatttcctccaagataaagcagttagagttgagattgatcttgcactatttgtcttgtgagcatcatgtttctcctttcaatattgttgtttagcgtttatttttttgttaattaattttagcatctatttctgccttttgtttaagcagtctttaaaagcatcatgtttcacatctactgcagggaagaagctgtcacagagcatcatcagtgagaaactagctgcttgtgtcaatatagtgcctggtttgtcactttgctcatcacttccgtttctctgacactatatgcctatgaacccagatcatatgtcagtgttattggccctctgtattccatagaaaacatctttattaccttcaaaaaatttaatggaaacactgaaaaggtttagtagaggtggcagtgtaaacgaattagatcaagaaaatccatcatatgtgggaacaaacccttttaaagctttgcttaccttactttggactgaaacaagaactctgttgaatcacgaaatataatggtgctttggttgtccaatgattgttgcgctgcccttccttatgctgttaggcaacaggtgctgtgccaagattcgcaattagcttgtttcatattatcgtttatactgaattatactgaagttctgtacatttttcaggcattgaatctgtttattggtgggagggaaaggtgcgttgtggaaatttacctatagactgaatagattattaatagttctcatctttgtaattcagtggtttatcattccttcggatgatgtatttcctgctccttagcagacctaggatttagtgatcaataatctgccttcttgcaggtgcaaactgatgctgaagagttactcataatcaagactagagaatctcttctagatgccttgactgaacatgtcaaagctaaccatgaatacgagtaagcttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatatccaacaacatgaagtaactgatcggatgttctctgtttggcctatgtatcacagtgacatttgctgcaaggaatatatgtgtggttgccatcttgtgagttctgatgagtaacttgggtctataattctgctcacataaaaaatcgattcagtactcatacttgtgaattgctgcccttgatttggtattctcatatgaagtttttctagcgatgcaaatgatgaagatctttaagatcgatgtaaacataccaattcacactggtaaaaccctgagtacgtacgtaatcacctagatatagccctattggcacatacagatgagacaggcgcccgtgaccaagttttgatgtcacgtataccttattgcacagatcggaaagctacaagcccacaagaggacaccgtgatttcagaaagggaaaagaagagaatacatagactgcacaagccgttctcgtgcatttgctagcagcagcttggctctagatgagatagcggtagatcatcttaattaatcttaattcttaattagttgcaggactccttggcgaagccgacgcgggagttggcgacgtcgaagacgacccggatgttctgctgctgcaggttggcgatgacgttgacgacggagttgacgttctgcggcgcctcggccatggcgaggcaggccagcggcgtggcgctgctgtggatgagcgtgttctccatcggcagcgccaggtccacgccgccgtccatgtgcaccgtcaccgcgggggctccgccggcggccacctcgtcggtgttgaagcacgtgtcgaacgcgcccagcgacgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgagagagcagcgccatggggccacgcccgaaggcgagcagcccttgccttggcatgtttgtggtnggccccgtcaccgagctcacgcacccgaacgtgtagttcgggatggcgtccttgcccagcctcagcgtgtcgctggcgagcgccgcctggaacgacgcgtcggcgaacggcttgaaaaaggcgcacgtcgcaagcgtcgccggcggcggcgccgcgtcgccgccgccctgcggcgccgggcacgcctggccctggaacagcgggcaccacgacgaggagcacggaagggaggcgtagaaggaggagttggccgggccgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaatttttcctatatagccatttgaatcaaatgagtgaaatcttttggaatcctataaaattcctatagaatgtctaatgccacgtaaattttggaggaaatctaacacgaggttctacctcatggaaatcgtcctttgagtttttatctctcctctaattcctgcgttttttctgcggtccaatcaaacggtcattactgtgtttttcttatgttttgcaatcatctattttactcttacattcatatcaaatttttgtgttttttctattattacattttctcaatcatgcgatttaaaggggccttaagcttttaggaccatttatatattaatttgagttaatagtatcgccgatgatttttacagaacacgttaatttgaaaaagaaataagtctttaggattaacttgcttatactcttatagacatatagttgtttcttaagtttaattgtttttcgaaggttatagtttaattaaccgtttgaccaagcacatacggacaccatcttggcatcttttgactaacctaacacatgctcaaagaatgtgaactttggtcgttggtattatgccctcacaactccaccgccgtacagttcgatgctttactatttacctcaatcatcatctcatggtggtagtaaataaattatgataaggtcttgatttttgaacaatgttctgcttctcccttggagtagaaagattatttgggataagaatctctcactagacaaaaattgtcacaagaacaatgattaattatggagaagcaaaatactggcttatcacatgcaaaattgtagtggagtgagatgcacagaaccaaattgacccttttaattacttagttaagctgagacagcgaggaagacagattaaggaagttaaacacgcctaggagtgcgaccaaaagtcacaaagatgggcaagaatattgtaccacatcctgtcaaagtttttgtccggccactgcaggtaaaacctgacgaaatccttgattcctgacacgtcctgagacagcttcttcacgggtcaacaaggacaaggatcatcacaccctgtcgacgaatcaccaggtgtgtcttagcttagttatcaaccaatcaacaaccgttgagtgtctgttaataattactgttaatttgcattattctctgggtcattggctgtgaccggcgatcaggttaacttgtttaattattaacttggatgtgtacaaataacatcaacgtagatgctcgcatcctggtattttctgcagtctgcagaaacatgtgatccgaatgatttgttcaaggaccacgatccattggtgagtaacgcatgcttgtacgtgttgataaccacacttcctatagaggggtatcttagaaagatatttaaggctttttttaggaggagcttttagcttttttatccatattttttatagctgtattagttacataattaaaaggataactttgtataattcagaaaatttataagaaattagaagttggttttccaatttcttcatattctcgtccgctgcttctcaagatataaaacgtaacctacatgcctattcctcctacaaagtaacatatgcatgtctgccatgtccgactctctgactctcatcctgtagtatatgtaattgagatgcacttgatagtgtaatagtagtcggcgtgtggtttcaactctgaggttttatgttcaatccctagccctctcacaatttcacatccctccaaatctcttttttttttctctctttcagtacatgtatttgcttcctcacaattaatctccttttattttctttcagtacatgtatttgcttcctcactattaactagctagggaaatattgatgtggactatggatattttctcggtgaatctattgtgctgtgacgcctacagatccaaatgtgtacaaatccccgttcctccacgcgtgattccgcggcctcctttctttgggggttggattctactgctcgtctgttccttcttcacgagcagccagcggcatcacgtcccatcccttccatccagctcggcatgcattgcgtgcgcacgtaaaaagtgtactacgcagccgcgagcggatggcccgtgcattgctgtactcagcgcgcagatggctaagtaaccttcttctcaatataaatgcatctgcgatagaacttgagatatcctacgattacgaatctgcatatagttatttgtccagatttgtatttgtagaactataaatctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatataaaactacccataattttttttggcgaatcagtggtaactagcatttatgtgagaactgcttaggagaaattaaaattctagaacaagcagttgtccgaaaactctcctatcgtcctggcagaagagagcacagctgacaaacgcaaattgtaccttcaaaagtgccttgcaagcaggcaacatcaacaagccagccagccaaacgaacaaaccagcagtcaacggtgcaggacgctactgaaattcagcacgaagatcgtcgtccatccgtggcaagcatcgttcccggccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagtaccaaattatctcatcaattataaacctataattgaataacattttttaagtaagtttgtttcttgctgaaaatgcttatacaatttttaaaattttagttaatttgaaagacgtttgatttagaacaaatttaaatgacttgtaatacgaaacagagggagtacagttggttccctatgcttccaaagggagcaggttcacgggcaccttgttccttgcgggttgcggcgaattagcgatgcacgcagagttgcagacaaagctcgccttggatcgttctaatccacggctaataatgcagttttgttctacgtgcgagcctcgcttgcatgcgtccatgcggtcgcagggatcagatccaatcccgtgcaaaagctcatgggaggatgcagttttatccagatgtagtacagctcatctgaatttcctgccacttcatctgcagtgcaaatgggttctgaacccataggttatgatgctttgagcttgcggcaaatgggttggaaaagccaatcgttttcttcttttttttttcattcaggaactctcaaattcaatcaatcctagctttttttttttttgaaataagcaaaaaggaatgcctgatatgactatatggagcatggagcagttttgtacgtacaagatttgcacaaggcacaatcctggttcgtgctcagatttgaacacaagatttatatttgtttccgtgtctctgacaggtcaaaatgcttcactggcgttggcaccagccaaatgatcatacataaaattccatgatgcgaatacaatcgtatatctacaaatgcaatcaaaccctgacgttttcacaagccctacaatattaagcggcactgataaacagccaagtggacagacaccacgacagaatagaatgatggagaaatgggaaactcatacaacagggtgttcgtcctacagacggccgatggatttcagcgaagtgaggtcttgccggcgagatggagcaacgcctgcttgtggtaggcggcgcggagctttttgtacttctgaacaaaggttgggaggtcaatgtccttctccaggaacttctggtgcagctcctccgactcctcgtccaactttgccatcgattctgagcaagcaccgaagcaattcatgaaaatgtcagcggttgcggttgggtgtttgaaaaattaaattacatggttggacttcaaacaatgacagaagcataaatcaaggtttcacgaaatggaactaacatagacgccactatgacgctagtaccagtcctagcctgatcattggccggttacagaagggtagtgcattcatagcaaacaatagatacatacaaaacatgcccatgattcggtgcactaattcacataatgtattcaactacaaataataaagcacagactcttattaaaatacacagcaaaaatgatgcagatgcagctgttcagaacccttactttggagcttgtcgagcagtgcagcaggagaatatgacctcataatctcatccttttgcctttccaactcagccaacctatcttgagcagcagctagttctgtagttcttataatggtgcactgcacaataataaatgcgatttgaatctcaggaaaaaaaattgaaacgcagacaaaatccattattatagcattaactgtatttaaagttcgtttaacaatgaacatcatggctacagtagcttatagtttctgagatggaggtcacagtactaaacctgattcctgagctccaagatccgttgctctttttccaaattttctcctgtaagttcagaagatccaaccatatttgatttagaaacagtagtaactaacaagttgtttatatctttttcatagttaagacaatccaataaaaaagcattgcatgccgataacagaaacacgaataactcacttgcaagttgcactgtctcctttctaagctcatcgcgtaactgaacattaagaaagaacaagaagtgagcaaattgacaagaggtctagcattcagacaagtcaactatctaaggttaaaagcagcaccgaatataaattaaagaataatcacccacattaatgcccaaatcacaggagatgtgccacagcccaaagcctcaaatatgaggccagaaaaagaaaaagaaaaataattggagcatatagtttggagtttcctgtgtatctttaactactggaggaaatacagaaacatctaagtacagccaccaatacaaatttcaaacacctgtgtactcagcaacaaaacttacgttgttctgggttttaacttgatcgagtgaattgaagaaagcattatatgcctctttgtctttcaacagcctctgcaactcatcaacactgcagaaaaaaggacagtattatatacagcagttttgcattccaaacaagcatgctcacaaggaatagtgtgaaaaacacatgtagtaaaggtggcgattataaaaagcaacccaaccatacataatcacttcttttagcatttatatacatcccttctgaattgcacaaattgtcgtgccctctgaaaagctagggattcttcattcattaccaattgatagaatatagaatatcagccatgatatcattattgcaattaaaaattcattactctaatattattagttagattctagtgactctcttttagtactaatataaacactagaatatgtaaaataccatggtaaaaagtaacaaggctgttgcaattttaacccacagtatagataagataaggcataatacaatgaaacttcgtatacaggaagctacaagcaacttatcaaaaaaaggttagctgctgaccttttgtcctttaaccgagcaattatccctgcagcctcagctggagatggttgagcacgcgatgaagactgggaattatcagaagctctttgatgtggaccaacattggaagagcttggtgtggatggatgtgaagatgaaccaactacagactgagggtaccaaggttgcgtagggttgtcctggaaatttggatcaggttgctgctgctgcgagttgctgctggcaagcattcagcagaaacaaagacagtaagccagaggagctcgtttttcaggaaagcttaaggcaataagtgaatcatattaaatagccacgttaatttacttatgctaaaaattaaattcagcgtaactgaagacccaaccataagaaataacagagtagctgagtggtggacactgttcggatgataaaataaacttttggaacaaaagcaaagcaattttttgagcatcaatatctgaaggctttttagtatagaaagaaactaaggattacgaatcacatcaagcctgctggctggcactgatcaacaaatacaatactttctaccaaataaaagaggaagctcagtttatagaatacaaatgctatgcgaggaaaggttaggaacagacataagaagaacaaacgaaaaaagtattgctttcagtaaaaataacatacccaaaaagaggaaatctccagctcattgtactagagcaatctgcataaaaagaaatagcaggttacatatgttccaacagttggtggtaatcaataagctgtacatgcatatagattctaacggaaaataactagtagatggtaatcgctaacgccaatgccagactaattgttggttgcatcagaaaaataaaaggaagaagaatggatcaaatctagaacaaattgaaatcaaacccctcaacgcagagttcctattgactattgtcaaaaaacgatatacttgtgataagtctcatgttcggtaggacgcgttttctactccaaaattactgcctgcgtaatcaaatcaaaatgccaagcatttggatggcaaaatgttctgtaggctacggcttgcttctactctcaaattgcctagataccgtagagcggttaatccatcactgaagattaccatgagctgctgataactaactaacttgggtgtgactttcaagaagtcatcagaacaacagcataaaaacgtgtcccccactcccccccaaaaaattccttgtaaaacctgtcttgcaaaactaattcctctacctgaatcacaatcgccgaacggattcgacaactttaacgggatcgtgaaacaaaccacagcaccggttttggatcgagggcagacacaaacctgccgagatcagcctcgaaaccgagttgccggtgcgggcggcgctcagggacggccggcgagggtcgcggaggcctggtctcaccgccgcgaggtggcggggaggggagcgcgtcgcgttcgcgttgcttcgggtgggagcaagcgaagcagcgatggacggtggccggcttgtcgaaggagaataagcaattgggatttgggggagaagaagaagagagagaggaggcgagaggcgacgcggagtcggacgcggactgggccgtggggagaggataggtgggctttctgttgggccgtgtaacctctgcgacttgggttttgtttgtgtttgcatcactgggccccggataggagaatgtgtagggagaagtggtccaaaacgtcgagaacggtagcatttgttcgaaacgattttcggtcagtcgaacaattgatcatattagcaatttattacttcctctgttacaaaatatttgacgccattgactttttatcatatgtttgaccgttcgtcttattcaaaaaatttaagtaattattaattcttttcctatcatttgattcattgttaaatatatttttatgtaggcatataattttacatatctcacagaagtttttgaataagacgaacggttaaacatgtgctaaaaagtcaacggtgtcaaacatttcgaaacggagggagtattacgatagaaatatggtgtttaaaagtgaatagaaaaaacaaaatttctatttgactaaaaaaatcaagaacatatatattatttatacgaaaaatgatgcttgatcggtagagaatttcagcgaatgttttcattattaagaaagtgtcgtccaatcatcactagatgtgtgtttatgacatgtttatcagggatttagctcaatctgatctcacgagcatagtctagatcgagtggagttgtgaagcagctcggagatcgttcaatcatggtgatctcgaagaagttgagttgtgggaaatcgttcgatcaaggtgatgttggagttgacggcacaatcaaatatcgagatcaaggctgagggggaagtgggaagtgagtcgtagtgcccggtgagggagacagcgtaggtacgtaattagagctagctagtaagctaagtacggcgccgtcgattaaacaccataaaaccacggcggcacacgtacgaccgatcaatattcgatcgatttaccttcatcttgtaaggacacgataggagcatcaattcctccggagacaatctcagatcgaaggggcgatcgttaacgaaagcgcgagattaattttatcagctctctagtgtgattctctctggtatatgctgagtatcattcgtaagtcgcaacccaccgtaagctatgcaatcttataactatactaattttagtgttgatccatgttaatcatacaggaaccacctatatatttatcgacaaattttcttttaaaaatttgatagatataattatagtacaatcgcaatgtaattacactgtaacttgcatgtaactacagtataacttgtatataactttcacgtaattttgaatcattagatctattacaagatttgttctagtgacgaacaaaaagatcacagtacacacgtatatgaaaggatttgttcccacgacctcgattttaccgaaataacatgttacggagagatttttgaaagttacatacaagttatattatagttacagtgtaattacatacaagttacagtataattacactgcgattgtactgtaattacatctgttaaatttttggaagaaaatttgtcgacaaatatatagcaaaattgaatcatatatatccttccttccttatatagtgtggttgcatctccacatttttcttttatttttcaccggtccattgactgtaacagtaaccgcgtcgccctagcacgatacggcaccaccttagactgtggtcttgacatgtgggccgacatggcacggtccgatataggtgatgtggcgtgttaggttaagccacccatttggcctgctatataacaggtgggtgcttggttaccaggtcacaatttaccacccctaaaattaggtgagtttaattttattagcagttgtttggttgtggtcgcagttagtagcgagagtatctttcaataaattggatctcacgcgttattagtaacataaaacgtgtatcaagatcatgttagccttgctaacatgtgattaagaatttaatcatttcaacttaaataaacgtgacgataatatttattgataaacggtgacctgaacgaaccacctactcctaaatttgtttgcaacactccaccaacccgtcttccaggctccaacacggcaacacctcatcacaccgcctagctactgcatcgtccacgcatcaatccatcggtcagtacgttgtccctcctgacctccctgttcctcgattccttcctccatcctcccgagaaaaaccacccaaaacagtttcttcggcgagagctcaaaataggatactcctacccctagctactctacaaaagctcatcaatttctgaacgatagcaggaggctttgccgtcatagaaagaaatggacggacgatggaccgactgatgccaacgtacccctcttccacccccccttcccctcctctctcctctctcatggctatgtttagggcatttgaccggatgtcagaagtcctctctcctctctcatggctatgtttagggcatttgaccggatgtcagaagtcctctctcctctctcatggctatgtttagggcatttgaccggatgtcagaaggagttttcggacacgaataaaaaaactaattttataactcgcctggaaaccgcgagacgaatcttttaagcctaattaatctgtcattaccacttgtgggttactgtagcacttatggctaattatggactaattaaactcaaaagattcatctcacgaattcctccctaactgtgcaattagttttttcatttatctatatttaatactttatgcatgtgtccaaagattcgatgtgatgtttttagaaaaaaaatttgggaaactaaacgggcctaatagttccaaagttttctttttccaaacttctaactttccatcacatcaaacctttcatacacacacaactactgttctatcacatcgtaccaatttcaaccaaacttccaaacttcagtgtgaactaaacacagcctaagagttgattcttttaatccctccatcctaaaataaatttaattttctacatatatcaatactccctccgtcctagaatataaggggctattgagttcctaaaaacatcacatcaaatctttagacacatgtatgtagcattaaatatagataaaaagaaaaactaattgcacagtttgcatgtaaatctcgagacgaatcttttaagactaattagtccatgattaggcataaaagtgctacagtaacccacgtgtactaatgacggcttaattaggctcaaaagattcgtctcgcggtctccagacgagttacgaaattagtatttttattcgtgtccgaaaaccacttccaacatccggtcaaacatccaatgtgacacctaaaaatttttatttcaccaaccaaacaggtcctaagaaattttagggctggacacggttattaagaaagtaggtagaagtaagtggttgagggttgtgattggttggaaagagaatgttggtgcagaagttgttatattttgagacaaatcctgatggctaaaaattgttatattttgggacggagggagtataaagcttaaaacagaataccatatttattaaatcctaatacagtcattttccagtactttatctgcttccgatatattttttaattttcatgaattttgatgtaatgattattaaaaataaacttattttaagataaatgaatgaaacttactcctaaattttattataggacgaagggagttacttttattcttcagtagctcattttgtagattacggagttttcggtagcttatattttttaggaccgaacatttcagaagaaactcactactacaggattgattatcctggacaccaccccattttatttccatgcggtccgtaagtcagactgcacggaaaaatggtgggagcgtcgcccgcacacgaaaatcaatttttgtgtgcaggtgacttaacaggcccacacgtgaaaataaccctattttcgcgtgcgggcctcctaatccacccgcacagaaaaatagtcgtccctcccatcctattcaaaattttcctctctctccccgcggccccttctctcctctctctcccttatcttctcaccttccttctcctccactcattttcctccctctttctctcaccttcttcttcagttgcctccttctccacaacccacaggcgggacggcggtgagctcggcggcggcgggcggacgtggggaggcggcggctggcgtagacgggatgggcggcccgcagcttcttcccttcccttcccagcagcaacttcggcgcgcgggcgggcgatgacgggcgaggagccgcggctcctcccctccccggcggcgacgggagcgcgcgggcggtggatccggcggacgggagggcgatgaccggcggccgcggctcctcccctccccagtggcgacgggagcgcgcgggcggtggatccggtgggcgggagggcgggcaacgacgggcggcccgcggctgtccctgcccggatccgacggcagcgttcctctcctgcccttccccgctcgagggcgacgacgacgaggcgggagcggcggcggcgaccacaatgacgacgatgacgacgacgaggagggagggctctcctctccctactttcgcgaggcgacgaccgggcgggtgcggcgaggcggcggcggcgagggccgacggcaaccggcccccacacgcccggatccggcggcggcggccgtccctcacggcggtgagggtcggcggcgggcgcgacgatgtcgacgacgagttgcggcggccggttcgcttgcaggccggcgggcgggcgacgatttttctttttttttggttttttttattccgtgtgggtggtatagtatgaccgcacgggataatcgattatcccaagcggtccttccgtccgcacgcgaaaatactgattttcacagacagcggtgtgcaggcgggtcaaatgaccgcacggaaaaatggatatccccgtatggcaaaatgagttacgtagtagtgactgtagctgtcaaaggatctgtttaatttgaggagcctctgacagctacgatttcttctaggttctcactcgttactttttagaatttggagaattctgtaatatatctctaggccctttaacaactgtcaactaaaatgttgtagtcgaggaatatacaaaagtacaactaaaatccagaagccagaagctatttattttcagctcatctcatcttttgtttttcagaatctacaaacatgccataggctgtgtttagttcatccccaactaccccaaactttcaagtttccatcacatcacatcacattcaaaacttttctacacacataaattttcaacttttcccaaacttccaactttttttagaaactaaacacatcctatggagtgggacaactgcagtttcttctaaaatactccccttttctaaaatataagtatttttagtacagtgataacccaaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggagtaacaagtttcccaaacaattaagcttttcgtccagattctaagaagttgaagtcagagtctaaaaaacaaactagaagtataaggtgtgaaacctagttttttagattatcagaagatgactatcaaatgctccctccgtcaaaaaaaaaaagcaacctagagccacatctccttctagtagtacaacgaatctgaacaaccctcctagatccacatctcctcctaaattgtctttttttttggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctg

SEQ ID NO: 78712 - DNA, 2224 bp, Oryza sativa
  unsure (1)..(2224): unsure at all n locations
ggtatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagtttgagagctataaaaatatcgaggaagggcagaggggaaagtgcgagccgaaggggactagtagtgttgtgtttgtgcgcatgtgaggaggagggcaaagttttctgtgtgtgtgttgggggggtggttctttttttataaatgatttaagtgaaaatcgatgatctattgttttgtttctaaaattttcaaatatttttttttctaattattaagatgtaacacctagcggcttaagattttcattaaaagtagatgtaatggttgaaaataatggatctacatatttaactcgaaacatgtggtcaactgtttttttcctataatttctaatattttatttttaaatttaagatgtaatatgtgacatatgtgatactgttagtgctctatagataatgtacgagatttaagatgatatagtaattattatcaattttttatttttctatttttttgtttggttgacacacgtaggtgtctacaaatgatgtactatttacagcgaaatatgggtaatatggatcttgaattatttatttatttataaataaaacaatagttcaaacgaacttgaaaaccagatataacttaaaagatagtcatttagttttctaattgctgtttgtttatgtattaagtttttaattagttaaaatttagaagaagaaagaattgaatgagaggggagaggagagagtataataagaatatttattttacaagtttaatgtgttttaattactatcgatttattgtatgaaaatagattaaatgctttattgattgattaagatgtatcttttttttcttttcataaatatatttatatgtatacactacaaatttaataatattattttgacttattataatgtcggattgagaggagtattttttgggaattaggttcatttagttttttcatcatatatatagtttaattactgttaagttatatacagtgataaaatctatatcactctttttttccataattttattattttttgaattggacacaaaggtcagaaaatataaccaaaagttacatattttattcatagttgaattatagtgaatgtgggcccttaaaagtaaaataatataaagaatgtagtccgtgcataggtaagatataaatcaggttcgacattgaaatcgaagcagattcggcaaagagatggattcgaagaacagagtatgcatcggctgcgaaggcatcggctggagtctgcatcagctgagatggatcggatagaaaacagccgatagaggtggtgcaaccgattccgacggtgatggcttcaaggatgtttctagaatcaatcaacgtgcttaacaaggattgccacgatggagataaagctcttagaaaggcaattctatctattaattaggatatcttacgtaaattccttagagatatgtttgggtaaaagtctaccgtaaaaacttatggtatcttagagtttgttaaagataagagtcgtgtccggcaaggacatattttgtatctcgggtataaatatgacccggacccatgtaatcaaacaacaacagttcaatacaatctcggcgcatcgccaccctttttactttcgttctatttcgatgagttcttacttttcggttgagctgcatcgattcgatcttcaactagagggtaacttgtcacttggcatggcnggattgcgttctcgggatagtggttccatttttattgaccctttaatcc

SEQ ID NO: 78713 - DNA, 9507 bp, Oryza sativa
  unsure (1)..(9507): unsure at all n locations
cttctatctttatgatactctaatcttgtttatgtaattcgtcgatttatcatatatctcacataatctctggcaatatcgctatctaatctataattggctaacatctgtcggtagaggtcagccgattagattagatatcgacgttgacttacattatataaggtatccaccactctatgaaacttccaacggcttgattgtctagatattgtccttcttttcatacttatagctgcatcagttgagtttgatcttatgagtcgtgattagaatctcaatctctagcctgcttattggtcgccgattagggtagaatcggggtttcagccgatcttatctgatttaactatatttgtatctcatatgcttgattgacatgctagatctgccctttatgctaagatcttatagcattaaagtatattaggcattttgttcgatatattctgcttgttttaatatcttaatatagagtggtatcggagtattagccgatacatgctagatctatctgatcggctatgctataaatgtctatataatcagtactttaatgtatatttcgacttaagtgatttatactgtctcggcatggcgaccgatctatcctaatcacttagtttaaatatacatcgaatgatcgattatatgtcgttaatatctatagccaattgagtagatttagttttactttatttatacacaactgccgatcgattccaatatgacatcggcatcggctcgaagataaatgatatgccatcggcaactagccgatcggctatcgtatatggatttaaccgtggttttcttgtctttctttcttgttgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaattaatcatgtgctaatgagttgtttcattttgcgtgctagggagattagctcccaaccccatggaaggaacataggcggttcattttacttttagaactgtagatctaatttaattatcatgaagttacgttggatgataaaatctatattattattattattattattattattattattattattattattattattattattattattattattattattattattattattattattattattattattattattttcatattcttctaatggtttgaaatgcatgcaaaagtcagaaaatatagcccaaactaacgtatttcttttcaacttttaattatagtgaaatttggtcttcaaccgtgaatttggtcataaacaatctaaagacatccatggattaaaaaaacaattatatgatttagatgtcgtagttacttgattttttaacaaataaagtatgaaaataggataaagaattaatggaaaatagaacagggaatcgaaggaagggagggagtaagtacataatgctcggtggggccgggtttaggagatgatttttaaaaaaaaaaattataatagttgtaaataatgggtccaccgaattgaatgaaaatcgacggttattttttaaagtgcaatgtgacggcttagaagcgtttataggatgccacgtgatgacttacgagcgtttgtagaaagtttaatggacttttagtatagatatatgatttttcaataaactacctcttattctaaactgctcatttcaattttattttattttcttattacacaacaaatgcacacgcaaactacatcactacacatagtcacatacttaggcaaatgtgcccctaacacatgcttaaaaagacataaacagaaatcagcagcatatctctgatcttattaaaaagacattagatttgaactctgatgggtaaaatcatgctgaccccccgagaaatccgaagtctgaaaaacagaaattccccaaaagatgaaacggaaagaaggcacgtgaatccatgttgaaaattttacttgcgtatgaaatactgaatggggaaatgcatgaatgggtgacagcaattcgatttctgtgtccacattagacacccagaggaaagcattatttttgtttaatttaaagtacttgacaacgaaattgttaagaaatatatatatatgatctcatccatccgatggaataggcattgcggttgccatgcctcccgttaccacaaccggcagagaagggaataaggctaccatgccccttctctccttcggcacttcttgacaactggcgcgatggttcgcgctcctgtggttctgaccgtatccccttgtataaattgaacgctacaattaatgagaatcaaacctcactcgcactttgtaccgcatgaaatcactccacttcaacagttcagtcaagagcagttcaatttccccgcaaaaaaagagcagttcaattctgcatgaatgtttgatctgttagagttcactttaggatcatctagctttagatctactcgggtagtcctcttgggtgtttgaacaaatatagagatggaaagagagggtttagagaccgaccagtaaaggtggaggaggaggaagtgccggccatcgtcgttgtcgtcgcgtgcttgtcgtggacggtggcgacggtgggcttgacggtgatggcggtcgtggcagcggcggtcgtaggcggcgatgacgaggcatggtgcagcggtgatgcttcccgtcactggctacgccccctcgatcggttagggttttgtgggtggagttggcggcggaaccgaacctcatatcatgtgccgccccggcctccaccctctatttatatggcgcaaggtgacgggggcccaccagtcaatgggctgggcgcccccgatcagggcgcgggtcaaggtccccttgtgtcgttgggctcaaggggagggagatctatctaatattctcccccttgatctcactatttcttttagcttttttctattccatcatagatttgcacatagagcatgtttcatcgtcacggttaatcactgttggatttgacagctactatacacatctctattcagaaacatatactttaacttttgggccctgtagtccaggattcataaggcttctcttaaacccatgccggctacatgttccttgaacacgttgggtggtaggcctttcgtgagcggatccgcgagcatcctttctattctaatgagctcgagactgattgtttgatcccggactttgtccttcacaacatagtactttatgtcaatgtgtttggcagcaccacttgactgattgttgtgagcgtacattactgcgggttcgttatcgcagtataactttagtggtttctcaatactgtcaaccacctttaaaccgggtatgaacttctttagccagttcacctgccccgtggcctcatagcatgctataaactcgacatacatagtagaccctccagtgatagtctgttttgagcttttccatgaaatagctcctcctgcaagggtgaacacgtatcccgatgttgactttgcattatcttttgcaaaatcagaatctgaataccccactatctggagcgattctgatcttctgtaggacaacatgaggccttttgtaccttgcaaataacgcaagactttctttactaatttccagtgctctgggcctggattactttgaaatctgccaagtaacccagtgacaaatgccaagtcagggcgtgtgcacacttgcgcatactgtaggcttcccacagctgacgcatatggctttattttcatttagttgaactcatactaattactgggacattgccatgccccatacttttcgcctttgactataggagtaggtgtagcactgcatctgtacatgttgaatttcttcaacaccttttctatatatgccttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagctagtagaatgatatcactactagccagtagaatgtcatctacatacagaattaggaaaatgaatttcccattcttaaactttgtataaatacaattgtcctcaatattctcttgaaacccaaatttctttattgtcccatcaaacttcaagtaccactgtctcgaagcttactttaatccataaatgcatctctttagacgacaccccatattatcgtttcctttcacgacaaaacctttcagttgtgccatgtatactttttcctccaaatctccatttagaaataccgtttttacatccatctaatgtaattccaaatcataatgtgccaccagtgccattattatcctgaaggaatctttacaagagactggagaaaatgtctcattgtaatcaatcccttctctttgcgtgaagccttttgccacaagtcgcgctttaaacttttcaatattccctctggagtcatatttggttttgtagacccatttacagcctaatgttttggctcctttaggaatctcttctaaatcccagacatcgtttagtttcattgatttcatttcatctttcatgtcttctaaccattcagatgagcgtgcgcttctcatggcctcttcatatgaggtgggatcatcctcaatatgtgactcttctatattataaacttcatagttatcacggatagccaatcttctgactctttcagaccttctaggggcctcctcatttggcacattctgtacctgagactcttgttgagcctcccgttctggcacattatctatttgaggctattgcagctcctcctctggtgtggcaataatttctgttgagtcctgtagaacaggttcctcattttcattcattgttgccacaggaggggtaacaacaggtgctggtaccgcaacgtcatgcattgcaggcacaacatcagcaggtagagagaagaaaggctcctaagtcgacgaagcgggtacagacacccgcctcttctcaagatcaatttctcgaactactgagctccccctaatcattttgtcttccaagaagacggcgtgtatcgtttagacagtagaaacgataaccctttgatctagaataaccaacataatgagattcatttacaaatgtaataatgttctcacctttctttgccatgatcattttcaggaagtcaggataatctttatagtagttccttttcttgcagtggagacactgatccttttcaactgtgaactgttgttgctgaggcagatgctgaggctgttttgcttttgaggagggtgtcttgtagttcttttccttgttatctttaacaaagttaatagagccaccattggactcttttgattcttttctcctcttgcacacaattagcgatgagcttttcaaaattccatttctttggacttattttgtagttgacaacaaagttgtcaaagtgctttggcaatgaggccataaccagatggatcagaaagtaatctaagatgcccaaatccattggcttcaacttggaagccatgttgctcatcctaagaatgtggtctcttacaccacctccatggtacctctctgtcacaagctgctttatcagctgtgtagcataaatctttgaagaaccagtaaactggctctttattattttgaggtactcaaagacggtgtcacactttgggattaagcccaatatagttggctcaattgtgttctttaccgcagccaaacatttcttgttggctaaggaccatttcgcatgctcaatgtcatacgacattatgaggggagcattgtccctctctctcttttgccagtcagcatctgactctttttcacctctgacaagtgcagcaggttctatcggatatggggtggtcaacacccagtccacctttcctaagataaaagcaaggtcgagtttttttttccattctgcgtagttatctcccttcaaggtcggaatatctttaatgcaacccataggagtagccacctgaaataatcatgtacagtgagaacaaaattaacattaaaatgttatgcattaaatctacatcaccgttaggcaaaaatagagataacacataaggccataactataacattgcaattaacaacgttggtcagaaaattacaacatcatagtacagaattaatgttcctaaaattaaattctcccgttggttcgaaatttaaatttagaaacactaatttttatcaatttcatctatttgcagcggaagatctatataaaattcatatgaacagtagcaaattatgttatttacactatgtaaaaattacacctttggttcaaaatttaaacagaggtaaggcatgcaaaatcgattaaaaaatctattgaaatttgcatgaaaatagacaaaataaaaagaaagtcgctaccgttccttttcttcattttggcccatcaaagaagtcggcccatcgccgggcgtgtgcgggcgcccccctccccccaggccgcaacctgggcctgggcctgaaagccgccgncgcgcgcctcccatcttgggctcaatttggcctggctgacgccggccatccaatcgctagggtttcgatcggatggccaggcggagagatcgggcggtaaaataaacccgacccccagccgccggccaaaaaccctagcctctcttttctctctcgcgcacgaccgcgcgacgcgaaggtcgccgccgccggcgaccttcgcgtcgccgcgccttgcaccgccggcgtccgggcagcgcctcgccccgccgccatcttttctctttcccctcaccatctctagccctccacccctctaccgagtgaagtgagagagagagacggccgaacgagatggcagcgccaccgggggccccctcgccggcacgtgcgtgcacccgctggtgcgcgcacggccgtcgaggggctccttgacgacgccctgtgccctcccccattccccctttgccggcgttgacgatggccagcgacgaagtaaggatttagggttaggttttttggtttcttttatttctttttctttggatttctttccccgaaccgatctaatcgctagggtttggctctgataccatcgttagagttcactttaggatcatcgagcttttgatctagtcgggtagtcctcttgggtgtttgaacaaatatagagatggaaagagagggtttaaagactgatgggtagagatggaggaggaggaagtgccggccatcgtcgttgtcatcgctcgcttgtcgtggacggcggcaacagtgggcttgacagcgatggtggtcgtggcagcggcggtcgtaggtgcgacgacgaggcgtggcgcggcggtaatgcttcccgtcactggctgcgccccctcgatcggttagggttttgtgggtggagttggcggcggcagcgaacctcgtatcatgtgccgtcccggcctccaccctctatttatatggcgcagggtgacgggggcccaccagccaatgggctgggcgcccccgatcaggacgcgggtcaaggtccccttgtgccgttgggctcaagaggagggagatctatctaacatgatctggctttctccaagacccaagccaaaaaccgattcaggctctttttccaagtcaaaccacataatctagttctgcttttatattcttttagcgtgcgttctacacatagcatcacaaattttatctaacatacatagtagtatagtactacttaaatagtcggagactcgcattagtaataataaatctctgaacttgctaaacttttatgaaaagcccaactactgatcacatgccagtaatattcataggcataacagtttttttttaattatgcataggaaggagaggaagaagaaaatagctagtactaattaagacgatgcagccgatagagaatcattgtgtataaaactagaaaaccgtagtgtttggtaacctactacgcgttcttctcatcccaccgatcgatcgcgcgagcttgctatgccgcaacatgcaccgtccgatcgaagtgtttcctgcatgcttcactgcgatccggccgtccacgagcacaatcaagcttgattaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagcaaacgatccgccgccgccgccatcggaagcgagaacgacgacagagcaagaggtcgagctagcgtgcaaatggccgcagtgttgctggcacgcggcaatagtcgaggcggcggagtcaacctactaggtaggtagtgtggtctcaactctctctagggcagacgatagctgtggttgcagagctggtggtcgtggtgggcgagatagatgactaatttgcagctagccgcgcgtgtgggccgccgcgcgaccaccccgcgttttccatttcggcccaggtgacgccggaccgtgcgcctccactttccgtcttgggttttcttatttcagcccagctcgcgcgatcagttcagcccatctgtctaaattttgtatacatatggatataaactttgaatntataagtatacaaactttgcatatgtctttacattttttatacatcaaaagtatgcgtatacataaaatacactcacacacacatatacacgtatgatatgtgcatctgcttcctccgcacgccaccaccttaaattgctccctgtacagtgtcaccaccgctacttcctttgcacaagcaccg

SEQ ID NO: 78714 - DNA, 1342 bp, Oryza sativa
aacaggagggaaccaagcctgagctctttgcttggctcctaaatcccattcaaatattcttaaaaaaatcacatatttcttttttttaaaaaaaatattatgatgattacgccgaatatgtcacttgagccttaagcgtggagaatttaatttggctctgtcaccaccatcaggaattgaagcagggaaatgagagctataaccgttgaataacctctcaaaaaatccctgaattttagctgcttgagcaccttaaatgtgggatcaatattcattaagatcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccgccatggccacccaaacccgccccctcgtctccgtcaaggccctggagggcgacatggccaccgacaacagcagcagcctcgccctcgccgaggtgttccgcgcgccgct

SEQ ID NO: 78715 - DNA, 6397 bp, Oryza sativa
gacgccgagaaggccaaggactcggtcggcatccgccccggcaagggtaagatgcgcagccgccgctacatcaaccgcaagggccccctcatcgtctacggcaccgagggatccaagatcgtcaaggccttccgcaacctccccggcgtggatgtcgccaacgtcgagcgcctcaacctgctcgacctcgcacccggtggtcacctcgggcgcttcgtgatctggaccgagagcgccttcaagaagcttgaggaggtgtatggcaccttcgaggcgccgtcgctgaagaagaaggggttcatcctgccgaggcccaagatggccaatgctgatcttggcaggatcatcaactctgatgaggtgcagtctgtggtggagccgctcaacaaggaggtcaagcgcagggagaagaggaagaacccgctcaagaatgtcgccgctgtgctcaagctcaacccctacttcggcactgcacgcaagatggccacccttgctgaggctgcccgcatcaaggccaggaaggagaagcttgactccaagaggaccaagcttagcccggtataacttactctcctctcaattttgttgattcagttattataaaatgatgactaggttgtagaataatccgattagctatgtagatctatagttgactctcatggtaacaagaacaaccatttggatgcttgtctaatgtgttagctggtactgctttggatgatctatttgtttagatgacattctagtttacttagttagcctgcacttgctgtttgtgctgctatgttgcttcatgggctgttaatttgttagtattgctcggaattgatactacctggtgttaattcttgctgttattaggtacattcgtttctatattcatgcttctaatgtgccattttctccatgtttagttgagtagtattttgttctatgatctctctggtaagccaaggttgtattacttgttataagttattgacctcattgttgtagctcagtgtctgtcttatttctacattgtgttcctagaagcctttgaatgtgttaattgattcatgataacatacagttgtgcaaggtcatttagttatttttcttaaattatgtctctatgcattcaagtttaggtttcatgtaatgttaatattctagattggctccttgtccttggtgaaatggtggctgagttcttggcattagaaggtcatttatttggctgtgttttatatttatcatagcatgtgtggtttgttgttgacttcgtcgtaactgtttatttacactgatcttaggttctactatcattttttgtctggtttattctgccattgatatttcatttgctgtattgcccttagtgtttttagtgggatacttgtttagtcctcaaccatttggagacttcaatctcttggtgccttttgttctaactgaaaattcctgttgattcattgtaggaggaggctgctaaggttaaggctgcaggaaaggcatggtacaagaccatgatctcagacagtgactatgctgagttcgacaacttctcgaagtggctcggagtgacgcgtgagcgttgtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagcctctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgtcatcaaaagcatcctctccctcctactctcccctcgtctactactacttcacctcgcaatctccgcccaaatccaacgcctcgtctgaacacaaaaccccgtaaaaatctccgcctccgccaccgccaccgccgccgacgccgccatggccgccaccgccgccgcggcccacaccctcctccacctcgcggccccgaggaagccctccgcggggcccccactcccgcccgccaccctccgcctccccagccgccgcctcgcccgtctcacggccagctgcagcagcggctccgggaacaacagcgccgccgacttccccaaccccaacgggatcctcgtcgcgcccccgtccgccgcggcggtggcggcggcgtcgtcgcatatcgatgttgacgtggcgacggaggccgacctgagggagaacgggttccggagcacgcggcgcaccaagctcgtctgcaccgtggggcccgccacctgcggcgccgacgagctggaggcgctcgccgtcggcgggatgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggtgagcttagctgccgctggattctgcctttggcattgccgccttgctaatttgctttcatgcgttcgatggaattcggcgagtaccgcgtgcgtggtgctagcaagtacgtgaattcatactactagtgagtaggaatgcgtgctttattcgacttggaattcggataaagaagatgtcctgacaccgtgactcggtagatctagatttgagctcaggttcatgtttgcacagtgaaggggaacactagtattgttatggaatattcttccatgaaatgctactagcacccaacattccctggagtggggataccagtttggattttgcgcaactttatcgcaagttgggtgataacatgaatccagattctactgcagagaatataagagatgctcaggtagatgcaaaagagagagccacatcataatctcacttgagcaagtgctccagccccttctgggactaccatgttatagacctgtcaacaagctaaattaaccacctatttaagcgtgtaaccattccaagtgctggcctccttgttaactattgaatactctgcaacttttcatgctattgtccacgctggtagagaaacacagttagtttggcctaattgtcagctatgtatgtgttttgtacatggcccaacaggctcttgttcctgtaatgtcagcctatagtgtaaatcttgctttccagctgaaaaaggaacaccgcatctgaattttgtttattagattcagcagaagcatgcaggcatctgtagtttgagttttattgacttggtttggcagtcataagctctgttcttgctctagtaaagaattgaagtttcacattaaaaaaagggtaaagaaattgaagttaacaatatctgatgctccaaagtttctgtatcacctatgtcaatgaaccatgacataatcttagagattaatgaattctctcatatgactggctcaccactctcaaaaataagattcttgcataatttttttcatttgaaacatattacaagtggcttgaccgctatctagcactccctcctagtcatatccaatgataactactttactttttctagccatgccttttattggttctttttgggttttcctagtggcaatatgcccctctaatagttatttattttaatcctttttttttcttttgttggatttcacaggatggagaaatatggacatttagcgtaagatcctttgaggcacctcccccagaacgaactattcatgtgaactacgaaggcttcgctgaaggttattttcaagcagatctcttctgttggtcttatttatatttctattcccctctgtaatgtgttttttgaacactacacagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggtaaattcactagcatggcaaatttgttgctgcaagcctgtaatcaaaaagtaggctgaatggttatgtcattttgttgcacaaacagttcatgttttacatgttactactgaggtcagcccaaatgaattacctggtttactcaaaccattgtgttgtaatagtgaataatatctgcatatattcgaaaaagtccaccatccatttcttagaaagctttatgtggactgttaccaagagttattgttgttgagaaatgatgattcttatttctgtgcaacttctgcaggattggcttgacatagactttggaatttctgaaggcgtagattttatgcagtttcgtttgtcaaatctgcagaagtaattaaccatctgaaagctatatagctgcaaggagccgtggcaggtaagatgagtataaatactctcttcttgattgagctcatacctccatgaagctaagtacatggtttgatggttgaactgatggccccatatgtatgactaatactgtaactatccaactcttgtgcatttgctgcttttggttcttgtccaattctgtggtaccagttgggtaagcttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttgtactgtttctagtttagatttgcagtagtgtagtaattcacttttaggttgctttacgtgtattcttttatttctagaagagtgaacatgattaataaaatgcatgaatttagatggcttaagaaaatggaccatacaaatatatcggtatagtgtatagtgtttatatgtcccaaagaaccaagaaatattacatatatttctattaaaaaagctaggcattgcattcccgaaatattagttt

SEQ ID NO: 78716 - DNA, 1594 bp, Oryza sativa
ccatgaggaactggaacttaaagatgtttcatcttccttctctgacaaaatatcagaagaaatctgcatttcggccgctaaatgggtaaccactgccaactctacttctattgttggactgctgctgtatatatgaatcgttttttcgctgttacttctttttgttattgtgcattgccatggttattatcaactcagactactgaattttgccatttgcatatctgggcaaggcctaaccacagctaatttgagttgcagccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaagggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagccagtaaagattctttaaaaactccttgcacatcaaattagaactgagtagttttactttcatatggactttggccaaactagtcactaaccttttgagtgaaatttttaccttttttttttggacatgtatgtatgcagggtattagttgacctgatgtagccatgaatagtttttgcattggtacgtttgtttgaatagtttttgcattggtacgtttgtttggcatctgtcacaacccacaagtaggacgctagcaacgacataaaaatattttattggggcgtgaaaaatgggagaattatgttcgcaagagggtttgaccaggtagtcatgacattcttatgctaatctcaagtctcagccatatatcaaacatcttaatgcacactgcaacgtgttacgtgagtctcctgctaccgctagtctcccaagtctaccaaatacttgacccgtttttaaatacactcagtttgaaaccctccgttctaaattaagatgtttttgtttttttccaagtcaagctttttttagtttgaccatatttatagaaaacataactgcgtttttagcacaaaaacaagtgtactataaatatagccagtaatggatttaatgaatttggtgtgttactacgtatttctatgagcttgctgaagaaatctgacttagaacaaaagactaaaacatcttacaacctagaaagtagaaaa

SEQ ID NO: 78717 - DNA, 699 bp, Oryza sativa
  unsure (1)..(699): unsure at all n locations
gtgtcccaatgaatgcnnnnnnnnnnnnnnnnnnnnnnnnnnnnnnnnnnnnnnnnnnnnagtggattttgtcctacgtggcagtctagtcagcaattttttatttaaaaaattagtggggcccacctatgatattctctcccctctctatccttttacccctctcacctatctctatctctcttttgcgttggaggctgacaaatcccacgtgtcggcggaggccaaggatgagcggtgcgccacagttacgagcctcctcaaggcggaggccgagaatgaggcacacaccaactgtggccagcccgtcaagctcaccatctgggcctcgtcctcctgtggttagggaagcagcagctagcgctggacttgcacgagaaggcagccatggcgggggaaataagacggcggggaagaggggacaacgcaatggggcgcctgaagaggacggtggcatggaagcggaggagagggcggcgcggtcgaagccgaagatgcagtggcgaagatggccatggtggggaaatacgatggtaggggagacagctagacacggcagggtgcctgcaaatcccggcggcatggaggcggagctccttggccgatgactggcatcggcgagctgtggaacattgatctcgaggccgtttcccctaggctcgagctctaccaccgaccgacaagtccaaagtcctcctg

SEQ ID NO: 78718 - DNA, 2056 bp, Oryza sativa
atcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcggttgcaatttttattactatactgcagtcaataggaacagtgtttgtactgcagtcaataggaacaatgttttgtattggcagctgcagcagtgcagccgctgcatataacagccgaacagactcaatattaattgtcagatatgctaatagtgaaacgacatatgtcgttggataaacatagattacaaaactacaggtgctggtaaatcttcatgaggcttccagagtctccaaatccaaactgagataaatcggtgaggagagagatgtgcaatactgtaagctgaggacatatgtcaatgcaattttgtaatttgatccttccataaaattcattatatatataagctcttaatttaatatatctttgatttcttgaaatggtcgcattgtactaccttctcaacatataagaagtttaggattcaatacggatatttaaaaaataggtaaaattcaatgatagtagattacgattgattgaaatgaggaaaactggtggaatgttgtaattggttatttactcaattttttatggattttttttacaatttttgaccatgtataataggcgggtttgagtcacgcgaatgcgtgacttcgtagcctagtgaaattgaaatttcactagaaaaaattcgaaaaaaacacttaaatgtgtgcataaattggggataattggaataatatatctacttttggggtgtaaaatacaaaaattcggcattaatttttctatatatggacttcaaagcaattcaacattttatagcataatagcattacttgcatattgctaccatatttcacacgagcaacaaatgacccattattattacaataaatatccatccctaaacatgagcatatctactcacccaacaaataacatatcacctctacaaaaccattttccgcatcactagcaaaccatttttcacctattcacaaaatttcaaatctcaacaaacatcaatctttcacaatgtatttgacctaaacccaatacatttttctttttctaatttctaaactatttttgattttgccctcaaatttcaatttatattactctatttccaaaaacttcttcaccatctgccactaaaaatcaagaactacatccatgaattcttttgattttttttggaattttcaatttgctcgaatttcattcaaaccatatcgcggaaaaccgttactgtgccccgacggtaaccgcaattattgcgcgataaggtaaactctgattgaacgatgtagtatgaaatctgatactccatccatcataaaaatataacacatatataaggtagagtctctctacctttttgcttaaaaaatataacacatatatctctataagtgaatggtgaatcccaagaattaactaggatgagccacataatcaacaaaataatagccactggatccacatgaagacaaaatagaaagaagaaatctgagccattggattcactttatctagaaacttccttaacctactaaaaaactagtaaggttatggatatgattttacaatgtacacttttatttaaaaaactattttgcaaatataccctattactctatctatgcaactttcctttgaggaaaaaaatacaaatagatcattgacctatatttagaaatattcaacaaatgttgtgcatataattttacaactctcacggtttacaaataaacctcattttttaataaagattaatatgatccaactaagctttatatcattcaaagttatatatattagtgatgagcatatatatgtgtgtgtgatatgctgatgtaactattagttatgcacccattaaagatgttatgattaatcatcattacaaatttaagcttattattgctaccacaatctat

SEQ ID NO: 78719 - DNA, 3869 bp, Oryza sativa
ttattctatctatgcaactttcctttgaggaaaaaaaatttaaaatagatcattgacctatatttagaaagatccaacaaatgctgtgtatataattttacaactcacacggtttacaaataaacctcatcttttaataaagattaatatgatccgactaagctttatatcattcaaagttatatatattagtgatgagcatatatatatgtgtgtgtgtgtgtgtgtgtgtgtgtgttgtgtgtgtgtgtgttgtgtgtgtgtgtgatatgctgatgtaactatcagctatgcacctattaaaaatgttatgattaatcatcattacaaatttaagcttattattgctaccacaatatatagacagtatttaaaagagaggtagcttatagttacgtgatgcacaacttaatatactagtatacttgagtagatacaacctaataaaagatttggtactatatttttttatagtactatatggtatatatcactatattttattttatgttggaggaagtattcataggaggatatttcatctcgaacctatattaatgaattgacctgcagccggtctgagtcgaaggaggtattcgtcatggactatgactccttctacgagtctcctgcaaatctcgagtctcagccgtctaaccaaacatattaatgcacactgcaattgacttctgttgctagtcccctctagtcgtctcgcccgtccaccatattagtgcacacgctcatcatgagtaatgacaattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaactttgcatggaagtgcatgcatgtgggctggggatacattaatgcctacaccctctattttgcaagttataaacattcatggaaattttagcagaaattaagactaaagtgagaaataatgtgattgcttgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcagacatgaacatatgtcgaactgaaacatgcatgtgccctaactgttgggtgtgtgtgtgtgctgctgggatcgccactgatcggtgttcaatgtttcttaattatgctttccattaatacattatgacaatataatgatcagaactccagaagagtacttggctagcttgccacttgaattgttgtaatgtgaaagatcatctgtgctatatttatcatcaccaggattcaaaatgttggcctgtaactatatagaaccagagacccattacgtaaatttaaattaattgttcaaattttgaatttatatttaaagcttatttttccacacccggttataggttggtaattaacctcctagttgctgataattttctttttcaaaatttcagtttgcaatttcgtcctgtaaatttccggtaaccagcactccagcagtaattaattagccagttaccggtctgtgttttcttttttgttaattaaagactgtcatggtcgggattacgtacaagcgatgaagccagagaatagtgacaatgatcgattccatttgttttgattcagtttgtcacttgtcagcttgttatccttgagaagaccagtagcagggccgtcccgtcaaattcggaggtcctgtgcaaagttgaaggataacaacttaattgatgatataatatgaaaataatttatactctgtaatatatttcatagcaatctagaatgacctaaaatgataatccaaaattagggattaccggattagaaattatcagaaagaattagataggggcgcggcaggcgtcaggtggcacgaccgcacgagagaaagaggtgaggcgtcgtttactcctctcgttcgttgtgattggcaattggcgaggttcacagtgggaggcgattcaagattgtgaaccggtgcaactgtgcgaaccggcaaaggcgtaatcgaagccgaaacgacgagaaaaataacagattttcggaactagctgggctaccaatttacttattgagttgtatatctagtgttgaagttttgggcctaggggccttaaaaattgggggccctctgcgggcgagctggccgcacacccctacggcttgtttggcaacttgaaggaaggggattgtgagtttacacgagggaattgatggttagattaagatgggaatttgatttttaatcccagtatcttatttggtagatgttgtggaaattgatagggagtttagttggagattaggtcattaatgaaaacggatggctgagatttgtttagacaaaataaatgaggaattccctcctaattaccatcccctacccaggtattgaaaaggagggagttcctccctcaattccccatctccatcccaccaaaaatcctatgtatcccattcaaacaaagcagttaatagcctaatccctctaaactcccaattccttctaaaaactccctccaaccaaacggacggggacggccctgaccagtagcaaaacaaatggaattggttgttgctaacaaatcctgtaattgaagtacaaatgcgaatacacctagatgtacccaccttttatatgaacacatacatatacattaccaatgaataca

SEQ ID NO: 78720 - DNA, 600 bp, Oryza sativa
ctgaaaggggggggttagtgtgtgtttgacagtgacacagtgtattgcaaatttgcaatgggaccaccacattagttagttgttacatcaatctagctagagataactaacccgtattatatatatatccttcaaacatatatacacatatatataaccacctatatcaaagtgtgtactggtcggtcagagtaatttggagccactgctatataaagcctctcagagccttcttcttcctctcatatctctctctctctctctctctctctctctctctctctctctctcgtgtgtgtgtgtgtgtgtgtgaattttggctgtgtttagttcagtacaaagtttggattttggttgaaattagagatgatgtgactgaaaagttgtgtgtgtatgacaggttgatgtaatggaaaaggactgaagtttggatccaaactttagatctaaacacagccttgattgttgaggtgcaaccattaggagctgaagctgccagcatgatctgatgagtgcttattaggtgagggcagaattgactgccaaaacaaagatcagatcatgctgtgcagtttcatctgcttgtggctgcacaaaatt

SEQ ID NO: 78721 - DNA, 1732 bp, Oryza sativa
ccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgtagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagcaacctgtacacctgtgggtagacgtacgtttcttggcgaaagtagcgccgccgtcgttgcagccgccatcgccgcggagcagatcgatctactggcagcgttcggactgatggttgcagactcatttccattgacatcgtcgactaatgctgctgatccgtcgcatgtcacgccgccaccaagacccccgctgctactgagcagattgatttgtttctgaatctaggaaagatggctcctactacgctgccgcacctctatccacgatgaagttcatcgcctctccgacgtataccacgtcgccgccaccgcctccgtagtcggatagacccacgatttcctagtcatcggatatcaaccatcatcagggccaagagaaccgaggtgactccagcgagcaccttcgtctcggcgagggaggcaccatggtggccgccctgggccgggacacggctatatatggaagtggacaccgtggtgtctatggcttccataggcattatcgtgacggttggagaggtgatcaccatggtgggcatggacaggaacacatcatctctcacattggtttcctcccgccgctgccggcaccacattatcctttgtcggaatttctgccgccgccgtacttcggcgcataccatgaaccaactatcggatacgcaccccacagcgaatactatggatcaatggtcagccatgcacacccaggtatgtgagataacgaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaatatatattgatattcagttatacataccctat

SEQ ID NO: 78722 - DNA, 13428 bp, Oryza sativa
ttagaaatagctgaaattcggaattaaaaaataaggatattaaaagaggagactagagtccatatagaaatacaatttagaaatagctgaaattcgaaattaagaaataaggaatattagaagaggagactagagtccatatagaaatacaatttagaaatagttgaaattcggaattaaaaaataaggaatattagaagagaagactagagtccatatagaaataaaattaggaaataactgaaattcggaattaaaaataaggaatattaaaagtagagtatagagtccatatagaaatacaattaggaaataaccgaaattcggaattaaaaataagaaatattagaagtagagtatagagtccatatagaaatacaattaagaaaaaaaatagaaatatggaattaaaaaataaggaatattagaagtagagtatagagttcatattggaatttaaaaccaactaaaattcggaataaaaaggagcctccatgttcgctctcatggcctagaaattctcacattaatcagagaaaaagaaaaggcagagtctcagagaaaaagaaaaggcagagtccatatagaaatacaatttagaaatagctgaaattcagaattaaaaaataaggaatattagaagaggagactagagtagttattacacattagtagttttgaaaagttattgcaaaatttaaaattatgttgtcattgtaatatattttataataatataatgagaaaacatatatgcttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaagattcttgatgagcaacagcaatatgagctagtaaagttctgcaaggacgaggaacttgttcttctggcggatgaggtaaggctagtcatgttcaaaggtgtcagtgtgttgagtgatataataatgttaacaaagtatgatgttaacaaacacaagagaaaactgtccagataatcgttttttggggggtgttgataggtataccaagagaacatttatgttaccaacaagaagatcaactctttcaagaagatagcaagatccatgggatacaatggagacgatttacaattagtatcattgcattctgtttctaaaggtgaaatcccatcatccgcctttctttctccaagtacattgtaactccttaccacatagatatttttttgcctgccatcaggatattacggagagtgtggcaagagaggcggttacatggaggtcactggcttcagcactccagttagagaacaactctacaaaattgcatctgttaacttgtgttcaaatatcaccggccagatccttgcgagcctcataatggatccaccaaaggtgcaataacatatctgtccttacacgaaatgtaattgccaatatacactagattcataacacagagagaccatgcatattgtgcaggctggggacgcatcttatgacctctacgaggaagagaaagacaacatcctaaaatctttatctcgtcgtgcaaaggtgtgtggagtttacttttaacagattcacttcttgctatctatgcagacacttgagctaagacatcattttgtctggaatctggatcacaggcaatggagtctgcatttaacagtattgatggaattacatgcaacaagacggaaggggcgatgtatctgttcccacggatttatctaccacagaaggcaattgaggctgccagggctgtcaacaaagcacctgatgtattctacgctctacgtcttcttgataccaccggcatcgttgtgactcctggatctggttttggacaagtgagctactttctactcttgatctttgaaccatagtgatatgtgctgtctgaatcccacagaatgataagtgaactgttttggggaacggctgaagctcacgcagcacaatctatattcctgaagagtctggtagtagtagtagtctcgttctacaagaacagatagcaccaattaaaaaaaaaacaataacagatagcaaccgttttttctaccatttcagatcatcagatgttatctgttcacctgcaattctgaattcctgaccactcaagtttggtcctttgtgaaaggttgcagggacatggcacgtgagatgcacgatcctgccgcaggaggagaagataccttcgatgatctcccgcttcagggaattccatgaggagttcatgtcacagtatcgcgactgatggactgaactcataaggcttcgccatccagaagacgagaaataaagcaaaacgccgttaatctgcgatgtgttaacggaagatgtgcagcaaccttaatctggaaaacttgagcatactcagtttgggtcgtaaagaattcacgggctgttgcatcagtgtttgcccggtacaaggtttgattggattagcacgatgaatgagtgcagggagacctgcagctaaataaatactccctccgtcctataatataaagtattttgaatttttgattgcaacgtttgaccgctcgtcttattaaaaaaatttaaaattattatttattttattagtgacttactttattatctacattacttcaagcataacttttcgttttttatatttacaaaaaaaaaattgaataagacgagtgatcaaacgttgcaagcaaaaactcaaaatcccttatattgtgggacggagtgtgggacggagtgagtgttaatgttagtagttgtgagttagtgactcgtacctaaaagtaatgctacgaaataaaaatgtgttgagagagtatcttacattcagtaaaggttttccaatcgagttggctatcttgaaacggaacgagaacagcagctattgttttgagctctgaaatctgaagcaggcgacacggagcagcagtctatagcgaatctcttcttgaagcgaaactcaaactcctcgcgatcccgttcattggggcgtggtcgcgtagattcatcattcatgggcctcgcactcccgcggctaagagcaagaacaatagtaggctttatgccagctataacaagaagaaaagagaagagagaaaaaagcgggctataaatttgtatccagctgaaacatggacttcaagacactttgtgtgtttgagaggtgagaccgagtattaattgtgtagtatatttttatagataactatttaatgaatgagctattagattagttatagataatttgaagctaacatttggctatactattaaacttgctctaatcgggccatgtgggctgcaccccaaccatccgggctctcggctctccagcagcatacgacctctcgggactcgggagccctacggatttttcttaattttaatttttatctattaaaacattttctaaaacattcttaaagtataacagatctacacctttaacgtcctctatttttacgacgtggtatatgttctaaaaaaaattaaatcctagctactaacctaaacatatatgtgtctaaattctcatattaggattggattgagttttttatgaaacagaggtgtagctgttaatgcatgttaactgttgttgagaggggagggttgcaccgtagtgcttgtaaaatagccagccttactttacgtagtcgttagcattaaccaatgactatatgtatgtcacgttatataaagaaaaaacgctaacacttttccacgaggccacgttgttgccgccttgtctgctactacctcgacattttggtaccgagaaagtaccaataccgcacttccaccacctgtagccatatggacacgatgcagtggctggcatgttggtagtggcaacgcagggatatgtgggtattggttggcacatgacaaacggcgtcgcccaaacacgtgctgcacgcacgggtacgtcgtaaacgtatgtgcggccacacaccagccgtcgtgctcacgcgtcccagttttaatttgtactttttcctccgtctctttttaggtggagtcataattttcgtgtttaactttaatcatctatcttattaaaaaaatttaatcaatatttttattgttattatatgataaagtatgaatattattttatacgtaacttatttttttattttttaaataaaatatcaaataagagagacgattatggttgcgtttaaaatagaatgcatggagtactagtgtactacatcgagcaggagcgccatagctttgcggcgtccacacaacacacgccgtgccttttcccggagtggcaattggcaaaggcaataacatgcccagaattaagtatgcaaagcggttgctgccaacgccccgggttgtgcacatgggctatttggagaattggattcgcccctacgagtagtagttgctcagctagggttgctgtttgtttgccaaagatattctctgccactccctcctgaatgtttaacgcagttgatttttttaaatatatttgaccgttcgtcttatttaaaaacttttgtgaaatatataaaactatatgtgtacataaaagtatatttaaaaattaatcaaatggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgctgagtacattccttccttcagaataagagatggaatactcccatattgtcccatatgcgcaaggtagaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttggagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcacagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagtttactgcaactatgcattttaacattacgaaatcaaaagctgatgttttgccacggcgaagtcttaactctaaccgttaaatctcttatcttcacagtgaccgtagcagagatcacacattcacatgcaaaaacacgtctctttctctatacttcactttcacctcgataaaaaagataaataatccacatggcaggtgagaaattaaactattatcccgattatgtggcgcccataaagccagcagcgcaagcccatgtcatgccaacacagtagagcattgcacgcgctgtattcaattcgatcgccatgtgtagcatgtgcgaatattttttatcattagaaaaatatataatcttttcgaggttttgacaaggagagctatagctttcagctggcccaataataataataatcaaataaacaaggaaaacaccacatgtttcactgtactagttgagctctgaccactatatataatcacactgccacacaatctgctagcaattctcctccccctcttgcaatccattctgaattctctgatcttgaattcttcatcttctctctctgcaagaatctcgagatttcaagatcgaggagaacttaaaagtttttacgccatgattccgagagctccgagcctcttccatatcgaggatggagctgtgggtgtcgcggcgtcgacgaagaagccaatgccggctgactccggcgagctcgtcgggctccggctgatcatacagcagtcgccgaggcaacggccgccgctgtccgtgctcaggcggtcggcggtgaggccgtcgccggcggcgacggcggcggcgagtcaggatgaggctggtgctcctgcaggccgggggttcatggggttggggttcttgaactgctgctactgctgccacaagaagctctacgccgacatggatgtgttcgtctacaagtaagacattttacacaacaaatcaagaactccgccttaatccacacttcaaatagaaactttatttggtgattagtgatcatgatcgagctgaggaacttgtggttaattaattcttggatactgactgactgatttatctgtggttttttttgttttgggcagaggggagcacgcgttctgcagcgcggaatgccggagccagcagatggcgagggaggagaggcgagagatcgagatgctggtgaggcggcgccgcgacgcgttccaccgccggcgagcttcgccgccggccaagatcggtggacacgcgaggctgcagatcgctgcttcatgatttatatatacatatgacagacttatcgagatcgaggttcatctccgctagtttctgaacaatttttcaggagaaattagggaggacaatacaacggagacgtacggctactcattctgtcacagattttgttgtcctcgtctacttcacatgtataaattgtaattgtatttttcgatctcttcttttcgtctataaccagcggtagtagtgtagttgctgcagggtgtagatgctgcaaattaagttaagagtgtacaagaaagtagatgaaactgatggacatttgacaacgtgtttacggagtgtttgagatagattaagatgaaaataaagttagcatacgtaaaacaagaaaaccattaatatattattaattgagttaattgttataaactttaaaaatagatttatttgatcttttaaaacaacttacatacatcaagtttttcagacgtaccatttagcagtttgaaaaatatgtttacgaaaatcgagttaagataagtatcctaatcgaaaagaacgtgataactctgaagacatattcacttgcgtggacttaactgatggaatgatcgagctgagacccggaaaacattgtccagatcgaaaataaccatgaaaggttccttaatgcttttcccgaatttcaatcataaaatggcgtggacgttcagtatccgcatagtgcaaatgatctctcaccatggaagcatgagatctgggtgctcatccaacaaaggcctgtcgctttgatcaggcagcgactagctactccctctgtttcagattataatatgttttgactttgatcaaaatcaaattggttcaaatttgaccaagtttatagaaaaaatagtaatattttcaacccaagataaatttattataaagatatatttaattattaatttaataaaactaatttggtaatgtaaatattactatatttgtctataagcttagtcaaacttaaagaagtttgattttgatcaaagttaaaatatcttataacgtgaaacggagggagtacataacaatagatttgcactgtgacaaactatgaacagctagctgcagactgtcatctaaaaaacactgaaaaagttccaacaggatgtttatattagtgtatttgaggaagcttccgattcaaatgtgtactctcttgtgatagaaatcaactatcagggaatctgttagtagtaaatcaaccatctgaactagtatttatctgaaaaccatctgaactatccacggtcctgaactttgcataatgcccccgtttctgtcgctaccaatgatagcgaaaatttttgcataacacggacaactccaaaacacgcgagtacaaaatgggcctttagcccactcgcataaatgggcccccaagtcctcaacgatccttccgctgttactttgccgatgggcctcgtaggccagccatgttagggttcagtagatgggctttgacgatccaatagttagttggtcctttgcttcggcgggcaagaattaagaggcccaactctgaagatgtactggcagacctgaacttactacttcgagcatgttcagattgataccattttttaaagtaaagttgttaaatatgtgtatccatttagtttcttaccaaactttagtaaataaataagaaatcctgccaaaacttagcaatattactaaattgccaaaatttagtaagatttattttggctacaatctaaataggcccttcaactacgttggagttcactgaacttgttcgtaatagatatctcgaacaagaattaggaagtcctgagcattcagctaagtatttttttagcataataaaaaatgactgccagcctaggagaagcagccgctttggggtgggctggttgcctgcggccatggcaatggatagagatgccaattgtgccgttcaacgcacaactgaactggaactggataggaaggctgccaggctggaagggattcctagggtatgtctgggaagtttctacattgtgcagcttctcatgaaatcaaaatcttctctaaataatttagcttttgatataaattctaagaagctatagtagtaaaatgcagaaaatgaattagaaatcaaaagttgaaaaacctactacctcaaaaaattgcatttctagctctaaagctttgtcccacaaaaattgtatttctagccatgtggggcccagcaaattgattcatctagataagtttccttctctcagcttgtaatttaagtatgctaattatatgggttaattatctcaaacttatttttaatcatttgtatatatggaatgtgtgcatgcaatgggttcattaaataaggtcattgtggtcattttctaatcctactgttttatcctaaattagctagaaatgtaatttttatgagacggagggagtagctttttttataatctcagaaactgaccatctacgagctgtttgttactccaatcttaagcttctcaaatagacccatagttgaagagatgccctgtgttgctgcatggtctctgcaccgcacggcaggggagatgtgccgcttcatcaattggccgctccgcccacatgcaagatgcaacgccaacgcccagaaagtaggcgagagagacacatttcttcatttttcttgactatgaatgcgagacactgaacctgttctgcctctggatgataagaaccccacacgttccaactacgcgctgcttcaatttgtagtactgtagtactgtttagagcaggtacaatagcaggctacaaaccagctgcaaatatattttaagaagataaataaggagagagagaagcagcgggctacagatttatagccacctgtagcacggattttaagacgtattgtgtatataacatgtgggaccatatattaatagtgtagtatgtaactatagtataaataagctattaaattggctatagataaattggagctagtagttggctactattgaacttgctcttataacccgcaagttgccgtcgcctcccgccatctcgcatgattaaaagtttaaaaccgaaccaccaaaagcgcgacggcaaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctaggacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcccaattcatccctcatcagtaaatatttattgtagcaccatattgttaaatcatgacgtaaatagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatatatatatatatatatatatatatatatatatatatatatatatatatatatatatatatatatatttgctactcgtagtactagctttgactgtagctgcatcctgctgcctgcgacccttggttgctaccaacagatgatgctgtattaataaacgagaaagtgagcaggtcaagttggcaacttgacaataccggaattccaagaaactggggttggggagaaagttttggtattcgcaggcgatgcagccccgatctccgtggctcacccgtgtggccgtgatgccgttggtcgcacacgtttgggtgaggggagtccatggtgttgcggaggaaggtttggtaggaaggatcggcgagctcaaaaccggggaaagctcttcttcactgtgttgtttggcttgttgggtttcggattcgtgtgatgatactccagtttgatactacagtaaaatcacatgaacccgtaaaatgtactaatagtacggtcagaattttgaatggattttatagggttgatatccatatagtctaagagcaattttaatagtatagcccactactaagtctaattcatttatagccgatataatagtcaatttatacaatagttgtttactatactattaatatatgatcccacctgtcatacatatattgtgtcttggagtccgtactgcagctgactacatatctgtagcccgctactcttctctctcatcttttatctcattaaaatatgttcatagctagctaatagtctgctattgtacctgctctaagagcatccacaatgtagtccaaaagtgatccataagcaatataatatgtcattcaaccacctagtaacattgtgaaattagtacatagcaaaaaaataacaaaagctacccataaacatatgggctggaggataaaatatattatttgtctctacttcttctctccttctaatactatttgctatctatatacattatgaatgttacaatagttaaaatccatacatgtgggtcccgtctatatggactacttttgctatacattgttgttgggcccctttaaatcgtagaattgataaaacgtaggaatagaaaaaacgtaggattttgatagaaatgtaagtgtaaaacagaggattgaaaaaacgcaggaatgactgtttgattgaatcataagaaaaacgcagaaattggatgagagagatatactcaaaggaaagttaccaagaggttgaagctcttgctaaatttcctccaaaatctatataagattgttcatttcataggaatttcaaaggattggataggatccaatcctttgtttcaaagtgtttcttaggaaatttttctataggattgaaatcctccaaaattccaatgtttttcctctaaatcaaaggggccctaactacatgtagttagtaacacttacttcaatcaaatcaagtttattttaagttttgttagcacctgtaaccacatttcaatattgaaaagacttttgttgcttttaggttttctcatcttagtttattttagagcctttgtttctaaatcactaataatatatatatatatatatatatatatatatatatatatgaaagttttattcataaattgtttgtttgcaaatatgtcgtgggtctcgtttaagggcctgtttggttggtgccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaagcagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgacct

SEQ ID NO: 78723 - DNA, 5067 bp, Oryza sativa
acctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagcgcggccgcgccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaagatctttttggctgtgcctttgatgcaaaaatctgagtttcagttaatcaccatgtttatgttgtctgatgttcaagaaatcaagacaggattaatatgttcaagaattctttggttctttcaacatgattgatgaatcttttgaacaagaagaagatagtgttaggccgaacgcagcaacaactggtatgctttttgaacaaagactagaccattagttactgctactgcgagtgcaaaggcaaaattatctgaaacgcgctcctattcagattcacatgaaaggcaaaattagattcgaatatggatgaattaccccatctatctttacactgcttcacattcagatgcgactctaccaacgagaaatcaaatgacccaccagcatctatcaggctgtcgatcatttcggtggcgagtttatatcaggtcgcttcaacgaacttgctgtcggcagtagcaactatcatggcctccaaacagcgagaaaagatgctgctaatcttcgatcttatccctacactacttctactagtaccttcattgttccattaacatcatctccgtcaaaaaagaaacaaaaaatatacagagaaagaaagaaagaaagtaacttcaaacagttctgaattcttgaatttccctgtcgtgggatactgtatcgctgtgacaacacggtggtgatggccatagccatgccgtgtttgtctgctaatctgtttgttcctgtcactgattcccttcttgtgaaggcaaagctttgacacagccgtgtcaccgatggcacgaaacagatctttcactttctcatgcagtgaagttactttggctctcgacggcgacacagaacgatctctctctttcacaaggcgaaagaggatttgtaattgttcgtctcctctggtcaccatgaattatataaatttataatatgagtacaaccctattgagttttcatttttctgttttggactatttcatcaaagtcaattgattggagatggcagcagagattgttcgagcagaacgagtaaacaaaaaaggacgagatatatacatttgttaagcctcaacttgactgcgaggccacatacagagcccccaaaagctaggaaaaaagtagtgatatttcccccatgttagagataagggacacgaataaatatttgctatgtctagaagccgtccatgcgttcttggcagagaaacagtgaacctgttcaagatgctttctcaagtaggtagagttgagttgctcaactagcaattccagcatacgacaaagcaaatcgatcacagcaagagccagccaacttcaaaaagaaaagttttttctttcttttttttgggcaagttgaatcatggatgggaacacgcatgacagcgccatttcattgcattatacaaaccgaaacgctgcaatcatgtatggactctgcctgcacaggcccagctgggcaccattcctctgcttcttgcataccaaactcttctcttatcttcagagttcatcactgaattaaaatactctgttgatagtgctaaccattttctcctgtgaccaaataattgtttctgaatttcttctgcttgctaactgcccagggactagtaagggcctgtttggttcgtgaaataaaaaattttggatgtcatatcggacgtttgaccggatatcggatggggttttcggacacaaataaaaaaactaattttataactcgtttgaaaaccgcgagacgaatcttttgagtctaattaatccgccattagcacatgtgggttactgtagcacttatggctaatcatagactaattaggctcaaaagattcatctcacgatttcttccctaactgtgtaattagtttttcttttaatttacatttaatgctccatacatgtccaaagaatcgatgtgatgtttttgggaaaaactttttgggaactaaacggggcctaaatatgttccgaattcagaagaaaaaactgtcaaactaaatcataaacggcagaatcttgagtttcttttaggaagcaaaaggttgcaagtgaaatgcgaatcatgttcagttggtttctgttctattccatgagtgtccggactttttgtgccacattttgtttgggggggggggggggggggctaccagttgtgccccataccgctgtctgcatacctgggcaagaaccacggttttgtgtgcttgctgtgtagtatggatcatcagaaagagttcttgattagctaagcgatgacaaatacaaaccaggtttaattagtgcaagtgtcataaatctcaaaaagctagtcctaggtagtacttaaccggtcaatagaaataacaaaggagataggtattactagcatcacagtttatgatatgaaaatgaatggttagtgtcagaactggagctttacaaattttgttggatcagggagaggataagagtgccaactccattgcattggcttgttaaatactactagtagccactaattaacatgaaccctccaattgtatggagctagcttttaagtacctttagctaattaaacacccacttgttgatgcagcctactggcaaaactggaaggccgtactccgggaacggtttcggtatcgtgagatcgttgccttgttgtactggtaactgtgagtatggacgtcactggtaaattactgggcttatctatatcctgcagttactgaacccttgtcaaaagggcaggccatgtgcaaaccagacgatcaagaactcaattcccgtttataacattggagttcactgttcatcgcagtaaatgaacaactagctcgtacaaaatttctgcatataattatataaaataggattattgaaaaatttcacaaaactgcagatattttgataaaactgtcacaaaatcacatgtttaagttgttgtgtcacaaaatacgcatttaacatcgaatttatcacaaaagtatagatctaagctatggtatctcgtaaaaagcacatattaaacacataattaattgcaaaagctttgcaaaagtatatattgtaaaagttatcttgatgaaacttttaaaatacacaaagttaaactgggtacaaagcgataaatctgtagcttcgtgatatcatttcttaaaaatatagttttatgataaattggaccacgttgattatgtgtaaagctttaagtctgtaattactatggtactccctccgtcccaatatataaaaacctagaaccggataggacatttcctattactgcgaatctggacatgccgctaggaaatatcccatccggtgcctgtctagattcgtagtactatgaaatgtcccatccggttctaggttcttatatattgggacggagggagtagttttcaatgaagggtaaacggttttgtgaaatttactcaaagggattatcctttttatggaacttcttacgaaattctaacccaagggtaaactgtgtgtcaactgtcaaggagtagtagtaggaactgagcatccaggctgggagtttagaaattagaccaggttcaggttctgaaaaccttttggtgccaagcggtggaggcgacgagagagaaaggtcagaagtgtactcggttggtgcaatatgccgttcctatcctcaattcctccatcctcccacccacgacccttgagcgcctcgcaacgtcgtcggctcggctcgactcgtctcgtcgcccacgaattttggagggtcgcgtactgagctcgtggcccgcgtgaccatttcttttattttctccccctacttttcccgcgctgctttcccctcgcgccatccaagcgcccgcctctatatatgcgcgccgccaccatgtccagctccggcaactagctactgcgaagtgcgaactgatcagatcgtcgagaggaaacccaagatccaacgacgacatgtgtggcggcgcgattctggctaacatcataccggccacgccgccgcggcccgccacggcggcgcatgtgtggcccggcggcgacggggagaagcggcggaaggttggtggaggcgggtgtgatgacgacttcgaggcggcgtttgagagattcggacgtgaggactctgagatggaggaggaggaggtggaggaggtggtg

SEQ ID NO: 78724 - DNA, 22914 bp, Oryza sativa
ggggacgcgagcgtagcggcggcgcgccgacactgcagcagtcagggcacgcggcactccggccgctggctactggcgggcggcagcaaggcagggtgcaggtgggctggcggccagctgggggatgcggcggcgtgacgcggcatcaagcagggaagggggcatctgggcaaggtgcaaagggcgtcagcagcaagcagcagcactgcagcaggtcatcagcccattgcccagcacagcagattgaggaattgtggtatataacatttttgatttgtcatttaaaatcaatttcaattgtcaagtctagttgttactaatagctcaagtcttcaagaaatcatagagatattgaactgaaaaattttgtttgtgattcctagttgctactttgttatattgctaggttgtgaagatgccgaaaagaacactgctcacatattattctagtttaagtaacacaaataccagcgatcctccactcaataatgagattgcaagtcagtcaaagaggcctagggcagagtttagtcatatggatatcattggtgatccagtggaatggaaaccaattgagaattatcaacctgaaattagagatcaagtaaaaaggatatatgcattgagtggtccaactcaaccagatttttgcacatttcctcgtaagtggcaaagtggtgaatggaggtcctttcaaaaagcttggttcaatgagttcgattggcttgagtatagtgtttcaaaggatgcagcttattgcttgtattgttatcttttcttttagctaggaaaacctaaaaatttggaagttctgtatttgctaaggaaggttttgttaattggaagaaagctaaagataggcttgctacacatagtaattgtaagactcacaatgatactaggaaaaaatgcaaagactttatgaaccaaaggacaagtatatttaggaaaattgagattgttagcaaggaggaagacattagatacaagattcggttgacatcttctttagatgttataaggtttctcattaagcaaggtgatcctttccgtggacaagataagaccaatgcatccctcaataagggtaaatttagagagatggttaattggtacaaagacaaggtcccataagagcaataaaaattgccaaatgttatcacatgacattcaacaggatcttactaaagcttgtgcagaagaagtgacggccgtgattatggatgagattggacattgaaatttctccgtgcttattgatgaatcttgtgatgtatcgataaatgagcaaatgggtgtcatcttgaggttagtagtaacactattaattttttgccattttgtgatgctttcattgtaaaatttcaatttctttttaagtactaaccctattaatttttgccatgcagatttgtgaatgatggaagggaaagtgatggagagatttttgggtcttaaacacattgagagatgtacaacggttgcattaaaagaagctttggttggtatgctttctagttataagttaatcatctctaggattcgtgagcagggttatgttggagcttctaatatgagaggggaatttaatggtgtgcagaaattgattagggatgaaaacccttttgcttattttgtccattgttttgcccatcaattacagttagtggttgttactgtttcatcttctactgcagccacgatagatttttttaactatgtgcctttaatagtcaacactgtgggtgcatcttgcatgcgaaaggatgccttgcttgcaaaacatcatgatgtattgttagaaaaggtagagaatggtgagattaccacgggaagagggctgaaccaagaatgtagcctagctaggcctggagatactagatggggatcacatcttaaaactttgcttcgcattatggtaatgtgggaagctatcatattgtcagggttatggataccacatacctaatagtagttgactaaatctcggcaggacccaccacataccatgtcttatacggaaacaaccttcggatataggaggagttccgcataaggaaagatgagtatagttctacatggaaacgacaaggactactcggattgtatccatattggtttccctagttctacttggacaaggggacacctatgggtataaatacaaggccccctaggaggagaggggacacggaacaatagatcaagacacaagatcaacatacaagccaacatacgctaagacaagatgccggatatcgacttcagagataagcatgcctagtcccctatggtgtctacggatactgtcaggagagacaaaagcgctgtctttgatctcgccggatgcggattcgaggaggaaggctaccctgttgttgactacgagtcaacacttcagaccgccaagtcgacaacagatagataggctaccccaaatattgtattggtgtgattatgatgaataagagcaacgaccggcttcggccaacaggagtagggtcattacctgacaattcaggggcccgaacctatataaaaatcttcgtccccatctcttttattacaatctcgcatataccctggtaccaacgatccccatactatgcaaatactggaatcgcgacatcaaacgtcgacacatatatgtgcttgagaatgttaagaaagattctactaaaccaacatttattggtggagcatttggtttgatgggtaaaatgcaatggtttgattttgtgttcataatgcatttgatgatagacatcttgagtataacagatgacatgtcacgtgctttgcaaaggaaggatcaatacattgttgaggcaatgaatttaatcatttatgttacacaagggagaatggatgggagcctttgatgaatagagtagcatcattttgtgttaaacatgagattgaagttcccaaaatggacaaggaggtaaatgaaagtgggacatctctatgtcgaaagcacaaggtaacaaataagcattattaccatgttgagatctttcttgcagccatagatgcaattttggcagaaatgaatcgtcagtttagtgaagttagttcaaagttactaagtatgcatgtcagcctttaatccatggattttcttatctaattttgatgtggataagcttgtgaggcttgctgaaatttatagtcaagattttttggttggtgatcttatgcttctacggcctcaacttgcaaattttattaccaatattaggagagctaaagaatttgttggatgtaaagatcttgcaaaggtggcagaattaatggttcaaacaggaaagaacaaaacttatccattggtgtataggctcattgagttagtattgatacttccggtggcaacgacttcagttgagagggttttttcaaccatgtctcttataaagacaaatttgagaaacaaaatgggggatgaatggctaaatgacttgatgatatgctatactgagaagcaaatttttagaagtattagtaatgaaaaaatcatccaaaggtttgaagatatgaaagcgcgtcggatgttactacctaaaaataattatttgaagctattgtttgtcaattgtcattattcattaatttgacatttcttttttatagactacccctgatgaagaataattggcgatagggtgtactagtgtcgcacatcatgcatcatctattggacatttcaatattgctttgatatggataatgtttatttttcggtaactctatatatttatactttgtattagacatatagccaatttatatgagacatatctcaacttttattggccacttttggtttagcccctactataattttatcctggctccgccactatgtataactagacttgtttttaccatcacatatttgcaagcggttaaatagtcacattttttcaaagtattgtgtcatcttttcagctttcataaaaccagaatacgactcctatatttgcttggtaagtcctataaacaaaaaaaaaagagaatatattgagccacacatattataccaattgcacactacctccccgttttccgcgcgatagggcaatttcccaacttctaacttctcgtttttcgtgtgcatgctttctaaactattagatgtgtttttttcaataaaattctatagaaaaattgctttagaaattcatatcaatccattttttaagtttttcagctaatacttaaataatcatacactaatgagtcgctccgttttacatgagagaagtttctaatccttacattagaacgcacctaaggaatgtactccgtacttatcactagaccactttactgttgacaactatcaaaccggactagcggaccaatgttgctttggttcagtttattgtaaggacaaaatttaaaaggttcagtttctagctggaagagacctcctatcatatatttctagcaggaagagacctctgatcatatatttctagcaggaaaagacctgtgatcatatatttgggtgtcagataaattcagctgaactaaaagcttgtcataccttcagttacctactacaagtctacaaccatgagtccatgatcaactctgaattcagataggtggaaacatactgctgaacaacatagttttctatagataaatgcatgcacaaggagagcctcaaggtagaatctgattgaaacgtcttcacaagaccggtggcatttattcaaggagaaaaatcgtcctgcatttgtttcggatgcaataggatcataagtcccattttagttcttggagtttaacaagtttccctgtcctccacaaggttccataaatttatgttttcttagagcaagtttagtagtacagcccactacttactataagccaatgttaaagctaacatatataataggttagctataaggttagctttatttttttcatcctctctctttatctctctacgaatttaatgcatatttcttagagcttgtgtgtagctagctcttgcatgagagccaacactctccacttttatttatctctctcttccacataagcatttagcttgcttatagctcaccattatccttgctcttatgtacatattatacccatattatggggattaaccgaagaacaaggccttaatgggaaattatcttggaggcctccccaactgttcaacagcaatgaagcaccatgtataattgaccagaccactacgaactacgaaattgaaaagcttgaatttctaacaagtaagagacctgtcatcacatatttggggtcagtgaatttcatttgaacttaagcttatcataaacaagcatttgaccaactgtggtgcttgcagatgggtttggacaattttctatggatcctaattgatggaagacaaatgcaaaggtcaagagccatgctcaggaagaaattcaagtttcaacctgattggaatgcgccatggcaacattcccctcctccatgtccttgagaaattcagcgaatgcagtgcacgatgatcccccttccttccatgctgccgctgcgctctccttcatcgccatgacccgctccaggactccctgctgcgcatccgattccatgatccgcctcaagatggcatcgacgatgtcggcctggacaagtgccccgggtttataccctctgacctcgatgccaatcttcatctcctccacgatgaacaccttgttcatccactgctccgcgtcgagcggccagcacaccattggaacgccggctgcgacagcctccagcgtcgagttccatccacagtgcgtcacgaatgcgcccgtggatgcgtgctgcagcaccgccacctgcggcacccaggacgcggtcaccacgacgcctctgtcggctgtccgcgccaagaatccgtcaggaagaagagacatcgcggcgtccggcttcgtgcccgcgggcgcgcgcagcgcccacaagaatctctgctcggacctctcgaggcccgtggccatctcgctgacctgctccggcgagagcgcgccgcggctcccgaagcagaggaacacgacgctgcgctccggctgcgcgtccagccaagcgaggcacgggtgcctctcctcctccgcgccgccgtcggtgatcaatggcccgacgcagtagaccggcggcgtggcgcggttggagaggcagcggccgtccctcagcgccgccaccccgggaccctccagcgcgtcgaaggtgttcaccagaatgccgcgcgcgtccgccatccggtcgaacgcgtccagcatggccgcgcttatgtccgtcccacggtcgagcacctcctcgggcaagtgcgacgccggcagcgggcgcacgccgggaaacgacacgggcgcgtcgccgagctccctcaagcttccgctgctcccggcgcaaaaccgtggcaaacggaggaaaacggcgaggttggtggcgccggtgcagaagaggaggtacccggggacgccgagctcggcggcgacgtcgagggcgtagacggagaacatgtcggccacgagcgcccgagcggcatgggggccacgcagcaggtccccgagggcgggcgcgtgggcgcggaggacggcgagcatacggaggagcgggtgagcggcggcatcggcgccggaggaggcaggaggatgaggaggaggagggagtggatggacggagagggaggggaggcgggatgcgtacttgcggagcgcggcggagaaggcgggggcggtggtggccgggtcagggacggcgaccgtgacggcgaggccgtggcggatgcaaaccgcggcgagctccagcatgggggcgagatggcccacgccgaggctggggaacaagaccactctccttgcagccgccattggaggatcgctgctcacctctgctcttgcctttcttgaattcttggtgggcaatccgcgacggatagagacgatgcactactaatcaatctgagggactttctgccctttctttttcatttttttccccttctttcgtgtggactagcgtggcgtggttgcttttccgtttttgtttaatcatcactgtcaaatatatacacatatcactgtatctgttcaactaatgacctaactttctacttcgtactaaaatgatccaaatggatttggggaagactgcaaattgtgcgttcgatttctgaaaatttaggcgttgtttcaccacttctatgtaaattattttattacttttaaatgtatcaactaattacacattaaaaaaatatcgcccttaaatcaataaccactacattaaacattaaacccaattaccaaaatatcgaaaatattgaatgtgcaacgagtcgtataaatattggcttctcacacacggatcattaaatttgaacggttgattttttttctttaacatataatcctatggcctctttcaaattaatcaaaatgaatacaaccgtataattgtataattgagcaaatactttagggaaaaattagaacatactaatagggtacttggatggatcaaaagcatgggtgtcagcttctagccttccacagaccacagctaacacgctggatccggcaggtggcaattatggtggaaagaccgcttctcaatcactccacaaattttctctaaaattactctgaattgggccatctatctatctattatatactaaaaatccattaaactttatataaacgcttctaaaccaccatatggtatcctataaaagctcctaagctaccacatggcactctcataaatcggtggacccactatttttaactattaaatttctttttagaaaaaaaataaaacccccataagcaatctctctccttttccctattggcctatatggtacatgatccttcacttctccgctggcggccccaagagaaaaaagcaagaaaaaaaataatatgcacgtacgtaaatatatacacgtattcatggggaaaaaaaggaaaataaaatatgtacgtacataccccagaaaaaataacaaaactgagcacagtatcgatggaaaaaagaattaaagaacatgtacctacgtacatatgcacctaccatcgagaaaaacaacgatcaataaaacatagaacatccatgctctctataataaaagaaaaaaaatactacatcacgtattaacaatattttaattaaaaaatcacaaactgtattatacctttttatgccttttctcacaaaatagagttaataattacggaacaccacattcatttccaaacatttccatctacttcacctccccctccccttcccctcatgtatatccctgtttgctccttcctcttgcttgaactggcactatttattcttttcccccattcctattatttggttatccaactaaaatagaaataatttgtaattgtaattttcaaatgatgataatttttaaactacgtgctacacgtatgatttctaatataactatttctctatttataattaaccaaacaaattaagattcatatacctatgtttttctatatatgaaatatatatagtcaatgcatgtattatatatgccatccaaataacaaagaaatatgataaagaatatcaacaaatattacatcattacatagatcattctataaatatgcatagctaaactaaattagtagaataaaaaatatatatttataaattcaagtatgaaagaatacttttatcgatagacaacacttgcctttttacatgtcgtctgaattgcaataaaaagctacaaaataattcaacaacacatgttgcgccctcatatatcatatgtagattttttctacatctttcaggtatgaacacaattccatttatttctttgtgcatgaaccattaaaaacaattgtcatatattatacacacaaattataataaatttattcagactttggaacccagacattttcttgcgcaaacaagtgcatgggagagaaagagaagtacggagagagttagtaagccagtcttgacaagctaagaataatgtatcaatattagatgggacaaggcacaacgagcgtattttttaggcatggaacatatttactaggaattagatatgatcgtatagcaaccaaataattttcatgctagaaatgaaaaaaaatgaaataattcatttggtcttgggaacacagggattttctatggtctttgatacgattagcaactggataggtattataggctttatataataatataaatatacttaatacatgccaggtacaggctaactaaataaaaattaaaataacatagtagtcgatctcaagtaaaaattcctaatattaaattaattttttttatggaaaagtatttaaatcatctaaacaatcacaatataccacattctaaaaataatgatgcatgctaattatataattttagttgttcgattgtgttcacgctaggttgcgtgaagcctcacacaccacacaaatagtgttcataaatagattgtgtgtcacaccacataatcatgttgaactctacaaacccatgtacatagtgtagtctcatgtcctatccaatccaccaattattgaccaatgagaatatatatttggccttaccaacttatataaaatgtcattgaaatttccatggaagttgaaaaaaaagtgtaatgctctgttactatttatcatatcacaaattttatacttaaaataagatttatatagaataaatagaaaatacaaaaaataccaattgggagtaaatttaaccaattggagaaattttgcttcttacttcacacttaaattgaagctactattgcaataaccatttcataataattgccttagataattggaacaactctgataggttaaaaaaaattatttaagcaatgccaaaaagaaaattaatgaataaataatacatttgaagcatggcatgcaaatgttatccaattaatattctgcttctataattgtcttaaatgaaccttacaatgcatgcccgcacattcgcgtgggctaactttctagttatatactaaaagtccattaaacttcctaaaaatgctcctaaactaacatgtgccattctgtaaacgctctcgagtcgccacatctattatctattatatactaaaagaccgtcaaacttcctaaaaccgctcctaaactgacatgcccgataaacgctctcgagtcgccacatgtcactataataaaatagacaaatctgataattaatttttatttaaattagtggacccattaattttgatcgttagatttatctttacatgaaaacaatatccctccgtaggtaagtacgatccctccacgcgcaacatatgtgctatgcatccgacctctgtttcatttgttccttttttttatccccataataattaaaattaaaaacctttttgggcctaaaaagcccatcaacctattagatatagctagcttttcctctatcctctcctaataaatagtctattaaacattatctaaatatttctaaacatctatataacactcttaaattagaggaaatctaagaaattatatactaaaagtccattaaacttccaaaaaatactcctaagattccatgtggcatcttataaacgctctcgagttgccacatgtcactctaataaaatagataaacctgacaatcaattttcatttaaattagtgaacccattaattttgatcgtttgatttatctttacatgaaaacaatctccctctgcaggtacaaacgatccctcctcgcgcaacatacgtactatgcaatccgacatccatttcctttcttcttttttatccccataataattaaaattaaaaacattttttgggcctaaaaagcccatcaacctactagatatattgctagctcttcctctatcctctcctaataaacactctattaaacatgatgtaaatatttctaaacatctatataacactcttaaataagaggaaatctaaaaaaaattctaaacatctatataacacttttaaattagaggaaatctaaaaaaattatatactaaaattccattaaactttctaaaaatgctcctaagctaccatgtggtatcgtataaacgctttcgagtcacaacatgtcactctaataaaatagataaatctgaccatcgatattcacatatatttctaaaaacgctttcgagtcgtcacatgactaataaaatagataaatacgagcattgattttcacttaaattggtggacccattaattttaatcattaaatttatctcacaagaatataatctccctccgtaagtaattaggatccctccgcgcgcaacgtacgtgctatccatccgacctccgtttccttttttcctttttttatccccataataattaaaattaaaaactcttttttgcctaaaaagcccatcaacctactagatatagtagctcttcgtctatatagcattcatttgttccgaaggagcatatcggaaaatctccacatcctacaaaattcttttaaaaaagaaaagcttttgttccaaaggagcccgtattgttattgtcaagaaagagagcaaaaaatcatctcagaacgggcgacctgggctttgtaataaaccatgtctcctaaaccgatactttacaaatgatacccctccgtcctattttaaatgtaaccatgagtttccatatccaaatttaattgtccgtcttatttaaatttttttaaaaaaattaaaaaaacataagccacgcttaaagtgctagtcattttttatcatctaataacaataaaaatattaatcataatttttttatataaaacgaactattaaagttggacatggaaaatcattggctgacgtttaaaatgggacagtgggagtacctaataatagctcatctctaggctaataacctatctaattatttaggggatagatgttactatcgagcaaggtaaagagtttcctacattaccaacacctaacaggctaacacacatagaatatgtcctcatcaattggttcttcctgtagtgatgttggtaaattggcatctcttacacgcatcatattcacccaacgcgcaccatctcaaatgcaacttccattattacaatgttgagccatatcattattatatgttagaaatctggatctttatctaattaaatctaggaaggcagaactttatgacacctgacacctcctaattggagcctggatcaagattagccatgtccaaggaaaaagttgtctcagtgccaaaattacctatatccaggaatgggtcaagtgagtcccactcagtaccagacacgcctgaagcatcacaaatcggtgcggtgtgccttgccacattctggctacttgaagcggcacctgaaatggtccttccatgctggtcgtctttattgtttgaaaatgtagcacccccaagatcctgagtatcaggtggtgttatgctgatgcgagctgaatcaacattgaaaaagtgagtaggataacccaccatgtaatcagcagggctgttgtatgttcctccttttgttcctgcaatagccacatcggcatcaattctactggacgttggaaccagcaattccccatgaaacttatttaaaacaatttcttgatgttctccgatgacagtgtccttctgcaccaaatgatctctggacatctccttcacttcatggttctccgcagtattgtcttccacaaaagcatcaattggagcatcgtcagtagagaatagccattcattgacttcatctcctgaattctcggtagcttggtttttacatgcagagtggaggttcttacatctcccggaatctaatacttcattgtctgaagcaatcgacagggatccttgatcaccatgagctgctcttctgagaggaatctttggatcatattgtagacaatgttcacgagggtgtacaaggacatccaaagccagcaaagcatgtgaacaaaattttgcaagctcggtaccagtctctagcctccctgttatgacaagaaaagataaatactacaacaaacaaaattaacacgttttgagaattacatggatgtaattaagtaaatgaactgctatatgaaatgcatgatttatttagctagcttaacaaatttcatgcgtatgtgtcctagtgggtttcttctgtatatcgttaactctacgttttaccaatgaattagcaaaactggaatgcatgtggaaatagatgataaatacagcaaatacagattggctcagaacctggaagaaggtattacctttgttgaagagctcaagacctcgttctaaataaggacaattgtcaggagaagaaagaaaggatgccaatagagattttaacaaggctaactggaagtctgaaaaagttggatctcctgccaatagtggtcttagttcatacatccccatagtacagaaagactctcttgcaacattaataagaagcaggtctatttgtgtcctccagtagcatgctctgaatgaaccaccctgctcatgttgagagtcaatagccaatttcaacagaatatacgcaagattatctactactagtcccccatcccaaaaagacttcatttctagctatgaatctggacaaacgaagtctttttgggacacatgtctatacatcctaaaagtaagagtggcacaataaataacaccttggaggcaacctagccaattgagtagagatacgaaatgatgagtggattaagaagataatggtactctacagtattctgtttgtattaatgaccaacagttaaaccgttcttataaggaatgccaccgtgaaagtaaaatagtaataccagttcaaatagtcaccgttcaaaaaacaaaatgctagaattgcacatgaaatagatatgaacaaaagaacttgtcttgcaaatgaagacaaaaggatggatatacaaagggcaactttacataagaaaatatacactaaaggaagttccaatacgtacaagcgcaaacaaaacaccaccgcaaccatggttttcaagttcgatttaggccgaaatttcagccatttcggttctatcgaaattcctgaaaatttggtttttttggaccgattttttttttgaaattttaacataaatttactgaatgactaaattatgaccaaatttgcataagtttgagaaaaacagaaaaattcggccgagataatcacttgcccaagaggggagggggtccaaaattactgaaattgcaatcactgaccacaaccacccaaaaccaacaaatagaagttatggactagaaataatgtttcagagagccgcatcacatgctggtcaacaccgctagatcatttcctcctcaaccccccacatctccacttgaatcccctctaagtccatagtgaggtcaattgcaatgagtcaatagacgacgcaggcgagagcatatgtggcctcatcaccatggtcgaacacctgctgagggtgtccggaagcatgacaatgttggcgaccaagtcaccgtgggaactcactacctacagcagatcagtagacgctgatgcaggaatgtccactttgaagacttcatgacctctttgaatgttccgagaaatttgataataagccactaaatacgcatacctttgcaaacttgccatccaatccgcatgccttttctaacgcaccattaggagtgctaatttttttttatttcataccactttctctctttctcatcattttctcattttctctcattttctgttttatcctcctttttcaaactgttttacccctggccccacctatcaggtaagagagagagagagagagagagagaggttttaccgcagaaggggatcgggaaggggaggcgacacttgttgtgctcccattttgcgccggcgccgtctccaggtcccgtcgctggacgccgccactaggacccatcgccgggcgccgccactaggacccgtcgccggcaccgctaccagcctccttgcccatcaccctgcaacccgctgccaccggccaacctccttgcctcactgccagccagcctccggtccctagggtttgaagggagagggggaaagggggtgacggttctgctgcagaggagatcatggcgcaagcggcatgctcctcgattccaagtgaactcccttctaggtaatgctataaccctcgacatctccattatttgcactaacgggctgaggagcagaactaggacgtaattggttagcgggtaaactaatgatttttttactctcatttttcttgttcgtacgcgataggactgaccatgatgtggagtttagcgtgcacgttcagttcggtcagtttacaactaaacttgatgatggtacttgtgttgaagtggcgcgtaaatggcttgaatgggttgtggactatcatcagtgcacattggagagcttggaaaaggaccttgcagcaagggtaaaatgccaacatgttctgatcagtggctatgacatgagcaccggcgaggaaacaccgtttaaggataatatgaatgtagtccatgcattatttgttatgaagagtgatagaaagttgattttatttgttgatgtggaggataagcctattcagttgataactaactcgatagttttataggtcaatgaggtagcaatgggtgaagttgtgataggcagacaaggtgatgctcaagaatgtagcagttgtattgattgggatagtctagagatagctccaattctacataaccaagttcctcagcttgctattgattgggatgcattcgagatagaaccaattccacaacatcaacttggaggaaaatgaaatgtatacatttgttggacttagaactgaggatgagagagctgagcaagctagaattgaagctgagaggcaaaggaattatgttcctacaccaggtccagctcatactaaagggaatttgaaccttaacaaggtaaagattgctgttaatgtgtaatacctggagaatctgaaattttctatgacagggatgatcctcctatggaagttgaaagctcatatgtaagcatgaatgaatttaggttagctgtgaggcaacacgctataaagggacaatttcagcttgggatagagaagtctgataaaagagtttaggggcttttgcacagctaacgaatgcccatgggctatcgcggccaggctgatgcctaaatgaaaaatccatgagggtactaataactaactaaacaatgtctcatatttcaaatattggtttgactgtatgagttgtctcatggctgttacctttttttttgcgtatgttgcgggttaccttgaacaaatttgcccatacttgtgcatcaactgggagaataaagaccaaaatggcaagttagtgggtggcagagaaggcaattccttttctaaaaaaggatccaaatatgggtgcaaagaagttgatgggggaacttagaaaccaagtacaatgtcactttaggaaaccatactgtgttcatggctaaggataagatttttggtcctggctcctgacctctttctctggcgagaagaggcaagggcagcaagcaccctggctcctaaccgcagagcaacaggtaaaaccctccctctctctgttttacctgacaagtggggccaggggtaaaacagtcccaaaaaaggaggataaaacataaaaagagaaagaaaaagagaaaatgatgagaaagaaagtggtatgaaataaaaaaattagcactcctagtggtgtattagagaaggcatgcggattggatggcttattgtcaaatttctcttgaagttccctagcaaccacaacaggaggctacagcttggatctcctccatttgccacaccttcttcctttaccgagaagaaaggtcttgattgcctcattattgctttggagttcagcgctgtatttcttggcctcatccagctctggctccgagatgcttattctcgaactgctgccagcaacaccaatgaccaggcgacaccggtgattagcactgatgcatctgtgatcgtgggggctgaggaatggaaggccggagcaatggctagcccgactgcaggcatccgactaacagactggtcagaagcaacaggggaagtcctacaaagacaagagaaagctctcagcaaaagaagacttcccgagaacaaggaaaaattaagtctacatatatacttacgtggcttacggctttgaggagcaacgcggagtgaggggtgtcaactagccttgggactagtgactagtgaaaatatacttacatcttcgaggagggactaagtctacgtatatactgtcggcgctcgaaggaagagatggctgagatgagaagaatggacttgaaggtgaaattcaaaggcagcctacaaactttatcaaagagaaaaagcttaccaaggttgtgcgtgttctagaatctggagcgaagatggcattcaccacctcaaagtgcttagtccatttacaatcattctgaactcgaaaatacctaattgaaaccaatccgcacctatccatttcacctgtgcactcaaactgagcaaaacccaaactaaaaatcagctcattgaacccatttgatcccaaccaagcaggcctaaacatgagggagccctcgctcatctgaccttatttgcactaccagataagcactaagcatagttacaataggaaaaatgtatttaatgtggactaggaaaaaaaatttaaggcatttagaaagctgacgttatgatttggttacaataatctagttgaggagccaaataggtgaattagacagttatgcactcttgtttaactacaatgtattagtaaaagaaatctatttcgcttaagcatgagaagtgattgcttaagcaaaagaatgcgtaaatatacagttatacacataccagagtcagaagtacttcaaatgtttccagtgctgctattttgacacacagtgaagacattgattttctaatgcatgtaggttcagggctcccagcaattgagcttttcccatgcaatgcctgattgttgctggaagatctttctaatgaagactgatttattcctcctattggagctgaactcataacgaataggctgttgccagaattatcatccagatcagcagaaatgttgctaactaccacctgaagcaagtgcatacccatccctggtcaattagtggcaagaaatttaagagctttaacagaaaggtgcattacaagtgaaatattatgaaatcatctgagacatatccagtgaatgcagcatcctggactacaaaaccacagttgtttggctcagactcaacaggtggtttaacatttgatacgtccatgttaactactaaaaaaataacagttacagcaagtacatagagtaaaggttttctcccggaaccccctttccaagcataaaacttcgtagatcatctgctaatggcatgaaaatttattttgctccaaggctccaagcaggcataaagtgacttagtgtcagtaacataaatatacaaatagattctatacagttctaaatatagagcctgactgtctatttgataaagaaaaagagaatgccagcttgtctggtttgtacgaacgttgttgtctaagcaaaattcagctgacctgtttcatgtacaaaccctctatatatcctttccagcagaagcgaacacctggcatatgctcacttatgcagcagttttagattaacataacattattttacatggagtcgaactcaagggatagtgcttgggagctttactgctgtgagaggacaagagtggcgtagaataatgtcattaacctcgttagcccgatcgggcatcggaactggaagagtggacatgtcaatatctcgatcagtttttaaactacagtattctcccttcttcattgtgccaagcaatattggatatctatcactgtgtaataggaaatattggcaacttttttaacttttcaaaaacaaacacaatttgaaatgtgacaagtacattaccagtgtcgtgtcagtaagaaatatctgtgcataccagaacctgataatttgtggtaacatgtatagaaatttcctacaacacgtgtaagcgacaattcactattgaatgtgaaagggggctatgcaactctgcgaagaaattaaagatgtgatatttattataacaaagtaattaaacaatagaatcgatgacaaaaaacagcacgcgaaacatatcaatttccattcaggactatcatttctgaacacttgtacgattaactcacaagttggctaatttcgataacccaacttcaaatatgccaaactagtacttttaataagaaaagttaaatgaaaacatattattggttggcaactcagattgagaacacttatggagttctctacagttggtttgatatccttttccccccaaaaaactcaacagctcattatttcctaagacccccgaaatgattttcaatggtgctctgtctattcacaattgtacagacaggcccccaaagagatccagaaatgacatcaacagtagctaatggtaagagttacaaaacaagtgttttgagttcgagaggataaggtgcatactaaagatgattagaggttatttggatcagacattagttatcattttcaaatatttgaggcccaaggaggcagggagattcctcaaatatcagatgtggattgtggagaatggaggcgatatttcggatggaatatgataaggccccaggacaatatggttttccagctagagttttaccaagttttctagatcagagggactgatttgatggccatagtatatgattcgcaaaggcacacttcccctttactgccatctttggtactactatgttgttacaaaaaagcaaagagatgacaactatacaacaatatagaaccatttgtctactaaatgtgagtttagagaaaaactttactgaagtgaccacaatgagaattgctggagtgcaaaatttttataagatccacgcaaacaacttttaagcttggacattgtaccatggaaggaattacagttcttcatgaaacaatccatgagattgcttagggaaaaaaaccaaatggagtgaacttttaacaacatacttaactaagaaatattagatgggactcttggatagaacattttgcaacagggggagtatgatggtaaaagtgatgatagtttgaacttccgaactaagacagggtgacccatagtgccataatcaactctattatttaatattcggtggttatgttggcaatttagtaatatactattcactttaatttgatattatacgtggctatcaatttatatttgattgtttttaaataaacagtagcagaatccctaagttctaatcaactaaaattttgttccatagggctattgtagagaataagtgaacaaaatggacagatagaattgtgattggggaactcaagtaacatcgtgattattttaagtagtctctacgcatgtatccctattatacatgctttgggccactggctcatcgaactacaaggtccattacatcaacactatttatccactaacttacagaagaaatgcatcagtgttttgtttcgactactaatgcaagtggtgtgttaagtatattttttataaaagtgtgaatgacctaccaacacccatcgagctcatcaataatcgcacaatagtgtagagttttcttcttactgcaggcagctttgctcctttgaagtactcagttatgagcgttacaacactaccagcatgtggtaatagtgaactgcaggagaaattataactaaaaattaaatcaatttatcatcttaacatcacatgagatatctatgaaggctacaatactatagctagtaccaactgcaattaaattagataaggggtatggtaatcatcattagcctcatttgcaaaatttcaagtgataaagcacttctggaaatcatttagacaaacaaaaaatcaaagttatttttctaaagatcataaatttcaaatattgtactgaagcttgtctgctaatgatgtgtgtgtgcgcgtgtgtggaattatgtgttctgtttcttcatatgttcttttaaattttttttttgtgaaagatcacacaattactcaccaatcctggtgatttgtgtgtgaataattttgaaagtaaggcagaaacaaaagatcaagaatgcatgttacctgcgcattcctttaataatggcaccaagaaaatccaagaaagatgaatgcagttctagaatctcagaaaaagaaagatgacatgaaggggtgtcttgttgtactagtgatgatttatgaaatgttacatctgtcagcagcactcgttgtataaaagttaccaccgcaggcactggaatattcaccttcaattaaaataagggcccaagaatgtctgttagtgctaaagattaaaagcaaaaacaatgtttctaacaaacctgaattggataagaagtagttaacatcatggagcagcagtgtataagtgctgaaattgtaggaactgcaaatgtgcaaaatttctttgctgaatgaaagttccaatctccataggttgtctggcctcctgacagtggtggaggtttacttccaggtgaaattagtggcatcaactcaaatccagtatagcctgcaaaatgaacttgtggttcaacattgcacaaaattgtagtacaactgagaaggtaaaaaatgaggcaccaaatatctttgccttcatccagtccaacacaactaccatttaacaaattgttgaccacaaccaatatcttctggatcatcagtgacaaactattatgtgatactctgacacaaggcaatagtgctaaagtgctcgcaagtttctgaaagatgagaaaaatgaaaggatcagtcacaagtggcaaactgatgataatgaaaactaaatcaatgatggaatcaaatgaaaattaaaatggttcaataaaagcaaattccatgcctttgaatgttgtagattgcattgaccactcataatctttgctgcaatgatggattcaacctgaaattactaatatcagtataaaacttactacagtcagtgagacacaaccaatagatccacactttgatgtaagaatgtcagcattatccatatacttgtgaaggtgagcgtatatcatattgtcacatagaaatatcattgcaaggcatataagaaatgagtgtggggtatgctaccgaccagatggaaactgtgaatctttgatcagccagattgtgctctccattttgtacttaatgtgtcaaaccaggtaaaaggtaagagatgcatttgacgtgctagattcataaatcaacttgagctcaaggtaccaacaaattatgacaacagaatgagcggtagaggttattataatctctctattcctatacttctgattactaaaataagcattcccaataagccacatcatagaaaaattggaagcctttggatgaaagcatagaagaataatagccattgaatgttaaacatgtatccgacatctacagatacaagaatggcagttaccaaaatcataggacatgaagttagccaaccaaaccatatcataactgcctacatgaaataaatctctccgtggacatgcttgcgctgataaagcccataacagacggatatgcgtcagttatcacttcactacacatgatcaaaaaccttttataaaataaattacaaagaactgtcagcaaaatatggtttagattccccacataaatagaagtgtgttcttcatttaatttcatatccagaatcgcaagatggtttggattatctgttccaataat

SEQ ID NO: 78725 - DNA, 1076 bp, Oryza sativa
tatagttatgacaattgatatgaagacttgtggttgacctatcttagttcttgcgaggctcatatgttcaaggtattctatattaagatttgtaataaaatacataaaaaaatacacattacttgtgctagtctgctaatttcttacttcctccatcccaaatatagcaacgaaggactagatgtgatatattatagtacaacgaatctggatatatctgtccaaattcgaatatggatatatatatatatatatatatatatatatatatatatgtatgtatgtccaaattcattgtattaggatgagtcacacccagtcataggttgctatattttgaaccgagagtacaaattagtactttctccatcctaaaaattttagtactaattagtactaaatatatcctaattactacttccttcatattcttataagttatatcaaatatgatattatttgatactatgttgctatatttcaggacggatagagtatttgatttattggaaaagccaaaaacaaaattataccaaatggccatagattttatccctttgcaagccaaagcgagctgagtttatccatgtcatgataactttgctgagttggagatgatgtgttctatacggtcttctacggttgcacgtgcatacacacttatttgtcgtattttaggacatacactagagcaaagcatatctttcgaatgttcgtgtgttttatcagatttagcatcaacagttatctacaagattttttttatataaaattacgtcttttacaatattaatttaaagaaaaatacttacagtgcatgcgtaagactaatcgatccaatggggtcatgcgctcatttatattgatattattttattgtacctgttttggtattagagtttacttattccaaatctagccaaatgtggggcctccgttctgataaagtaaatgtaatgcacctgggtgtttcctaacatcctgatcattggtagtataaattttacaatattattttttttttcaaaagaagattcaactccaataataaaattttagggttaatatgttagtat

SEQ ID NO: 78726 - DNA, 5350 bp, Oryza sativa
  unsure (1)..(5350): unsure at all n locations
ccatgtcttcaccgaccggccgcctagtccgccgccgactggtgttttcgcctgcacggttggcctattatgccgccattgttgggcgtctacatcttcaccgaccggccgcctcgtccgccgacgactagtgtttccgcctgcacggctagcttattatgccaccgttgttgggcgtctacgtcttcaccgaccggccgcctcatccgccgccgactggtgtttccgcctgcacggctggcctatcatgtcaccgttgttgggcgtctacgccttcgccgaccggccgcctcgtccgccgccgactggtgtttccacctgcacggctggcctattatgccgccgttgttgggtgtctacgtcttcatcgaccggccgccttatccgccaccgactggtgtcacagcttgcacggctggcctattatgccgccgttgtttggcgtctacgtcttcaccgccggctcaccttcgccaccgtcgactggtgtctccgcctgcacggctggtttattatgtcgcggttgtagggcgtctacatcttctccgaccggccacctcgtatgacgccaactggtgctatcgtcttcacggctggccacgtcgccgccaccgcaattaggcgtcatcaccttcaacgcaagctgtctacatctgctgccgactggtttcttcacttccatggctgcatgattctgctagtgttgattggccttatcgtcttcaccgccggtcgtctcgtctactactgactagtgccgtcgcctctacggctggtttatactgctaccactactgatggacgtcattgttttcattgctggccgccttgtctgacgccgactggcttggtcacctccatggctgcacgttttcgtcatcattctacttcttccatcgccgactggttatgccgccgttgactggtgttttatcttcacaactattcatcttcgcaacgggtttgcttctgttgccgccgactcgtgttcacttcatcacggctatgcaactttgtcaccatggtggagcaacctcatttttattatcttcggcattggcaaactctattgcctctacttcgcaagctttgctacttcgccaaccacgacatctacaggagcctcgacatcttggcatgcgtcaacaagtataatgccatgttattttactacaacaagtggtgttccaatattcaagatttctactcggacatcttctatgcgtatattcactcaagcaatgactactcgacgacaagaagctacagttctcgactctatgttcagttgtttcccaactaaccaaagagtcggggactacacaaatacaaggctcaaaatttgacaattcgacaagctttatgtcaagatgaagcaattaattaatcagccaacgattcaactttgggagtcattagcttcgtcttcgcttcagagcaggtgttctacttcagcaactccgattatttcaccgacaattttggcttctccacgttgctacaatctactccaaatttctcaagtatcaagtttgagatttaatctacatattcgggagtttagagctatcaaccaagcaactcagtttcgatgagttggacaacagcattactttcctccaagtgaagcatctgcaacagctataacaccaagttctattgtcatctttataaatcaaggagcgttgcatcaatcttcgtcatacacatgctcacatcaagggaactactcgagttttgatgtcttctcaacaatttgatggattattgtcactgacatcatcaccagcacctcttcttcatcggccctgacgtcttcgccgttgctaatggatggctacgttttcacctccggcagcttctatcattgacgactagttatttcgccttcatggttgacctactacgcaaatgctgatgagtgtcttcgtcattattattggctgctacaccgctattgactgggtcaccgacatcgtcatcatcatcaacatcctgtcaagcttatttaacatagccaaccctactgctattgaaggacaagctatatgctcaggggcttactagctcaaacacaagtatcataccttcaatttggacttgttccggatacatgcaacatgaattcatgatcatgggtctattttctatgctcaaagactagactatttattattccccataagggttatcaaccgaatacttgcgccagtcgggattcaattattatatatatattggagtatctcataagggataatcactcagatcagaagctattcatatgagttacatttggtctatataacccggaagatttattactcgagagcatgttacatgcgtcatcctttaaagggtgtcgaaggcatattttttggcctaggcctaatatgtctgcagcccatattttcaagtgtggcctgtcacgttcttttagggacttaggcactttttgcttaggccaaagtgtgcgtgatctagtgcccaataccttaaaatccttttataccgcagttactcaactttttaggagttggtacaatgcatcttaaaaggtgtcaaacagtaaagctttatatagctgccccgctgacttttttatatagtcatggcgctgtttgggtttataaagcaattgattggatacaacatcaatgctttttgccacgtaagtgtgcatttttattgaccaatattatggcttaggctgattatatattttggtcattttccagacgattgataaatccttatgagtttatttactcggattttataccacatatgccatatatttccaggtgtggtgaaaccatgtgtcttttagggactcaagcacatctgttaaagcagtgtgcgcatggtgtatgcccaatactttggaaatttatttattcacaacatacaagcttctttatagctgttttgctatgtgtattcaatgatgtagtcagctttaggttgcacgcatcatattttacaaagcagtcggtatatcactcggatcatgttattcagggattcacgccacatatgctatatattaatattaagtcacttggttgactacaattatcaaaaccactcagttggtgcatctattaggtacatctattcgatgcacctgactttatttttcagccctccacaatcttcatatttggtaaaagtattcgggagatcatggcgaagatgattgaagcactcagctttggagtaatctagttcgagagaagattatctttccgactgtgaaggtctcaggggctactgtggagattatgggtaccccatacccacacggcatggttatccgactagttataggggatagcttatatctatggaatatgtaaccgatcatgacttgggtattacgtttccttttatattatggagcggcctaaagtcctgatttgataatattgtaaaatagatttaggaaaccgataccgtattagttaaggtttctatcttgtaatcctgccccccatcctatataaggtggcaggaggccctctagggagcatgagacaaactgattgtcagatcaatatacacccggcggattcaaatccctaaacaggagtagggtattacctctcattgagagggcctgaacctgtctaaatcctttgtctccgcatccatccacttttaggtctcgtgcgctacccccttttcatattgccgaaaatttgtttcgacacaatgtctcagcaaggcgaaccaatgtcgacgacaactagtgggtcctcaagggcacgtactcctaggacagggaacaaaattcctaaggaacggttccgcataacagcggtggacgccgtagggttgctgacatctccaaggaaaatattgagccgatttaggtctatctgcggggtcatagggaggcagaaattcagtattctgcaagacgacttcaagctcgtgccggccgcagagaagaacattgcttggctaacgttcaaggagagctttgattatcctacggagcataaggaccgtctcaggcgggctgctttcaaggttatgggcactgcttggaagaacttcaagactaagctagtcgacgagttcgtctacaacccggcaaatccaaatccaagagagaaatttccttggatcacggaacaggtctgggaggaattccatgcaaagaagtcgacccccgagtccagagctagaagcgaggcatatcgcttgctccagaccaggaaccagcatccgcaccggcttggtaccgccggatatgccggtaaggaagaggaatggtagcgtgaggatgaagaagcggaggaattgtgcacaccgctcgtgtttggcgatatcccacaccctcgggctaggaactgggccagggctaggtaccagaaaaatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcacaagaggcctgctctcaaagacgcaaagacgacctcctcacgaaagcgttgggcaacaaggaacaccgtggacggacacggggcgttgggtcttctgttccctggaagtatggatttccagactacgtgtggcagtacaagaagcggacttccaacaaggcggagaaagatgcacgccttgaagccaagatccgggagtcgatacgagctgagctgacatctgaattcgatgaaaagctcgagtcgatgagggccaagattaggcaagagatccgagaagagcaacagatcccccaggccgccgctgctgctgcgcacaaagacttaggaagtcccaccgaaaaacgtagcagttgcgcatcaactgagttggcggaaaatccaacatcggtcgacagcgccgtggaccacataacggtaaccgtgaacttactcaatacatgaaagacgtaacgaatccatatgatatataatattctaaaaaaattgattaatctatcgcaggaaccaacgagctgcaccctcacagttagggtgatgccgaccttcactgttccagcagccgagggacttgcgtaaaagccgacccagagacaagagtgcatggagcgcaactcagggccgactgtgcaaaagttcaagtcgactcagtgaagcccgaatacgagctgttccttctgaagtatccaccgaacgacgaggtcctctcactaggaaatgcccgtggtaccttcatccaatggcccaaannnnnnnnnnnnnnnnnnnnnnnnnnnnnnnnnnnnnnnnnnnnctcctg

SEQ ID NO: 78727 - DNA, 771 bp, Oryza sativa
  unsure (1)..(771): unsure at all n locations
acatgttccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctagcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgttcggctatctaatccgctaggtctatacccatacgagaagtgcggttgtacgggggtcgtttcatgtttaacttcatggctcggtccttaattgaccggggacggtactagcctttcccagataccacccaaatcctccgtccgccccagtcgaaaacaattgtttaattttatttctcctttcacaaatcatgtcatcaacatcatgacaatgtggcgctcatgtctccacatgccgcatttgataaatatgagtannnnnnnnnnnnnnnnnnnnnnnnnnnnnnnnnnnnnnnnnnnnnggatatcagnttcaaggnttaactct

SEQ ID NO: 78728 - DNA, 1661 bp, Oryza sativa
cacgatagcggcattagtagacggcataacgctattgaagattcaaacttgacaatactgagacaatttgttaacaagatttagccaaaatctacaacccgaactgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataattagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccggtgccagcgactcgtcgggcatagatctccggaggcaagccatggcgtcgaacatgacacaaaggctacagcagcgcttgccaacgtcgcagagcaacaacggccggcggctcacagacgagaca

SEQ ID NO: 78729 - DNA, 1989 bp, Oryza sativa
  unsure (1)..(1989): unsure at all n locations
ctaccggatgtcctcactccggctgtctaccttgagcagcatcagaagaaagccaacctaagactagccgaacgtcgggagcgcaaggatattgagccacaatccaagccaatcggcagcttgtgcacgaagagaagtccaagcttgatcagctatctgagggcccgatcaaatccaacattgatcggctcgaggctcacaagattgagctcttggcacaacttgaagaatgcaacaccgagctggatatggaacacaaaaagctggccgatcttccaaaatctgtcgaagaacagaaggcaagactaaaatcggctatcaagaatgttgctgatctcaccaagtctttgaaagtcattcctagaaccgacactcaagatgcccaagccattgaagaatttatgcatacaggtacatagttgttccatgcacgtacaaacgcatgcgatgaccagtaattgctggataagtttgagcattgatatagctcgcgtgtgcccgtagccatacgtcttcattaaaaaatactcgagctgaccaagtgaaaattgctgcttgtatgtactgctccgtgtttttgattttgcatgttgagtcagccgagtccgagattgatccaatcagctgtcttatgcaactagccagccgtggttgtctctcgtgacgatcagatcagctgtcttatgcaactagccagccgtggttgtctctcgtgacgatcaggggactcggagggcacagccaacaatcagtgcaggcaagacatagattgatttaattagtagttaaatctgaggccaatctaataattggtagattggaacggcgaacctggtcattgttgtaactacaaagtgtagctcccgaagcggagattttttgcggagatacaggagatatcggtggcgatgacggttgaagcttccaacttgatgacatagatctttgatcgccgttctctcgactgggtaaaacccaagtcggagaaggagagattgttgaagtcgtcggcagcgaggaagtgaaaactcacgaatcgaagacgaagccgacgaatcatgaaattgattccatcacactcgttgacaggaaactcggcgaacccctacctggcacgccaactgtcgaaacaaattttcggcaatatgaaaagggggtagcgcacgagacctaaaagtggatggatgcggagacaaaggatttagacaggttcatgccctctcaatgagaggtaataccctactcctgtttagggatttgaatccgccgggtgtatattgatctgacgatcagtttatctcatgccccctagagggccttctgcccaccttatatagtatggggggcaggattacaagatagaaaccttaatcaatacggtatcggtttcctaaatctattttacaatattatcaaatcgggactttaggccgctccataatataaaaggaaacgtaatacccaagtcatgatcggttacatattccatagatataagctatcccctatgactagtcggataactatgccgtgtgggtatggggtacccataatctccacacattgtctacttttttccaaaaaaacaaaaaaaaacacaattgagtgctacaatctattacaatctattaaccacatttcacaataatttcattaatgcaccacatttcatcccaacataaataaaccacatttcaacccaacataaataaaccacatttcatcccaacatgaataaaccacatttcatcccaacataaataaatctcatttcatcccaacatgaataaaccacatttcatcccaacatgaataaaccacatttcatcccaacatgaaccacattgcatataaataaagttaaatgatccacatttcatcgatcactacaatcatctatcaccaaattcataaatgcaccatatttcatcacaacatcgacatnnnnnnnnnnnnnnnnnnnnnnnnnnnnnnnnnnnnnaacatgat

SEQ ID NO: 78730 - DNA, 1541 bp, Oryza sativa
atagttggaaagcctatggggattcttggtgaaaatctatgcaagcttgtgtggtacgtcgcaggtggctcaacgtcgcctgagggggccacccggggcgcgtcctaccgagcacaccggtgcacgagtggttctcgcggagtcgctcgacggcgaggataaccagctgatggtgaacagctaccactgcaccaccagggagggcgtgcaggcggcggctggcggagcggttcgtgccgatggcgttcgatctgcgctccggatgcgattctgccgccgcggcgccggcctcccgccacctccgcgcccatcgccgcggcggtcgagcggctgctgccgtagtcctcagcggtgcgctaggccgatgcgtggccaggagtgagttcgttgaagccaaccggctaaagctccactggcatgtgggttctatgtagttttaattttttttaatttttgtttttagtgccacatcagttaaaaccaggagcttaaccacttaaccactcggatgctatactaagatgaaataattggcctcactctcctttttttttttactatggtttagctaaagggccatgcattgcaatggatactataagagataaaagaaagtaaaattacaagtttatagtattggtatatttttagagggttgtataggtagttaattagtcatataatgtcatatccaaaataaaattattcacgtgtgagaattttatgctgttagcttataatgtcagagacagatccgaacatcatcactaacattatttaagatagtatagctaccgagagtctgtgagtcttgactagcttgtgagtaatttttagagaaagtaaatcaatttactaggctgtgaaaaaaaaacgagcaagttaacagaaagtacacgcacgaggcgtcgacatacacggacgtatatacgtagacgtcgcggtcgtatggccgtacgtctctctgtattgcttctagaagcatcctcaagattggtcagctgctcgtctcaaccgctgctaaacgccgccaagctcttgactttcgaatagccgtactccctccgtccttaaaaaaagcaaaccctggttttcgtgtccaactttgactgtccgtcttatatgaaatttttttataattcgtattttcattgttgttagatgataaaacatgattaatattttatgcatgacttgtctttttaatttttttcataattttttcaaataagacggacggtcaaacgttggatacgaaaaccagggtttgtcttttttttgggacggaaggagtatagtatatgatcattggtcttttctatcaatcgattcagattttttttattgtacttaattattgtttttgtgattgtacgacgtcgtcctagccattattttaaacagttttttaatcctactgcctttacttaaaacaaactttcattcgtggctataaatctaaataagcacttgtccaaattctctatccatattcacgtaagtacaagaatcgatctaagtattgaagagaagagcggaaa

SEQ ID NO: 78731 - DNA, 14294 bp, Oryza sativa
aaaatcccttatatttagggacggagggagtatgtatagtagatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgagaaggtggctcgatgatgaacctgaggagaaggacacctcctgcatgacgaccggcgatgaaggcggtgagttcggccggtcggtggtgaagccgaaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtggagtgcgtgcgcccagtatcagagcttggcgccaccacctcagatctatgcttcgctgcctcgctgcactggaacaacagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctaggaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaataacatgtaagtacataatatacatcgatacttaggaagtgtaatatttctgcatgtcatagtcagacaatcatatcttaacaatccattttgaccaaaagtttaaccaccaaactgtccgcacagaagaagcatatgttagacaacaaagtaaaccatactggggttaaaaaatatagagtaaatttcataaaactacatatattttgcacattctatcacaaaactacagatttaagaacttatttcacaaaactacagatttagtgtctacgtttatcacaaaactacaggtactttgcacaatacatcacaaaactacagatttaagaacttgtttcacaaaactacagatttaatatcttcatttatcacaaaactacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatctcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaggaggcatcagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaaccttccctccaccagcgggcggcgctcagccagacattggtgagccgctcgagttagaggcgggcctcttcgtcacgggcgacagcgccggtgcgaacatctctagccctagccatctttgacgaccccctccaccatcggcctcgctgtggaacgtcttttctagatctggacaccatgtctcctcccgatctgctcttcctcgacctcgcggcttcggaccggtgccatcgtcgtcacctccaccgccgtcaacctgggggaccacgccggcactccatctccgactcctcgccggcgatcgatctcctgacagaaggggatgtgcaggccggctgcaagagcggaagagaggcggctagggtttgggagggtggggtgaggggtgggcgccggccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatttgacatagtcacaaaatttccagggttatctggctccaattgaaccagtttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcagagttgtgaatgtcactgaatctggctgcatcccacaacgcaacattgcatccacaagttcaagtgccctctctccatgcccattctttgcgaaagcacctatcatcacattccatgacacaacatccttccgttcaatctcgaagaacacatgttctgcattgtcgacacatccaacacgtgaatacatgttcatcaacgcattccacagaattgcgtttgaaccactatcaccatggtttctcaccatgtgcccatggacctgtcttccagactccaaatcacaagcccccagcacagcaaccgcggtacgggcattccctcgaacacctcttgcgcgcatctcccggaagcaatcccacgcctcgccattcatcccggcaccagcgaaccccccaatcatcgcgttccaggacaccacgtcctcgccgtccatacgatcaaagatcctcttggccgcgctcaccctcccacacatcgcatacagcgcgacgagcgccggccggccgaggcgtagaaggccagcagtggcgcggtctttaccccgtaggcgtgcgcggcgcgaacggggagggaggcggatgcgcggcggcagcaggagacgacgcaggagaggagctcggcgtcggggcgggcgaccgcggcggcggagaagagggagagggcctcccgggggcggccgtggcgggagagcgcggagaggatggcggtgtaggatccggtggaagggtgggggatgagggagaaggcgcggagcgcgcaggggaggaggccggagagggagtaggcggagacgagggcgttggaggccgggagcgaggaggggaggacccccagcttgagagcggcggcgtgtagggtggagacggccggggcggcggcgccgggggtggtggcggcggagacgagtaggcgagggagggagagagggtcgacgggaagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtcctatatatatatatatatatatatatattataacacggccgggaggaggaaatgaaaaaggagccatgatgagaggaatagacagattacttacatctatctaccctaaagttcaacaaatactttcactcattctttcattcatcactcaatggttcagattatccctgtgaaatccaatgctccagattcaccctccccacaaacgagcgctcccttcccaccccaaccgcgcccaaacctcaccatcacaccgccccgccacgattgacgtccccgctgaccccagcttctcgtagaacgctaaaccctaacctcccctctctccccaccgctcgaggtcgcgccctcatcgctgctgctcgtcgcccggagcgagcgatgcggtcaccggagatgagcacaaccgctggggcaccacgctttctcgatcggaggccagcaggatggaggaggttgcgggagagacgccgacgccgtcacacgctgttgatccgattccttgctactagatcaggatgcagtcccttttttttcgtaatctgcatgtaatcctagggttggaggaaaggcactgtggagaggagaaaagtgagacggggtgccggcgtgccgatgcagacgagtggccaagaataggtaaatagctctgttctattgctagctagcttttttttttacttactatgacaaattgatcgatctccctgttggatttttattaattctgattgaggaatgacgttttgttttgaacttttgtgccgtttgatttgcaagattactttgctagatttagcaattgtataatattcaaaacagaggctttcactatcactaattagagagcagaaacagaaagaatatagagtcagagttggtgtaccctgcaagtctgacgattggattgtacatgaactgcaatttgcatttcatgctactatggcattatgctcagtgaatcttgctgacttcctttattcaggcacaagtaatttgtgtcggatgatcaattctaagcagtgtctatgtgaataccgtttgaacaaggagctgtgtgggtttttaggattcaattctaatgaagccaaagaaaatatcttgaagatatttttcaggttattgttgtcttttgtgtccttcagagatggggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcaacaaataaatttcatgatttttgttcccaccatcatagtaaatttcatgtgatatagaggaatagcaagctaacacacgttcttgagattctttaaacaatcaattatttacttgttggtaaatcatgcatctacagttagatttgtggtttccgtgattacattacatcacctgaagtaatcaacagatttgagcattttgtgtatgcaagtagttgaagaatttcaccatgttctgcatgatatgaagtatgaacattatgctagagttactgtagatcctggcatcacagtcccttaggtttggtaaattcaaatttaccatgttactaagacatgtacgataatttacaggaatatgaaattatttttagaccaaatatattacaacaatatatataccgttgtttggttttgagacatttgaacttattttgctaaaatatgtatcttttagcatatgattgtttaattcacattactaaatatcgccgtagcgttagtacgggcatattaccagttccaacaattggccatgttttttcaatggaattttcgttaaccaaatgaaggcatcaaattcctgtgtctggggtagacgtactaggacaacacgaacaggaaaatacgcacagaacatacttcctccatctcaaaatagataaatcaactcttgtacactagaattcattcatgtatatgtatatgtaaaattattttgcttgaccctagtatgaaggtgaaatatatttaattaaatccgatccagagcacaaaatgagaagtgtttttattcataaatttctatttaaaacacacgagagtcacataccctatcgagaaggctgtaccgtctggacctatgattaaccatctggagcgttgtgctgctgttcttattacaaccacgccgaacctcgacgccggtgaacaccgcgaatttctcgtcgaaatcaaagttggacctccaccctttgtacatgaatctgacaatgcagaacctgccggcgccgagagggacgaggtgcggcgtcaccggtgagccgctgggcgacacggggctcaccttccacacattgcgccgcggcggcgaggtcggacgcgcacagctcgttgccgtcggaggagagcgcgaaccagagcttgtgctcgggcgcatactcggcgcggcctctgaacggaagcaaccagtcgccgagcttggtccatgtggcggtggacgtgtcaaaggagtaagtccccgcggcggcggcgacggtgctctgcactgtcatccagatgcatgagccgccgacggccgtgtaggcggtgaggaagtcatcatcatcttggaaaaagttgcggatgctatcaagggcatcatcggcggtgaaggcgaagggcggcgaagggaggaggcgccagtgccagtgcggcgtggcgaaggggtggtttgggtggcgatcgtggacgagaaccttgaagcaagaggagggggattgggaggaggccgggtacctttccatgacgtagatgttgcctccgatggtgagcgacaccgggaaggccttgggtgtgttcatcgggggaaggatggtgacggcgcgcgaggcggcgccgtacagcaccccgctgccgctgtagtcgacggcgaccacgtcgttcttttcgccgcctctgccgctgccgctgccgctgccgagaggcatgaaatccacggaggagggccaactcggaagcccgtatgatgggcaagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgccgactgttcattctcgccgccgccgccgccaccgcc

SEQ ID NO: 78732 - DNA, 21258 bp, Oryza sativa
ggtttcatatatatggagagatctttgtgtcagcaattgaagctcacgcgctttactttgttataatggctgtgtttttgttcgtttatggttgattagattcttgagtgatttaatgtcctcactgtctgtgtgagggatctcctttatgattggttcgcttagtttttgttatagggtaaaaggctgcaaaaaggtaagggaagatccctccttttgttttcttttgcaggggagaagagcgtttaagaaaagaggttataaaggggggattttttcttaaagggggctatcgtttttcaggcagattaaacatttgctttctgatgatcttgtttaatcatcattatctaaaaaagattttgtttattgatggatgctgaaccgccgtgttgtttgcccacgaatgtgtaattgaatcctgctatgctagtgccaaaatacattgtttgagctgatcttgtgcattactgtatatatattgggattttcaacgcgtagttagctttcagcttcgtgatgcagaaaccaaggtttctctatttgtacagcaacaatttataggagctatttttcttcctcaatgactgtttcattgctacaagggagtgttgatgtctaaagttgttctaaaaattatcccttgtttaacttttgttgagttgacatgagtttgatcttttgttgtagaaattttatcttatcggaagggacaagacaaggactctatggagggtgctgaagattgacaggatggagcctactgagctggaaatcgaggaagatcatacaagttacacagagaatgaatgccaagaactgctgtggcgaattcatgaggggaatagattgactggtggactgaaatttgtcacgaaatgctatggaatagttggtaatgaaacaggaactgagataccattgtttattgatcaaacttcctggtagttcaaaacttcaaattataacatttactccatctttgctttactcaggttttataaaatttcttggcccttattacatggttctaattaccagaagaaggaaagttggtacaatctgcagtcatgaaatatattctgtcggcaagagcgaattgattgcaattccaagtcctattgtgtggcccaacgtggcttattctagggatgagaacaggtctttcattttttctatgtgtaaatattgtgctttgcctgttgtaaatccatcgctggttcctagcaatatgaaagatgccagcttgctttgttttgtatctggacatatcatagtgcttgtattcatttatccttttgtagttttccttctcgtaatatttcagttcatttgtttgctacattgtgatgagacaatgtgcactatcggcgccaaagtgtccttgatttcacgtttttcttttctatgacaattttcttttgtgtgcgtgtgtctatctgcatatctttcagataagtttttgttcatatattcacgcttgtagttgaacctgggcaattccagttgttctgtgtgtgcaattaatatcactttgcctttaagtatacaattttcttgttgataataatatgcaccctactcatacggtcggtgcatacgtcaattcttgcagttctgagcattgtgtgtggtgttcataaggtcagaggtatatagaattgtttcgaatttctttgatccactaatattcttcttagtatgattctaaatatactatatctagagtttttctcatttctattgtctgcggatatttatatttttacctttcactttttgtagatataaacggctcctttgctcggtcgatctctcgaaagacttcttcttcagctactcttacaatatcatgcgcagccttcagaagaacataactgacaagaatactgggcaagttgtttatgagacaatgtttgtttggaacgagtttctgtctcgagctatccggaaccatctcaagaatacaacgtggactgttgccttaatccatggattttttaaacaggtattctgctgcaacattctaagtctccgatactgcatttgatgcgatccattcttttcatctctaattgatgagcttatgcatatccagcactgtctattcatcaacgaagaccacaagtagggatactgctaactcaatgccatcccactaacttttgtgttttactccacaatgtgtgacctgacatgtagtgaaagctcgaaataaagggtttgcaaaggcatggctttgtataacctgctgacatttatcagtttgagcttcttgaggctttcccgagtcgaaaattttgctcgtaagtctcagcagactgttaatgcttttcctaagttgttaaattcccctttgtgcagtcttagcaaaccaatgcttagatgtgaaattacagcgctatttatacttatctgtaatgtttattaaacggtaagcgttgtgccgttgaggttctttggtcctggttcaagacctttgaattaggacatgtatgattggcagttctaaatgtttctgataaataggaacttcttattgctactctatttgcattttcattatgtaagtactgtgtttcatactttcatctgtcaagtattatacacagagccatgctaaacatattttgttgcacagtcaaagctctcagtagctgggaaggaattctggttgacacttatagcaaggcgctcacgtcattttgctggaaccaggtttgcattacaatcctttgggtttagcaccctaatttatgttgaaaagaatggagcctaaacaatgtaatctatgtcgcctgatcttacaatgttaattttgcatgtcattttcaaatacagattcttgaaaagaggtgttaatgaaaagggtagggttgccaatgatgttgagactgaacaaattgtttttgaggacacaccagatgaaataccacatcagatatcatctgttgtacaacatagaggatccatacctcttatatggtttcaggaaacttcaagactcaacattaggccagatatcatacgtaagttctagactgtcagtctgtcatgcatttgccatctgtagactgtcttctctaatactccaatcaccttgctacctgcagtgaaaccggatgtagactacaagacaactcgccttcattttgagaaccttgcacttagatatgggaacccaataattatcttaaacttgatcaaggtgagaataagtgtggaatacaaatttggtttattctctgatggatttttttttgatagtttacatgtgaatcactactgacttatatatctatcaatttaattgcaatattttttttctgaaaaggaaatttaattgccatattgacgaccttatgttctttgttatcaatctggagttctcatatccatttcgggtcccttgtatttttttcagactcgtgagaagaaacctcgtgaatctttgctccgtgcagaattcgcaaaggctatacattatattaacaaggggctgccagatgacaaacgtctaaagtttttacacatggatctgagtaagctttctagaaggtagtgtatcgtactccaaggaaatcttatatccaagccattaggattcaagcttgtaattacttgtaaattgccttcgatgttaagtactaagtgctatttacaggaaaggtaccaatgtgctttcgctgttgaacaaggtagcatcagatgtgttggatctaactgacttcctccactgtgagataactacatcaaagtatgaggatgcatcaaggtaacatttggcctacttaagagttataagagttatctaaaattttgcctggccaccagaaacaaaatgatgttgtttgtccaaaaatgttccttcatgatgttaccctgtaacatattcattctttggattagtaaaagttgtgccttgagcacagtagaccacccaaataaggcagcttttgaaccaattggaagtaggtgctctccaatttggtcttatcttatgagctcacataacagtactaatgcattttttttctttttaaatgcatcagtggacaagaagctgttgccaactcaggtgacttcgaaaacatccaggttcaaaatttatgtgcaattaagctagtacctcttttactgcaaaagggtgtcctcaggactaactgcatagactgcttggaccgcacaaatgttgcacagtttgcgtatggcttagctgctttagggcgtcaacttcatgtgctccagctcaataaaacccctacaattgaattgcatgctcctttggccgatgatcttatggatttctatgaacggatgggtgatacgctagctattcaatatggtggctctgctgctcacaacaaggtacttgcttaattctatttactgactcgttggagcaaaatttgtgcttcctctactgtgtaatacaattctcaaacaaatgcatctttcattaaacccttcttcatattcttattcaattgtcctatttttgtttctttcaaagcgatttttcttcttaattggcggtgaagtcaatagtcataatattatttttcttctaaagatttttttttctttacaccccaaaagtccaaacttctcttttgagttattagtctgactgtctgagtactccatactgctgatatatgttacagatcttctgtgagcaaagaggccaatggaaggcagcaacacaatctcaggagttcctccggacccttcagcgctactacagtaatgcctacactgatcctgagaagcaggattctataaatgtgtaagcttctcatgtctgtattactctatacatgtacaataggcagaattctcggagaaaattatatgacagaaccatgggagctgttggtatcgctctagtatattaccacaaacgggtctgtctgactttagaattgcaggttcttgggtcatttccaaccacaagaaggaaaacctgcgctttggaaattggactcagatcagcattacaacattggcaggcaaggaactttaactgaagaaactgggaggtactgaagtcaatttccattaagaaatgttgttcagaaagctgtaatatgcagtacaacttcagcttatatttagacagtttaccagacaatcatatggaatatgaaagattccaagtaaatctgacactgttcacttctcaatccatgttataaattcaaaaggtgtcaccattttattttgctctagctgcctgtttgctcgtttggattgaacaatactaaaactttgtcttggaactgcaaattaataagggtgtgagagcctttcattcacacagagaacttatatttggatgttccacctagtaatgataatcaatgatctagaatataatatgttgattagcttaaggtagaacctatcttggtattaattgctgatataatgatgtgttgggttacccaagctatctagaatctggtcaattagtggttctgccaattgtactttgtttttgttatattattttattgaattttggaatttccatgtctagtttagtaacatccatatttcatatcagcagatcattcataaagaggtcgttatcggacggtaatattttatgtgacaacactggtggacctgtatctgactgtaatgttggaaaaaacaacacaagctcagaattgctcccaatgcaaccactggaggatattagagaaccttctgattctgcaccagagatctctatagaacctaacccgtgctccaggtgctctatccttgtttgaaaacgaattggtggttgttggagaacttcagattgtccatactatgaactaactgcatttttctcatgttcagtacaaactatagcacattgtctgggagacactcaatttcagaagagcggcagaattatttgagaagattgggttatcctgaattgcactcttcaaactttcttgatcttgatctgttatcatcttcaggaaattcttgtgaggaggaaatttatgagaggtaacacatctgtgatttatttgtatatccaactgcacaaattctatccccttgatctggcaactaaaggagtgaattctaggctgagatgttatattactcacactatagtattttatttcatttttttggagggaactgctgtaatggttaacggtaataagatgtttcaaactcatttacaggtcatcactcatcaattcacccatggatgttgtcagtattgaatcaactacatcatacagtgaacagggacacaatgatgaggtcagtcttttcccctcttttctttttaaaattactagaaaaaatgcccgtgcattgcaacgggtaaaggctattttaatattaatattattattattattattattatatcgagttaagatgaaattcactgtgttaaattcgcttggatatatattttgttagaaaatcatgagctgtaattaggtgtccgatcgtctcaagttagtatgtgagtttttaaagagatttcttatacgatttcttctgtatttctaaaagcgaacgaacttacaaactgactcaaaactgtctcaaatacggatttgtatttccaaaagcgaacggacttgaaaaccgactcatacgcgaatgaggtaccaaaataccggcaaaaacatcttcaatttttataatagtagagatatatgccactcaagcttgctgtacatttgttttgttccaacccagattttacatttttcaaatgtaatctatcgacgcgttctttctgccatcaggcatttactctgtacatttattgatattgaaacttttcctccttagcagggaagagatgacacagatctgtcacgctcaagcagccaaatgtcagacatccgtgactactctgaccgcttcacgcattgggtggatggcggaggcatgctttgctactagagctataaaattgtcttggtgacatctcagcaaaaggattcaacagcagaagctatcgcagctacattaaaggaaacactcgaagtcaagctacatctgctgcaaactgcaacggtctcgtgatcgaagagatcatcacaacaaatggaagaaacatcaacttggtttgcccagagaaagtgctcaaagatgacaatccattggggaatatgaaaccattctgactcggttcggttgaggtacacgattgaatttctatggtgaagaagaattgaccatactgaagacaataaataggagaaacatatatcacattctttgcaagggttagcttagttagaatctttggcaatatgttataggaaaaggataaaacagaaaaaagaacttctcaaacaaaaatgaaaaaaaaatggaaatgctaatccctgttgtaaatatgttatagtattatacatatttaccaatttttactttacttgctctctgtatggaacttgccttttcagtcttcactgtacaaaatacactaatcgttggcaacacggtaatgattgcgagacaatctaacaggccacacggtacaggaggaaatgagttgtcaagccaatgtttcagtcagcctggttgtgtgtttttttttttcctttccagagatgtatgaaattgcacctgatgcatgaactaattttcttctggggtcctgctgattcatgttaccagtattgtcttgcatgaaccctgaactccatgatgaatgggagtgctgttgcaacatgatgggaaattactatattaacgaatcaagatacaggtttgtgcaactgctgcaatactttggttgtatcttttgatttttaggaaaatcgtttggtcgctagggcccctttaatttgaaagagaaacataatttaaacttttttatccattgagcgacagcctttccactcagcatcgtcggatcaccaaggccgactttcgtctttgctcgacagatgagtcttgcagtcaagctcctttctgcctttgtacttgaggaccaatgtccattagcccaaggaaacctttgcacgccttgagtttatatgattttgaaccaatagaaatacaccccccccccccaaaaaaaattgctctttcctaggatttttcaggttttgaaatgcatggtaaatctgttttacacgtacatcagtagagtagagcccttagaactaagtttcagtgaggcagcacgtctgtttaggtggagattagaagggataaaatgcattcacgtcttgggaaattgtttttgtttccgcacaacatttctcaaactgtacaagtaccagatttgaataacaaactgagcgtatagaaccatgccattgcaccgaggaaaagattgatataaacgctacagaataaacttaggacaaaagtagaaagcttaacatataccacacatcttgccgagctcaccctcacagcattgttgttcgaaatagggacggacaaacaacacaggttcagctagaaattcctaaaaacagttgagttcatggtgtagctatagatgatcacattggattttgggtgttcattcatgcctcgggaaatatttaacttaagctgcggaagacatctcaaagtgattgcctagcctaatcccagccttgagcagctggttgagctgccgggtcccatccagtaggcgcaaccggtggaacgacggcggcttcagtggctacgggtgctcctgcttgatcccatccttcggcagcagcaactggagctgccacagaaagggagaatgatcagttccaagttagtacaagcgcttaaggcatgtaaattttacagcctatgcaggaaaacgaagagacaattgctaacagtatgagcagcaatcagcacaacagtttttttcaagaatattccaatgatatgaaatttttagcatcacaagaacaaaattcagaggtccacaacagttatatacctggttaaaaatataaatatattagaaggggataaaccacaaacctggagctgcgccccaatcaccaacagtagcagctgggggagcagccacatcagaggtccactggtcagcagaccattgttcaggtgcggtgtaatcagtgatggcagcaaagtcttgtgctggagcttcctcctcctgctccttggcctcctcagggtctctgtagaaaaacagatcaacctgcaaaagacatactcagtgtataagcatacaaaggatatgaaattatcttcatgaatgcacttccaatgtcaacgtgttcttgaagtaataacaccgcataccataacatcccacttgtggccagggaggatagtacccctcatctgcagaaccatcctagccaagagccagaacaggcacccaatgctgttcctccccttgttgttggccgggatgccgatatcgacataccgcattggggaatcggtgtcacagaaggcaatggtcgggatgtttcccagagcagactccttgattggctgcagacataattcaggataacacgatcagtaaacaatactgtacccaattcaccaacgcactaccgtgacatggtgatcattttcacctggtgatcggtccttgggtcagtgaggatgagcagacggggctcgctgaaggaggtctggagctgattggtaaatgtaccaggcgtatgccttccagcaatggcgtgcgcgccagtgtactgcgcgaacttgaggacggcgcgctggccgtaggggcgggccgactggacaatgatgtcctgggggttctcaatggcaacaatcaccctcgccgcgagctgcagcttctcccatgtcttgccgaggttgatgatgtagatacctatgaattgcagcaacgatgttcacgtattcatattcaagataccctcccaaaagaacagcagcataccttgcaacaggttgcaatgcaactatgccacacacgatatgacacgaaatcagatcaagttgagcaccatgccgtaataattctagctcacaacaagttggatacttagctaaagctaggatactaacaaagcatgaacaaaggcgagcactatgatacaagtgcacaatccacaccaatccaacctaggaaatctagtggcaagaacatggtaaacctatcctacgtaggaaatctcatggcaagaacattgtaatggctagctgtgagcatcgacgaacaagcagagccgggtgagatgcctgtaggtgggggtgggtgcatgcgtaccatcggagcggcgcttgtagacgtagcgctccatctggaagtcgcagttcttggtgccgaggtggacgtcggcggcgagcatcatctgcacgtcctgctccgcctgcgacagcgcccgcgctgcgcctcctgccactgccgccatggtcgcgtgtgtgggggtggcgcgcgcgaagggaagacgggggaggaggagaggcgagagctcggagagagtggcggcgcgaaggagaagggaggaggaaggagaggggcttttatgtcattatatctccgcccccctgaaaaccctaattggcgtttaggtgaggcagcgactctccttgggcagggtgtgcatgggccggcccaagttttttttctttttgcagaaagaccccctgttcatgtgaatttactcctttttcctcaatatgaatttgggcggtttcttttgccagcgacaacaaaaatcgatatccaagctgtttcgctcgatgaaatgatatacatatttgttttttctaagagatgcttgtggtaataagagtttattatcctgtttttggaagtcaaaaccactccccacttttgcggaaaactaaacgaaaactggtaaaaaaatgcaactactacaagccaactccgtacgaaaaaataggctaaaaccaatccgtttttacaccgaccacatacgggttttttttttcacaatgagtcccctacgcaacagaacactagcaatcgcaaaaatctgacaacgaggaatggttgtagtctcgtggtaaatggaagatcgagttgtgcccaaagccgaacacggccgctatgcaaaattttgctctgacctgataaaatatcttgccaacaatgtaatatcatggcagaatgcttacataaacataactaggcagatatgacgctcggatcgtcactagaattgacttgtttagctaaaacaggcatatcaaaacgcagtacatcacagcagagaaaacagatgcgcccagagtatcttcacgcgctcagaagttctgtaatgcaaaatctcagttggtctggttgttgactcagctaaggacagggaatatgcgagttacatgctcgaacggaacagtttcagctgtgttcttcttgagctcagggtgattgaactcgttgcgtggaaggacaatcagctgagatcgtgcacccttctcgatcacccaaccggagtttgcaatatggtgctccaggaacttgtccaatgcaagaccctcaatgttgatggcctgaaaagaaaagtaatgagtttcagccaacaagggacaatccatgtgcgaggcaaccaataacacctaaatgatagcaaaatttggatgatgatggtgacacttctggcgtaacaaatatttgtagcattagtaatatgaaacttaatattaccacgaatccttggtcatctaaagtttaaacaaaaaggattgaatgaaaactcatgctccctcgaggactcgtgtaataattaatttaaaatgacatcatttacctccgcaagaacaggcctaggaactttctggtatgtcaaggagagcacatgtatcgcataggattggattgcctgctcaaaacctgtaaagggattagttaagtaagccttcactagtgtttcaaaaaaaaaaaacacttcaccattaggtcaaacggaaagaatccatatcaattgccataagaaagtgtccaatatagcaaacattcataaaaataatccataggtagttcatgttagattaaaaagaattcctcagtagtcagtagaaagaatcaaacagaagttcgctcaagactgcttgatatggtaaccaatctctgggcatctaggatactaatacatactcatttacatgacaacgcgggcatgaacatgccacataaacacatggtaaacgtctaaacgatgataagtcacaaagttactttctaaaatatgagttgtgcgagaaaatgctgaaataaagtaatcagaaaaggtacagtttatcagtcacacccaattggccaaatcaatcaggaaaatggagggggaaataccagtacaatcatctagcttgcaacaattaccacttcacaacgtgtgaacaaaacatggctccaattccacaagacatacctggaacaacatccaatatgttgcggttcttcgacgcctcatcccaaaattgacggaacctagcagtctacaaagacgttgattgcggttaacagtggttatcccactaactgttcaacatatatacaatagtcaagccagatacatacctccaggtagtgagagagaactatcaacgtcttgaactgttcctccatttgctgaaataagaagagcatagaggacagtggtcaaaactcacatgataagagaacagagcccaacaaataaaagaactagatgtacagctataataaacacaatgtataaagtattcgggtctgttatatctacatatctaagactaaatgggcaaagattgttcccttgcacaaatatttaaattccaaatccatggtgaatatgattttattccatcaactacatgttattatatatatacattgcacatctctaggcatacatatatgataatgttatttcagggtcaatttggcaatcaccaccaaaacaaatagatcactgggtatcgatactatttaagatgcatccgcaatagcattttattagatagatagtttttgatgcgacatatacatgaggcagggaattgtttccgtaccacatgctctggaattaagaataagcataggctgaagtccgggcctggcattgccatgagagcctgtcaatagaacaacataaagagagcaaaacagttggaagtgatcaacaaaaaaccattgtttatttattaatgttaacattagttcttttctgaccttaatcaatatgcgagatacaatctgcacactcaacctttctggttcgaactgcaaagggaaacgcatcattaaataaacatataactcgagccaaaatatgggtaaaagcggtttgtacagagatggactgtcacctggtacagacgaagaagactaagatttgcatccaagttatatgtttggttggaaacctatatgaaaagaaaaggtcggtaaatttgaaagcattagaaccaaaaacttatgctggaataaaacagatgagctacaaaagatgcatgcacatactcacaatagctagagcacaaaaaaaaaggtctgttgagtttgtttctttatatgctggaataaaacagatgagctacaaaagatgcatgcacatactcacaatagctagagcacaaaaaaaaggtctgttgagtttgtttctttataaatcgtaagccaaacagcatgtcaaatattgatatgaatgtgtgtcatctgaccgaaatctccatcttgccactttcatgaccaacgacaacagatattatcaattgaaaatccatcagttagcattgagatgactgacaataagatttattgatgtaccaaacagcaaccattctctttacaagtgctgccgcttaattcacaactcctccacaacgatgtgctccactacagtctgcccgaaaaaaatacacaaatactgctatttctagctatcgccatagcgcatatgaatcaggattttttttttcataggagaatttaacgatttgcggaccatgtaaacatgagaaggcgcgaggctttttcagcacagccacggaccaatccttcgcaaaattccaacaatcacacgaacaaaatcaaacggggccgcaagtatcccatggctagggtttacctgatcgttgacgaagccctcgaggtcgttgaggatgtcggggttgtaggggttcacggcgacgagctcctccaccgtgtagctctccgccgcctgctcgctcgccatctcggggaaccctaacgcccgaatgctagagtagatctcgcgcgaaaccctgggagcggcgagaggaggagaggagagaagtggcggcgcggcggagggggaggcgatggagaaaagggttttcgggttcgtgcgaattttttcgctttagtccctcagctatccttatactcctacttcgtgtgccgcggatgcaaaaagatgctggtagaaatgcgcatgtgcccttccaaggtttggttatttcatggacacccctgctaataaccaaaggtgtggcataagcaacaactagaattgctaatcctaacaaaggtggtgttcttttcttttaaagatgaagataaagatagtattaagtgttttatgtaaaacgagatggtattgaggtgttattagttaagttttaatcaatacaaacttgatgaaaaatagattaatttgatatttgagagcaactttcatatagaaagttttcgtacgaaacacaccatttagcagttgaaaagcgtgcagcgtgtatcaaaaattttatcgaacttttgttggagaaaagaacaaggccttgccacttttgaaaaaaaaaattgaaataggagcctttagaaaaaagtggatccattttattcattccatgataccaatctattaaaagtaccatgagttcatgacgacgatttatttttggtaggaaccatgatattgatactagtaaatacgctcgagcaatcacatacgattgatgtgatgacacgaattatatttcgtcttttttacatgcgggacaattatacagatgatgaacatccttacgatcctatcacctacttcctccgtttcatattataataatttctagcattacccgcatttaaatatatgttaatgaatcaatacatatatatacgtgcctagattcattaacatatactccctccatccataatatagaaacctataactagatgggacacttcatagtataatgaatatggacaggaagcatgtccatattcgttgtactataaagtgtcacatccggtattaggttgttatattataagacggagggagtatatgaatgtgggtaatgctagaaagccttataacctgaaacagaggtagtacgtaattattaaatctatcacaattgataataacatgaccttaatttgctcatgtttgaaattttgttcccatgacaaaccatctgatgaagagctgaaaaccaaaatttagttgctactattatttatttctatattttacacaccaatctaaaatactattgttcctcacaaaattaaagcttgcaaagtcacaaggatacaagatccacacacacaatcccacaaactttacacaggcactttgcaggcttgcagcacaacgcccagttgcagctcaaaagcaagcaaggcaaacggacgtctggcccacatgtcagcctcacagtgaaggtgaaacaccatatggcatagtgcagagttcagacttcagacaagctcaaacattcagagttcagttcagcaagatcgtcagtcgagcagaagagaggcctgcctgaccaggtggcctctgcgctcgaacacctgcctcctgcgcctctcgaggtccctctccacggcggcgatctcctccatctcgcggtcgcattcggcgatcatcgccgcatactgcagctgcagcgccatggacaggggcaccatgtttctgctgctgctcgcgtcctcctccatgagctcaggtgtggcgctcgccatctgttcgtcgcgaggacactgcttgatcttgcactttgccgcgctcagtgcttcttgatctgcgacggcaacaagccaacaacgccaatacattagtaaatctacttgattcttcgaaatttgttggtttggtttgatcgagttcgctcattttatcaaccttgatcatcattcatcagtgagaatattggaatcctttctttctttcgcaaaaatcgagctcaaccgtatgatatgatgcgaacagggcaatgctccatgctacgagcctacgagccaagtttctccgccagcacacatgcaaattcaaattcaacttctactcccgcaacgaaaaaaataaaaacgaaaaaaaaataaattaaactataactagttaacgtatattcacaattaaattgttttattttattttgagatgtaggagttaattttaaacatgcatatttacaaagtgatatatcacgtattaatacatcttgagatatcctccgaggtggtagtacctgcataggctgctgcacggccagcactgcctgcgtctgcgtctgcggcgtcgacggccatggcgtcgtcgtcgtcaccggagacggccgccgcggggaggttgaggtcgatggtccagcagggccggtcgttactccggcgaggggagccatcgccgtcgcgggggaagttgagcctcgcgcccttgccgcggatgcggcgggcctcgcggtcgtaggccatggcggcctcctcggcgctgccgtacgtgccgagccacacgcgccgccccttcttggggtccctgatctccgccgcgaacctccccgacggccggcgccggacgcccctgtacttgctcttcttgctcgccttccgacgaccggccgccgccgccgccacgcgccgccgcggcctggagctcgaggagacatccgacgaaactgccgccggcgatcgatgaaatcaacagcaggagaagaaatcgtgtaaagttcaggttgccgtcaggtgaaaatccttcaagaaagcaggcaagatttctccatctcatcgtacaagaaaacgaaggtactgccttcgacttgggggacgacacacatgacacggccaaactctcgtcgccatcgtcggaaagctcgaactcatcgtcgtcgtcgtcgtcctcgaaaagctcgaactccgcctcgaagtcgacgtcggacttgcgcttccgggtggttctcctctcggcggcggggggagtcggggtcaccggcaggagctcggcggcggtcagccgccggggcaccctcgccggggtgaaatcggcgaggattgcaccgccgcacatggcgcggcgcgctcttctttctccgggagagacgtcgctatggcgcgacgcgggagagtggtaaatagaggaaaagtcgtcgtcgtcggcgtcgccgtcgctggctgatgtggggatgggctgtctagtctccgtgggccgctatctcccgatcttgtgggcgccgaagtctgtgggctgcctcgttgtcaattcgtctccttaaaaaaattgtggcaaaagttggttgcaggttaaattgattggatattcgatgttgtgaactttactgggataaggacatagactttattgggaaaaaaaggatagggtaatattgtacactagcatccatacttctcacctcatttaattatagccattcatctatttccctttaacaatcacacctctcataactcatttgccaaacacacctataaggttcagtagatgtggagattttctgggattaagggttcaacaaatacaatagcatgctataaactactccatctgtcccattttaaatgtaattgtgggtttatgcgcgcaacgttttatcatccgttttatttgaaatatttttataaacaatatttttattattattatatgataaaacatgaatgatactttatttgtgacttattttatttaattttttaaaataagatggacagtcaaacgttagatacagaaacccacactattctactgcaattaaaatgggacggggggagtaactacaagcgcatgtgaaaagagagagagaagaaaatcatactagagtatagatttgtagccagctgcagcatggatcttattatgtgtttatgagagatggaccaatggcatccctttgttctaaatgagctagtatacggaaattttccgaagaaataaaatcctccaaatttcctttgaagtgcctttaatccaaaggagtcctattcaaggagcatttgatgatatgaatgaatatacaacaattgtaaatcttaatgctcttagtctagtcactaacatgtggagctcgcccaaacactgtccaatgtccaatggcaaaacacacagtgatgtcttaatctctctctctctctctggcatgtgagcattatgacaaaactcaaaatcatatccacgtgcacaaagaaaggttttctgaatataccctccaaatgatactgtcaaaatcttgttagaataggttggagctaatgtgaaccggtgtagatgctgtcatgaaaagagtatactttagtatagcacaaaacagtaggaaagaataccatgggctcttctttcagcccacagcctgtctttagtgtttacccagggttggttatactcccacagacttgcataaagttcagaatttggaagcatcaaaccatgagtaacactagtataagaccagccgtttgtcctcatttgcagaaagggttagaaacccttagatttcatgccatcaagcgtaacagtgtaaccccaccatgtcatttctttgctacttatagcatcccaagttgatgatccatttcatgttttctctcctttttcagatgcatactatgatgtccaatgtgggtgtctgaactgaaatctgaactctgaactctgaaggctgttgtttccatcagggtgcattggttcagcagagatcggtgatctatgttttcatatgtgagtgatttctgttttgtttttgaaaggaagcgtatatgagtgttcatctatactcttcttttgcttttggtgaagttttgttaacggagcactcagtactaacaaattcttgcacaatgtttgtgtgttgtgaataggcagttggtcacgttctaccggtctttttcgatggaaatgaaggtaattggaggagttctatctgtttgatggaattcagaaccaaaatccgaattccacaaaatggctagaggaaaatttttagggctatttgcaattccacaaccataagcatggccaactggtagttctccaagtaaaagaagttaggagctggttatgatggtactaattattcagtttcttctattgatcctgaaagttctatgccaggataagaaaagcttgtgcaaaccctccaagccatgaaaacaattatcatcaagagaattgaagattctattttttttttcttaggatctgcagggaaaattattcagatagtggaacaggttcaagtagccatttgaaactcaacacaactttatatcaagaacaaatgaacaatgaatggtagatccaatcttcaatggagaatcatggaccaccgaattgggctatcttcccgagctatctacgactacatgcatagtataatagatgcaatcatgcaagtgtgcaactagtagttttttttttctgaaggagatgagattaggtatagcatgtaatggtcctggtgtataatgccatggcacactcaacttgcatttaaacaatgctagtccctgcagaccttgccaagttctctgctcatcctcattaggtaatttgcctttgcttgctgcgtgtgcgcacctaaacttttatatttgcttgagaatcctgcaaccccaacttaatttggaatttagttgagcaaagtcactgtcatggcctcatctaggtaagaaagataagagcaatttgcgcaaattgccgactaaaatatcactaatcaaatcgcaaaaccacggtttcataaggcgcccaccgtttcgcgcgtcggttttcacatccctgtagtagcggtactgttcctgaataaaaaaacttgctgaaaaagacagatttattttttttttaatttttgcaagctgcaacataaaacatgacagatttttttttaaaaaattttgcaagctgcaacataaaacatgatatgaactgatcaagtgttgtggcaaacaggattgccagcagataggaaaaccgtacgggttttcagaaaaaaaggaatactgaacaatggttttctgatcatctacctgattgctgtttggcaaatgagaaattcagacgataaaaaaaaacctgtctttctctccctctattttttcagcagttataatccaaacaaagcaaaattgcagttgtacaaaccaaaatacattacgactggactgaatccagcaaattatgatattcttacacgatccatctcaacatgacagagatcaaatgatggatcgatcagtggtacataaacaccaagaggaccaggttttcatagacttatttgacatcattaacaaccacgaccacgataattgacgacgatattgccgacatgatcgatttcataggactatttgaccagcagtacgaagaccccgtaaaagtagcccacaaattaagagtacataaacttaatatatagttttgatcataagatcggcagtagtacagattcagaatctaattgacaaacacaaacaccgcaatataattcggtaatcaagcaagccatgatatcagctgcaccccatcatcctccggttaaacattcatcaacgacgacgtgattaacctgaaccaagaaatggcatggtatctgatcaagatatataatcctgatgaacagatggattttaagtttttaactgaatccattaaaatggaagtgaattcagatgcttacaattgagtgcacaaactgcatcaatggaggagtacatcagaaaagggcgccgtcgattgggaagtcgtcgaagctccacaggttgacgccggcgttcatgtcggtgttcgcgctgttggcgtcgccggcggcgaagaggctgtcgatggactcgtagccgtcggagtaggggagctggaacagcatgaacgggtcgaactccagctcgtcggtgaaacccagcgtgtcgctgccgccgccgacgctgccctcggacgagtcgacgtcgtcggacctcgccttcttggcggggctcccgccggactccgacgtggcgacgctgtcggtgaaggagctcgtcatcatcatggccggtggcggcgccgcggcggtcgtcaggtcgacgaagccgttggtgaagaaaggtagcgcggtctcagcaggcggagagaattc

SEQ ID NO: 78733 - DNA, 39839 bp, Oryza sativa
gggggcccccgacgccgcctgaccccgctcctcgccctatccacgctttccctcgtcacggccgcgggaacgatctaccacatctccgcgtgggacccgaaggggaccgtggagaggtccagggcgtccgcgccacgcgtggtggagcgaatgcagcacacctgcgcggcgggaaggtgcttgtgcaggtcgctcatgtccgtgctgtcgtccgccaaccacgaggtgaggtccgggttcgagctccgcgtcgccgcgctgctcgccgacatcgcggccgccagcgccgcgcgccgcgcggccatcgtgtcgtgggggggcggcgccgtcgtcgactggctgctcgagagcgtcgtgcggcgggccacgcaggcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagctcttttggaagaccagagcttgactttggctccttctgtccctgactggtgctcaagtcttcttttgacagcttctcgggctgctgagaatggtgacatggcattggctcaaatgtcactatcaactttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaatgcgtgtgccgccaactgttcttagtagttaagttggttgataaatgagttttagataaataaacatgacgataatcagactgaaaatactagaacgtcaagaacttaagatcaccagtataatatagtatgtcacatgttcagatttatgacaagtattcctccaccgccgccaccccacgcccccgcaagtgccgccccaccaccgccaccgccacccccaaggcgacgacaccgaacgtcgtcgtcgtcgtcaacctcgtcgacaaagaggccgaggtcagcgagagctccggtgccagcagcagcgcgctgccggacttctcgtggcagggcatgtcggcgtcgtccgacgacgacgccgcggcgcagcaggcactcctcgacgccgccggcggcgccaagaagcgtccccggagcgagccccacgtcacctccgacgacgaagtgctcccggcgtcattcgacagtgacaacaacaccgccgccgccggcctgctcccgctcgacgatcctttcttgttcggcgaccagttcggcgacctcaacggcggcgcgttcgcctcgctcatggacgggctgttcgccgccggtgaagcgaacgtcgccggcgagagcgtggggctctggagcttcggcgacgactttctcaacgcgtcgtactattagctagggcttccatagttcttgtactttacttgtactgtactgtattgtactgattgttaacgttgccataaagcaatcttgctagtttgtaattctgcgtgtgtggtcgaaattttcatgtttgtgttgtttgaatctgtagttgtcgtatcgtttggggtgtgtttgatttgaacctgtgtcccttctgaccttgattcacctcaagcggcaaaggagccctttaacatgtgaaaattttgacagaaaccgggcctgatggactgcagtaaaaacaagagattcagcgtgcatgtagctgtagaaaactatgatccaacaggcccaaacaacccaattaatctgaacattcagaaagacaaatatggtcaattatccatcatggcagtaaaaaagataggaaattagtcccatggtgttatgtgttattatacttgtaggttgtaattcgttccttctttattattattgtattcaaagctacttggcttcgacttgcaacattaagggcttattcgtttttgaaggattttaacacacatgaataagaaaatgtggaggaataggaattcatgcacacttcagtctatatgaattttccaagagatttgagtggataaaaaattccttaagtttcttctctacaacttgtaggaaagggaaatttcctttggtttctatgggccggttcaaatcaacaagctgctatttgtggctaagaaaacaggtgaattattagcacatgatatatgtgctattataaattttaaaaatatatttatttgatttttttccaaaatacttttacatatatttttttacacaaaacacattgtttatattgatctagggaacgtgttatttgaaaacgaaaaacaagaaaattgttatttcgagctgccgaaaacgaaactcatacttcttcgttttcatggagagatagatcagagagtttcggccacaagttccatggagctcgtactgcttgtgctgtgtagtgtgtactcctacttattcaattagggcctgtttagttcgcgaaaagaaaatttttgggtgtcatatcggacgtttgaccagatgttggaaggggtttttgacacgaatgaaaaaactaatttcataactcgcctggaaaccgcgagacgaatcttttgagcctaattaatccgtcattagcacatgtgggttactgtagcacttgtagctaatcatggactaattaggctcaaaagattcgtctcgtgatttctcccctaactgtgcaattagtttttaaatttatctatatttaatactccatgaatgtgtccaaagattcgatatgatgtttttgggaaaaagtttttgcgaactaaacagcgccttagtagtacaacttgcgacaagttcttttgctcctcaagtacaggcccaagttgagtcacaactcacatctcacaagttgcgtggccacaagaaaaaaaaagcgtcgggaaaaaggtagtgtctagtgctaacgacttggagcagtaatatgcatttatgctttcacgtcggtaagatgtaatgggtgcctaacctaggccgtgctaatcctatctgttagtttggccgtctttagattcaaaattttttcttcaaacttctaacttctccgtcacatcaaatacttggacacatgcatggagcattaaatgtgaacgaaaaaaaaacccaattgcacaatttgcatgtaaatcgcgagacgcatcttttgagcctaattacaccataatttaacaatgtgatgctatagtaaacatttgctaaataacggattaattaggcttaataaattcgtctcgcacattacaggcgaaatttgtattttgttttgttattagtctacgtttaatactttaaatgtgtgtccctatacttaaaaaaattttagcacacgaactaaacacatcctttatctgttgactataaaccattttgtgccttttgtgtgtgcattggtccatgacacatggatgaccatagtgagattagtactgctgaaattgtgttcatctaagggggaaagagggaaagaggttgttgatcagagtgagaggatggggagtctaactgtctacgctctagtacttccttcgcatgataagttaatatagtacggaatataatatatcccagtactataaatctggacatacatccgccagatttgtaatattgtgatctatcacatctaactagattaatttatttttggataaagagaataagaaaactagactggaaagcctaacatgggatcttctgcgagaaatgtggttttctacgtggtttcagcggtttttgccgcggttttacgtagttacacgtttgcgtcgttatgtaaataatattagggtatcgtgtttcctaccagaacaaaataattatgtaatatgtgggtgtttactttccagctcatcatatgatcaagcatcacgttatataatactaaatgattgatcttttttatgagaaaccacaccatcatcatttggaaaaccaaggttgaaacagatgttgcggttgtgttgatggatttgggggtcgtgcacacggtgatcgatagatgcacgtcttcacgcgctaattatttttggtcaagactcaagagagccaagtatagaatagccgacagaggcatgtttggcttaattaggctgagaccatgacaatttttcagagagtttgctgatgataatatccgtcgttttagatgcggtaatatggtacttagtaaaaaaaggagccgtggatatgatgatattatcaaaagaagtgagcctcttaagctccgtagactagttagtttcctgacatccattaatttgctaagtcgatgatgtgggagaacttagcaccaaattgtctaatttagagttttgactacaacagaaaatgaagtggcattttattttattccggttactttgtttatcattatctctaagaataatttattgatatatgaaagttatttcagtacaatcgtcaaaaaatattttcaatattatgattttactagtttaaaataattactcggaatccacgcggcgttgttatagtacatgatgtggatggacgtgtgcgtatatatcgacacggtgcgaaaattgcagtagttggtagtagtatgttttaatatttagaaaagtaaataaaatatcacgagaatagaatttaaatgtctaagttctggagatggcaccgtccattttcaaaactttttcataaacattatgctgatcactgtcatgtcggttagctgtacgcctgtactatttgtctattttcagagtgttttaatggcttctagtactattttttttattttcctcaaaagtagctcattttattaattatactcgtaacatattttagtcaaactttaccagacaatatcctaacttcgcatttctagctatatgatactatacgatgtgattttcggaagaatacactcgataaaacatgtgggctgacatgacacggcctgtccagtgaaccatatctaatcgggcagtgcccactacccagacatgcatattattatttagggttatttgtaaaatttgtccatatttttttaattttgcaagatgctactcgaaagacagttctagtagtatttttacaattttttagtggcagtgttgcaataataattaatgatttaaaccagtggcaaatttgtaattgcctttattatttattatccaccatctcaatcatatactccctccgtttctaaatatttgacaccgttaactttttagcacatgtttgactattcgtcttattaaaaacttctgtaaaatatgtaaaactatatgtatacatataagtatatttaacaatgaatcaaataatatgaaaaaaattaataatatttagaaacagagggagtaataaataaaatcatgcaattccgaataataaaataaaataaaaatctaccatcccaaaggtgtcctatatgttccgtttggaaaatagaattaagctatggatactttcttttttcagatttgcaccgttttggagggggataggatatgcagattgagagtgcttggcgaaattactaaattaccctcgccgtttttgacgtattgttttcgtgagttatccgttagttcgcccgccgccgccgccgccgatccccatccatcccgcgaggcgcgagcgagcagggcgccgtcggcgccgtcgttcgtcatgctgcttccgccgcatccaggtgagcacatcctccgccaccgccgcctgcgccgattcccatccatccatcgctcgagcgagcgagcggggtcgccgtcgcttgtcctgctgcttccgccgcatcccttacgacgcacatcctcttgtctcatctccctctctccacccacgcaattttttttctcgaatttgcgttaaccctagcttcgttgtagtagaaatttgccttaaccttaatactaacaaatgtttgttccgaaaaaagtttggggttggggggggggggggtggggttcaacttaacccctatgtcccatgtcagatccgccactgctttattgtgtgtggcgcattgtctcttagctcttttaaggaaaactaactatcgttctctatgaaatctggctcgcattttctttcaaaaaatctggctcgcacgcactgctggtgtaaatatgatgatacattgtaagaatgaaatatagagttattaagtttagtttctttagcaagttattaatgattcatacactgtttatgagtgtgccattttacccaggtttccaaaggctgcttgctggcacagcttggagaacgtatatggttagaacagtgaaaaaggctttaaaaccaaatgaattattctgtttcctgtcatttcctttaaatatcacgcgatccaaacttctagccctaagtgtggtaagaaatcactgtaggatgatgcatcctcacaagccgtagagcagcttgggaaaaactggaaatttaaaactgtcttagctaaaggaattcttgctgtccgcatattactttcatggttaatttggtgtcaaattacatgcttatcagcatttttagtgctatatgtctggaagcactatatacacaatgataaatgaggtaggtagtataggctactagacctcttgttgatgtctagttccattttgtcatgaataggaaatgctagtgcatcaggatagtgaatattcctccgggagagatcagacggtgacatcttgaggtagaagaatgataagtgaaatctattgaataacacatgaatagaatttcactctattagggtccactaagccaaggctagatatgttcttttccatagcagcttgaaaacaccagccgttggttatctgttatgtactataatatatactgcctctgtaatgttggtacctccatttgtaaacatgatggtttggagatgggtggggtccccaataataaaagactatgtgaataactcaccttttatgtgaaactaatggtatcaatttcacatcaccatcttaatagaactttatatatcagtggttagagttaaagaagtatatctgtggagattctaaatcatcaatcattaactctttgtactttgaaaacagacatatggatgtgtttttgtgcattgaaaacctgtttgaacttaattagatgatcggttggtactgttcttgcaagtttccttagccccattcttcttgatcaaggttttcatctacctctatcttccaggatgcattgtattgaaaaaatgtttcaaatctacttctagttaggtaggtagacttccagcctttattttcctctctttttgctatcatgtttaagaactcaaagcacaatggaacttgtggctaaaactcacagcctcactggcagcgtgatagaaggctaactgctagtgcaagtaatgctgagagcaaacattatatgagtgggcatggtatgttttaccagagtaatgcgcttgattaatgggctgaaattgtaatgaaccttcacatggacatgaaacagaccagctgaaattgaatggcttcttcttccctaaattgctttcttgatttccctattacagcttcctctgccctgcattcatccagataggattaaattgttaaggcacatagcaggtctacattaaatggcccatacattttatccaaatcttacccatatgggtcagatgtgtatgattgtatgctctgatctgtagcggcttatatttttccttttagttaattgtaccgacaagctgggctccacatgatatttatatgttttggtaatgcaaccttttcgtaaaagagaactattcgttattttaacatacaaacacatcctttttcatttcattttttagaagttaattacgtgtgaatgatcatagcaggtcatgtatgtgaacactgctgactcaacatgaaactgccactgataaacaaatatagaaagaaggaactgcttatggcactatgatttttttaaaaattttatgcactttatgtacacttgttttcgcattatgggaatggggtgaagtggaaaaagaaagttgtgccatggccatctgtatgtccaacttctatgtatctatatatcttgtgtactgcgaacccttcaatctgaaacatttagttttcgtccttattcattactatgctattgtttcttgggtttcaggcagaacattaccagcctatcatggagacaacagatttcttcttggagcttgtttcctgagtaaactgcctatgctgcgcccaatgaagttgtctttggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctgaacaagcaaaagcacagggtgagaggggcagtgttgactcccttctaaatctgcttaggaagcactcagtggaccaacgaaggaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcaaattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaagtgttccaattattgatgaatctcatgatacgactctgaaatcttccttaggaggtcctgatttaagcactttgaaggtcacagaactaagagaacttgcgaaatctcgaggaatcaaaggatattccaagatgaagaagaatgacctggttgaactgctgagcaacatggcttgatccatcagcagccctgtcaacttggctctgttttgtcccttgttagtcacattgtcttgggcatatgcactatcttgccattcctatcttatctagatgaagttcttttaggtagaaaactgtaaatgagcaaggtaaacaatgttctgttctggttttatcgttgccctttctgttacctagcctctagttaccattgtttttgcgtaaatccttcatcagaattgaaccctggattggccataagactggcaacgattcgacgtcatgctgattatgttctgatgtgtagtgttctattcttatctctgttgtttctcctttctcatggcagctcttgtctgctgttgcatggtttctctcgtttacatccatggttgttactgaacgtttgatgcacaagtcttttgtgtgttcatgaaaagaataagcagaagcaacctataatggatttctttggtgttcaatcgtttactgtctttgttcagagccaaggtactgattgggaggatttcctgggaattgtctgcctcccgattatcaattcaacaatcagcttcattaaggaaaacaatgcaggcgatgcagctgctgcactcatgtcccggttggcgctaaaaacaaaggtttttttttctgaacagaaatttaaaaattgcaagtgaatccattgtgctagtctgatcttgttgtatacatggatttgctaccaggttcttagagatgagcagtggcaagagcttgatgcttccacattggtacctggggatataatcagcatcaggtttggtgacattgtccctgcagatgcgtgcctacttgagggagatcctctgaaaatgaattgccacacgccgttcatgcgaaagatgtcgatcactggaatgtcagactagttgctccgtgtaaataatttgatcacatttttgtttgtccttcatcttgtagtcagctctcactggtgaatcccttcctgtcaccaaaagaaccggggaccatagtgttcactggctcaacatgcaagcatggtgagattgaagctgttgtcattgcaactgggatacactctttctttggcaaggcagctcatctagtggactccactgaggttgttgggcattttcagaaggtgattcatcaatctttagactgtaataagattataagaacctcacaagtggatgtgctgtaagctgtttctaaccactgaattttctgattcttacctccataggcaacttctgtatctactcaatcgccattggtgtgattgttgaggttataatcatgttcccaatccagcaccggtcataccgagatgggattacgacttccctctgtttatggttctgatcatagccatactaaatgatggtgacgatcatttctctctgaattttactgtttctgaagcataaatatataggttcggcatctgctttgatcaggaactatcatgacaatatcaaaggatcgcgtgaagccatcaccaagcccagatacttgcagctggagttgtcatcgtagcctaccttgcattggtcaccatgctgttctatttgtaactcctcaataggcttcatgtctgcacattaccagaagcaaattttcagatgattgcataaaatagataacaaaacaaagtatgatgatcagcaaggctgatatcaggtaagcatacgtttaacttcgtttgaagggaatgaggtgaatggttgctgctgttcaaagtgttcttccattgcagctttgcgttttcttctccttatcacaaagaatgcaaggactgccccagagcttccaccaaaacatgaaccaccattgtcttgacctgggctgtttggacggtttggtggaggggggagctgtatatgatggaggtggtggatttccgtcaattctgtacacaaggatcataataggtcagtgtacaactctcatttttgcatgttcataagccaggagaactcactgtagattgtttaacttcttaatttgactaggaatccagccagtgaaatgattttttgcaacattcctatataggaaagcaaagatatgagatgtggtactgcacgtgcaaataaaatattaattacttataggttgatttcttacagatcatcaagggagagattagcaaggacattgatataaccagtaaatttattgttctgcagatatctgagaagaacgagtatgggatcacaggcatatcactctaaaaagacatatctatgagataaaaataatccaaaaataatcctttttcttacaatgcctgtaatcccatgctcgtagatatgcctgtaaacccatattcgtagaaatatctatttttatctcatagaaatacacacacacatacatatgtacagcattcattataagaaacgtgataacaaaaaaaaaagaaagtcactttttcgagttgccgaaaaaagaactcatacttattttttctgtagagatcagcgagtttcagctactagttccatggagctcgtactgctcgtgcgtgtgtacttcctttaggtggtataacttgcgacagaggttcttttgctcctcaagtacaggcccaagttgggccacaagttgcgtgcccacaagcaaaaaaaaaaaaatcacctgtgaaaaggtaatgccaagtgctaacgacttggattggtcgctgtaaactcacgaaatgcatagtaatatgcatttgtgctttcacgtcagtaagatgtgatgggtgcctaacctaggccgtgctaatcctatctgttagtttatctgttgactactgtgcatcattttgtccaactttttttagaattacactattttgtccattttgtgtgtgcgtgcattggtctatgacgtatggatgaccataatgaagttagtactgttgaaattgtgttcatctaacggataaaatggggaagaggttgctgatcagtgagaggatgggggagcctaactatctactccctccatcccataaaagaacaatctaagatggggcatgatatttcttagtgcaatgagaaaacgtcacatattatcctatgttgtttttttgtggacagagaacataagaaaactagagtaggaagcatattctggaatcttctgcgagaaatgtggtttcagcggtttttggtgtggttttacggtatgtgcacgtttgtgttattatgtaaataatattagaatattttgtttcctataaggataaaaataattttgtaatgcgtaggtgtttacttttcagctcatcatatgatcaagcatgatgttatataatcaaatgatatacccttttttatgagaaaccacaccaccatttggaaaaccaaggatgaaacaaatggtgcaattgtgttgatggatttgggggtcatacacacggtggtcgatagatacatgtctgcacgcgctaattatttttggttaagtgagccaagtatagaatagccgacagaggcatatttggcttaattaaactgagaccatgacaatttttttatagagtttgctgatgataatgtttgtcgttttagctgcggtaatatggctcttagtaaagaaatgtaccgtcgatatgatgatcttttcaaaagaagtgcgcctcttaagctccctagactagttagtctcccggcatccattaattaatttgctaagtcgatgatgtaggagaactttgcaccaaattgtctagttttgagttttgactacacaaaaaatgaagtggcattttttttatcccggttactttgtttatcattatctctaagaataatttattgatatatgaaaattatttcagtacaatcgttaaaaaaatgtattttccatattatgatttaccaatttcaaaaaaaaatactcgaaatccatatgacagtattctagtacatggggtgatgtggatggacgcgtgcttcatgtatctacacggtgcgaaaattgcagtagttggtagtatttaggtttccatatttaaaagagtaaataaaatatcacaagaatagaatttaaatgtctaagttctggagatggtactctccatgttcaaaacttgatcataaacattaggcttcagggtgtcatattggcccctaaattgtttccatgaagagcgctgatcactgtcatgttggtaagttgtgctatttatctatttttacagtgctttagtggaatcttcttctagtactattttttattttcctcggaagcagctcattttattaattatatttgctgctttgccaagtaagtggagcgtggtgaccacgagccacatattttaagaagggagcattgaacttaccattcaaggatcgatcgcgatcgattcctaaaaaatagccataagtgcagaaaagcattgggaaggagacatgcttaaaaaaatgcggatggtggataataacaatgctaattagcctgtcgtctgctctaatccctttagctttgttgttgatctgttctctagctaccttaaactgaatttttgttgttattggagagcttaattgttagtatttgtggaagtgtgtgacatcattgctgagtaatcaacttaacctatagcatttaggatcctttgtggagggaaattagtaggcttgcctgaagtgttaccccctactccaccttctagctatcaatcattagtttgttttactagtaaccacgcactccatatcacttggtttttctctccaagttaaactttatttactacaacacctaaccagtttttattaaatgtatattaagaatatttgtcattatatttattttcggttagaaataccgctacatctttatcctcacaattaatatgaacagaagtagttgtcggtacctgataaacctaattaaagataacatgtatagcattagcttgtttaggtttaccggattattattttcatcgtttatttattggcttatcaggctaaagtaaatttaaaattataacttaatcttagagatgattatttttgggtcatttttcatgttagcctatttattagccctttgtttttagactgccaataataacaccgatataaaatttttacttataaattatttttcgatgtttaatgaaacttaccagagcagtactctttaattaactacctgcctttcttattacaagatcaactaaaaattttctccgcgtaaagctaaagctcagtgctgaatctacagtgccatgatcacgcagaattggtgcgggataacttcgtggggattcgcatgcaaggtgataattagttaagacaaaaaaaaacagaaagcaaagttttagtggcacacctagggtgtatttagttcacgctaaaattgaaagtttctagctttatatgtgtaggaaaattttaatgtgataaaaaaattaaaaatttattgaaaaagtttggaactaaacaagtcttaaacaaaggctaaccttatctcgcgcgaagacgcaattaggcgtcctttttagagttgattaatttttggggggccaagccgagcggagtggaccgtgacgaggacggaggatgcatgtgtccgccacaagccagggagaggaagagaagagacgccgcgacacgacacttgcctagttctcgtcgtctacgcatgcggcgctcgtaaaagttgggcgttctccccgagtactggcattatatatcagcagtaatttttaggtataaattgttttaaaatatcagataaattaatttgtattcatatatctttacattctttaacgtatgctaaaaagaatttaaaaaaaaagacaagcaaaaatatatttatgtgtgtgtaatatctgtgagtagcgggatttgaaccatgatagatagtcatgcgagcacaactctaccacctcactattagtgttttctcggaacttttctttatacggtgtcgttcccaggttcttgccttcggttacttcggatgtcaaggatcctcggatttggccacatggcacctgtagttctagctagagttgaaaaaaaaaagagagatcgagagaagagcacaataggagtagggtataaacggctcgaacctatataaactgcttgcctcccgctatgtcaagcatccaggacatagataatatgatttatctaattaactaccagatattttcaacgctggaattcctaataatttccgaactactataggtatatagatttgatcactatatcgtttagatctttcaattatgatgaacaagatttacatgtgtttatattttcatgtaatttgcttgtttagatttttgttagtcttttttaacaaaatatgagcgctcaaactaaaattacgtgaaatcaaaattgccaagtactatatgtaaaacgacgaagggagtaccaagtgaatgcttccactaacacagggacccaacgatactacgataaattcccaaccttatcgctacaatcaaataagtacttgctccgtttcatattatcgttccactttttttattgttaaattttattgtgtttaaccaagttatagaacaatttatcaacactcaaatatcaaatcagtttcattaaatatagcattgaatatattttgataatatgtttgttttatgttaaaaatacctctatatttttctataaatttgatcaaacctaaagaaatttaactggtatatataaaagccaaacgacttataatatgaaacgggggagtagaaatttaactggaatgatcttttttttttcaagtcaatagatcacacttttagaacaccatgttggtcaccattcacggctgcaggcagggcatgcattgcatggaccagcaaaataatatcttcccacttgggttgaatcagtgcagtgtacgcatatgcatgcatgagtctacaaatatcttgccacttggacagaagattagttcgtgtaggccacgcatctatccatccgtagttaattatcatgtttgagctggcctcttgagtgtgccgatatagatctctggtctatgtgaatctaatgagaggttgagaaagagagtaggtttgaaggaagggagctctgctcctatgattatccattcaagtgcttggtgtgaaagaggtgctcttctatgagctgatcacttcactgtaactcaattggggaataagatggcattgtattaaaaaataaatcaagacatatttctttgcctcaacggcgaagccgggatttagacatgagaagggactactccatccgtctcaaaaaaaaaacctagaactggataatatacattataatacaacgaatctggacacattatagtactatattggttttttatggaacggaggagacctaatacaccattatttaggttaattaattaattagttagataactatgtcaaaaaaatttgttggaggggacagaccactccgcaattgtttgcctgttagtatattactagaagaggtaaaaaaaagtcatcatactatttgttatgaaggtttaatgtcaccattgtaatttttattttaaattctagctcgtccagaattgcattataaaaaaccaccagtttatctttgtatcaaataaaacaaaatgtcatatgcgctcgagaggagaaagggtgatactgtgagaggaatatgtagtgcaggtgcatttggtgtgtgttgggctgatgagttggccgagtgggggcatcatattttgtttagtggaagctcatctttgaagagtggatctgagctaattatgaggaataaatatataggtgacctaattaaaggcactaacataaaatcagagagtattttatacgctatcaagtttatgacattgaattcgtctctctctccctttatacaataacttaccagattaggcatacaatatgtatgagcggcacttacttgacaacagtcatatattatcgagcaaaacttcgaagttgtgggcataaaaagaacataggcgaaatcagaacatattacacaatcagagcaaacttgacactacataattaatctatatcttttatatagttacagccactaagcatcaaatgatcaacatgcaagtacaataatatagtacatattataacttaaaatacaactatactacatcatttacaaattactaaaatttaaactcgatatataagcctggtaaatcatcatacttattatatcattttcacaatatttgaaccaaaactcatcaatcattctacaaaatttaagatgtatttatttgtatatcatgcagcaaaatacgggatgtcatctagctttttaaaaagttgacaccttgatgctccaaggacatatatgtgccattgaaggagttaattagcgtagctacgttgtccacccgcacttttttccattttagtaacaaactttcaactcaaaccatacaagtgtttttcaagaaaccaaatcatacgaattataacttaaaatcatattaccaaactcctgactatggcctcaaaacatccatcaagaattacacaattctaaactaaaactccaaaaacttttatcagaaaatatgtgccgaaaacacagctgcgctaaatagcaatttcggataaataggtggtgtttgaatctcctgaagatgaagataaagacaaagattaagtgttttacgtaaaacgagatggtaataacgtgtgattaattgagttttaatcattacaaacttgaaaaatggattaatctgatattttagacaactttcatatagaaagttttcgcacgaaacacaccgtttagcagtttgaaaaacgtgccacatttatgctaaagtttatccaacttttatcggagattcaaacagaggcgagacatgacgtggcacgtcagcttgggggcatctgtgcgcgacatctggcatgccagtacgtcatccgccaactcatccaaatttgtgtttataaatgtactatatatatttttttccctccctcggttacaagaacaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtggtaatgttcgtcgcgtgcgatctcgtctaggtgttcgatcgtgatggcgatgagttcttggcttgatctcaccgaggaagattggtttggtttggttttgttcgtgcagtcgtcgccgggcacgacgggcgcgcggcggcgagggcggcgagcaagaagaagcgggggcggcacttccgaggcatccggcagcggccatgggggaagtgggcggcggagatccgcgacccgcacaagggcacgcgcgtctggctcggcacgttcaacaccccggaggaggccgcacgcgcctacgacgtggaggcgcgccgcctccgcggcagcaaggccaaggtcaacttccccgccacgcccgccgccgcgcgcccacgccgcggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgtaagcatctgaattcacttccattttaatggattcagttaaaaacttaaaatccatctgttcatcaggattatatatcttgatcagataccatgccatttcttggttcaggttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgcaattttgctttgtttggattataactgctgaaaaaatagagggagagaaagacaggtttttttttatcgtctgaatttctcatttgccaaacagcaatcaggtagatgatcagaaaaccattgttcagtattcctttttttctgaaaacccgtacggttttcctatctgctggcaatcctgtttgccacaacacttgatcagttcatatcatgttttatgttgcagcttgcaaaattttttaaaaaaaaatctgtcatgttttatgttgcagcttgcaaaaattaaaaaaaaaataaatctgtctttttcagcaagtttttttattcaggaacagtaccgctactacagggatgtgaaaaccgacgcgcgaaacggtgggcgccttatgaaaccgtggttttgcgatttgattagtgatattttagtcggcaatttgcgcaaattgctcttatctttcttacctagatgaggccatgacagtgactttgctcaactaaattccaaattaagttggggttgcaggattctcaagcaaatataaaagtttaggtgcgcacacgcagcaagcaaaggcaaattacctaatgaggatgagcagagaacttggcaaggtctgcagggactagcattgtttaaatgcaagttgagtgtgccatggcattatacaccaggaccattacatgctatacctaatctcatctccttcagaaaaaaaaaactactagttgcacacttgcatgattgcatctattatactatgcatgtagtcgtagatagctcgggaagatagcccaattcggtggtccatgattctccattgaagattggatctaccattcattgttcatttgttcttgatataaagttgtgttgagtttcaaatggctacttgaacctgttccactatctgaataattttccctgcagatcctaagaaaaaaaaaatagaatcttcaattctcttgatgataattgttttcatggcttggagggtttgcacaagcttttcttatcctggcatagaactttcaggatcaatagaagaaactgaataattagtaccatcataaccagctcctaacttcttttacttggagaactaccagttggccatgcttatggttgtggaattgcaaatagccctaaaaattttcctctagccattttgtggaattcggattttggttctgaattccatcaaacagatagaactcctccaattaccttcatttccatcgaaaaagaccggtagaacgtgaccaactgcctattcacaacacacaaacattgtgcaagaatttgttagtactgagtgctccgttaacaaaacttcaccaaaagcaaaagaagagtatagatgaacactcatatacgcttcctttcaaaaacaaaacagaaatcactcacatatgaaaacatagatcaccgatctctgctgaaccaatgcaccctgatggaaacaacagccttcagagttcagagttcagatttcagttcagacacccacattggacatcatagtatgcatctgaaaaaggagagaaaacatgaaatggatcatcaacttgggatgctataagtagcaaagaaatgacatggtggggttacactgttacgcttgatggcatgaaatctaagggtttctaaccctttctgcaaatgaggacaaacggctggtcttatactagtgttactcatggtttgatgcttccaaattctgaactttatgcaagtctgtgggagtataaccaaccctgggtaaacactaaagacaggctgtgggctgaaagaagagcccatggtattctttcctactgttttgtgctatactaaagtatactcttttcatgacagcatctacaccggttcacattagctccaacctattctaacaagattttgacagtatcatttggagggtatattcagaaaacctttctttgtgcacgtggatatgattttgagttttgtcataatgctcacatgccagagagagagagagagattaagacatcactgtgtgttttgccattggacattggacagtgtttgggcgagctccacatgttagtgactagactaagagcattaagatttacaattgttgtatattcattcatatcatcaaatgctccttgaataggactcctttggattaaaggcacttcaaaggaaatttggaggattttatttcttcggaaaatttccgtatactagctcatttagaacaaagggatgccattggtccatctctcataaacacataataagatccatgctgcagctggctacaaatctatactctagtatgattttcttctctctctcttttcacatgcgcttgtagttactccccccgtcccattttaattgcagtagaatagtgtgggtttctgtatctaacgtttgactgtccatcttattttaaaaaattaaataaaataagtcacaaataaagtatcattcatgttttatcatataataataataaaaatattgtttataaaaatatttcaaataaaacggatgataaaacgttgcgcgcataaacccacaattacatttaaaatgggacagatggagtagtttatagcatgctattgtatttgttgaacccttaatcccagaaaatctccacatctactgaaccttataggtgtgtttggcaaatgagttatgagaggtgtgattgttaaagggaaatagatgaatggctataattaaatgaggtgagaagtatggatgctagtgtacaatattaccctatcctttttttcccaataaagtctatgtccttatcccagtaaagttcacaacatcgaatatccaatcaatttaacctgcaaccaacttttgccacaatttttttaaggagacgaattgacaacgaggcagcccacagacttcggcgcccacaagatcgggagatagcggcccacggagactagacagcccatccccacatcagccagcgacggcgacgccgacgacgacgacttttcctctatttaccactctcccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttcttgtacgatgagatggagaaatcttgcctgctttcttgaaggattttcacctgacggcaacctgaactttacacgatttcttctcctgctgttgatttcatcgatcgccggcggcagtttcgtcggatgtctcctcgagctccaggccgcggcggcgcgtggcggcggcggcggccggtcgtcggaaggcgagcaagaagagcaagtacaggggcgtcggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcaggtactaccacctcggaggatatctcaagatgtattaatacgtgatatatcactttgtaaatatgcatgtttaaaattaactcctacatctcaaaataaaataaaacaatttaattgtgaatatacgttaactagttatagtttaatttatttttttttcgtttttatttttttcgttgcgggagtagaagttgaatttgaatttgcatgtgtgctggcggagaaacttggctcgtaggctcgtagcatggagcattgccctgttcgcatcatatcatacggttgagctcgatttttgcgaaagaaagaaaggattccaatattctcactgatgaatgatgatcaaggttgataaaatgagcgaactcgatcaaaccaaaccaacaaatttcgaagaatcaagtagatttactaatgtattggcgttgttggcttgttgccgtcgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgatagatttaataattacgtactacctctgtttcaggttataaggctttctagcattacccacattcatatactccctccgtcttataatataacaacctaataccggatgtgacactttatagtacaacgaatatggacatgcttcctgtccatattcattatactatgaagtgtcccatctagttataggtttctatattatggatggagggagtatatgttaatgaatctaggcacgtatatatatgtattgattcattaacatatatttaaatgcgggtaatgctagaaattattataatatgaaacggaggaagtaggtgataggatcgtaaggatgttcatcatctgtataattgtcccgcatgtaaaaaagacgaaatataattcgtgtcatcacatcaatcgtatgtgattgctcgagcgtatttactagtatcaatatcatggttcctaccaaaaataaatcgtcgtcatgaactcatggtacttttaatagattggtatcatggaatgaataaaatggatccacttttttctaaaggctcctatttcaattttttttttcaaaagtggcaaggccttgttcttttctccaacaaaagttcgataaaatttttgatacacgctgcacgcttttcaactgctaaatggtgtgtttcgtacgaaaactttctatatgaaagttgctctcaaatatcaaattaatctatttttcatcaagtttgtattgattaaaacttaactaataacacctcaataccatctcgttttacataaaacacttaatactatctttatcttcatctttaaaagaaaagaacaccacctttgttaggattagcaattctagttgttgcttatgccacacctttggttattagcaggggtgtccatgaaataaccaaaccttggaagggcacatgcgcatttctaccagcatctttttgcatccgcggcacacgaagtaggagtataaggatagctgagggactaaagcgaaaaaattcgcacgaacccgaaaacccttttctccatcgcctccccctccgccgcgccgccacttctctcctctcctcctctcgccgctcccagggtttcgcgcgagatctactctagcattcgggcgttagggttccccgagatggcgagcgagcaggcggcggagagctacacggtggaggagctcgtcgccgtgaacccctacaaccccgacatcctcaacgacctcgagggcttcgtcaacgatcaggtaaaccctagccatgggatacttgcggccccgtttgattttgttcgtgtgattgttggaattttgcgaaggattggtccgtggctgtgctgaaaaagcctcgcgccttctcatgtttacatggtccgcaaatcgttaaattctcctatgaaaaaaaaaatcctgattcatatgcgctatggcgatagctagaaatagcagtatttgtgtatttttttcgggcagactgtagtggagcacatcgttgtggaggagttgtgaattaagcggcagcacttgtaaagagaatggttgctgtttggtacatcaataaatcttattgtcagtcatctcaatgctaactgatggattttcaattgataatatctgttgtcgttggtcatgaaagtggcaagatggagatttcggtcagatgacacacattcatatcaatatttgacatgctgtttggcttacgatttataaagaaacaaactcaacagaccttttttttgtgctctagctattgtgagtatgtgcatgcatcttttgtagctcatctgttttattccagcatataaagaaacaaactcaacagacctttttttttgtgctctagctattgtgagtatgtgcatgcatcttttgtagctcatctgttttattccagcataagtttttggttctaatgctttcaaatttaccgaccttttcttttcatataggtttccaaccaaacatataacttggatgcaaatcttagtcttcttcgtctgtaccaggtgacagtccatctctgtacaaaccgcttttacccatattttggctcgagttatatgtttatttaatgatgcgtttccctttgcagttcgaaccagaaaggttgagtgtgcagattgtatctcgcatattgattaaggtcagaaaagaactaatgttaacattaataaataaacaatggttttttgttgatcacttccaactgttttgctctctttatgttgttctattgacaggctctcatggcaatgccaggcccggacttcagcctatgcttattcttaattccagagcatgtggtacggaaacaattccctgcctcatgtatatgtcgcatcaaaaactatctatctaataaaatgctattgcggatgcatcttaaatagtatcgatacccagtgatctatttgttttggtggtgattgccaaattgaccctgaaataacattatcatatatgtatgcctagagatgtgcaatgtatatatataataacatgtagttgatggaataaaatcatattcaccatggatttggaatttaaatatttgtgcaagggaacaatctttgcccatttagtcttagatatgtagatataacagacccgaatactttatacattgtgtttattatagctgtacatctagttcttttatttgttgggctctgttctcttatcatgtgagttttgaccactgtcctctatgctcttcttatttcagcaaatggaggaacagttcaagacgttgatagttctctctcactacctggaggtatgtatctggcttgactattgtatatatgttgaacagttagtgggataaccactgttaaccgcaatcaacgtctttgtagactgctaggttccgtcaattttgggatgaggcgtcgaagaaccgcaacatattggatgttgttccaggtatgtcttgtggaattggagccatgttttgttcacacgttgtgaagtggtaattgttgcaagctagatgattgtactggtatttccccctccattttcctgattgatttggccaattgggtgtgactgataaactgtaccttttctgattactttatttcagcattttctcgcacaactcatattttagaaagtaactttgtgacttatcatcgtttagacgtttaccatgtgtttatgtggcatgttcatgcccgcgttgtcatgtaaatgagtatgtattagtatcctagatgcccagagattggttaccatatcaagcagtcttgagcgaacttctgtttgattctttctactgactactgaggaattctttttaatctaacatgaactacctatggattatttttatgaatgtttgctatattggacactttcttatggcaattgatatggattctttccgtttgacctaatggtgaagtgttttttttttttgaaacactagtgaaggcttacttaactaatccctttacaggttttgagcaggcaatccaatcctatgcgatacatgtgctctccttgacataccagaaagttcctaggcctgttcttgcggaggtaaatgatgtcattttaaattaattattacacgagtcctcgagggagcatgagttttcattcaatcctttttgtttaaactttagatgaccaaggattcgtggtaatattaagtttcatattactaatgctacaaatatttgttacgccagaagtgtcaccatcatcatccaaattttgctatcatttaggtgttattggttgcctcgcacatggattgtcccttgttggctgaaactcattacttttcttttcaggccatcaacattgagggtcttgcattggacaagttcctggagcaccatattgcaaactccggttgggtgatcgagaagggtgcacgatctcagctgattgtccttccacgcaacgagttcaatcaccctgagctcaagaagaacacagctgaaactgttccgttcgagcatgtaactcgcatattccctgtccttagctgagtcaacaaccagaccaactgagattttgcattacagaacttctgagcgcgtgaagatactctgggcgcatctgttttctctgctgtgatgtactgcgttttgatatgcctgttttagctaaacaagtcaattctagtgacgatccgagcgtcatatctgcctagttatgtttatgtaagcattctgccatgatattacattgttggcaagatattttatcaggtcagagcaaaattttgcatagcggccgtgttcggctttgggcacaactcgatcttccatttaccacgagactacaaccattcctcgttgtcagatttttgcgattgctagtgttctgttgcgtaggggactcattgtgaaaaaaaaaacccgtatgtggtcggtgtaaaaacggattggttttagcctattttttcgtacggagttggcttgtagtagttgcatttttttaccagttttcgtttagttttccgcaaaagtggggagtggttttgacttccaaaaacaggataataaactcttattaccacaagcatctcttagaaaaaacaaatatgtatatcatttcatcgagcgaaacagcttggatatcgatttttgttgtcgctggcaaaagaaaccgcccaaattcatattgaggaaaaaggagtaaattcacatgaacagggggtctttctgcaaaaagaaaaaaaacttgggccggcccatgcacaccctgcccaaggagagtcgctgcctcacctaaacgccaattagggttttcaggggggcggagatataatgacataaaagcccctctccttcctcctcccttctccttcgcgccgccactctctccgagctctcgcctctcctcctcccccgtcttcccttcgcgcgcgccacccccacacacgcgaccatggcggcagtggcaggaggcgcagcgcgggcgctgtcgcaggcggagcaggacgtgcagatgatgctcgccgccgacgtccacctcggcaccaagaactgcgacttccagatggagcgctacgtctacaagcgccgctccgatggtacgcatgcacccacccccacctacaggcatctcacccggctctgcttgttcgtcgatgctcacagctagccattacaatgttcttgccatgagatttcctacgtaggataggtttaccatgttcttgccactagatttcctaggttggattggtgtggattgtgcacttgtatcatagtgctcgcctttgttcatgctttgttagtatcctagctttagctaagtatccaacttgttgtgagctagaattattacggcatggtgctcaacttgatctgatttcgtgtcatatcgtgtgtggcatagttgcattgcaacctgttgcaaggtatgctgctgttcttttgggagggtatcttgaatatgaatacgtgaacatcgttgctgcaattcataggtatctacatcatcaacctcggcaagacatgggagaagctgcagctcgcggcgagggtgattgttgccattgagaacccccaggacatcattgtccagtcggcccgcccctacggccagcgcgccgtcctcaagttcgcgcagtacactggcgcgcacgccattgctggaaggcatacgcctggtacatttaccaatcagctccagacctccttcagcgagccccgtctgctcatcctcactgacccaaggaccgatcaccaggtgaaaatgatcaccatgtcacggtagtgcgttggtgaattgggtacagtattgtttactgatcgtgttatcctgaattatgtctgcagccaatcaaggagtctgctctgggaaacatcccgaccattgccttctgtgacaccgattccccaatgcggtatgtcgatatcggcatcccggccaacaacaaggggaggaacagcattgggtgcctgttctggctcttggctaggatggttctgcagatgaggggtactatcctccctggccacaagtgggatgttatggtatgcggtgttattacttcaagaacacgttgacattggaagtgcattcatgaagataatttcatatcctttgtatgcttatacactgagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagcactgagtatgtcttttgcaggttgatctgtttttctacagagaccctgaggaggccaaggagcaggaggaggaagctccagcacaagactttgctgccatcactgattacaccgcacctgaacaatggtctgctgaccagtggacctctgatgtggctgctcccccagctgctactgttggtgattggggcgcagctccaggtttgtggtttatccccttctaatatatttatatttttaaccaggtatataactgttgtggacctctgaattttgttcttgtgatgctaaaaatttcatatcattggaatattcttgaaaaaaactgttgtgctgattgctgctcatactgttagcaattgtctcttcgttttcctgcataggctgtaaaatttacatgccttaagcgcttgtactaacttggaactgatcattctccctttctgtggcagctccagttgctgctgccgaaggatgggatcaagcaggagcacccgtagccactgaagccgccgtcgttccaccggttgcgcctactggatgggacccggcagctcaaccagctgctcaaggctgggattaggctaggcaatcactttgagatgtcttccgcagcttaagttaaatatttcccgaggcatgaatgaacacccaaaatccaatgtgatcatctatagctacaccatgaactcaactgtttttaggaatttctagctgaacctgtgttgtttgtccgtccctatttcgaacaacaatgctgtgagggtgagctcggcaagatgtgtggtatatgttaagctttctacttttgtcctaagtttattctgtagcgtttatatcaatcttttcctcggtgcaatggcatggttctatacgctcagtttgttattcaaatctggtacttgtacagtttgagaaatgttgtgcggaaacaaaaacaatttcccaagacgtgaatgcattttatcccttctaatctccacctaaacagacgtgctgcctcactgaaacttagttctaagggctctactctactgatgtacgtgtaaaacagatttaccatgcatttcaaaacctgaaaaatcctaggaaagagcaattttttttggggggggggggtgtatttctattggttcaaaatcatataaactcaaggcgtgcaaaggtttccttgggctaatggacattggtcctcaagtacaaaggcagaaaggagcttgactgcaagactcatctgtcgagcaaagacgaaagtcggccttggtgatccgacgatgctgagtggaaaggctgtcgctcaatggataaaaaagtttaaattatgtttctctttcaaattaaaggggccctagcgaccaaacgattttcctaaaaatcaaaagatacaaccaaagtattgcagcagttgcacaaacctgtatcttgattcgttaatatagtaatttcccatcatgttgcaacagcactcccattcatcatggagttcagggttcatgcaagacaatactggtaacatgaatcagcaggaccccagaagaaaattagttcatgcatcaggtgcaatttcatacatctctggaaaggaaaaaaaaaaacacacaaccaggctgactgaaacattggcttgacaactcatttcctcctgtaccgtgtggcctgttagattgtctcgcaatcattaccgtgttgccaacgattagtgtattttgtacagtgaagactgaaaaggcaagttccatacagagagcaagtaaagtaaaaattggtaaatatgtataatactataacatatttacaacagggattagcatttccatttttttttcatttttgtttgagaagttcttttttctgttttatccttttcctataacatattgccaaagattctaactaagctaacccttgcaaagaatgtgatatatgtttctcctatttattgtcttcagtatggtcaattcttcttcaccatagaaattcaatcgtgtacctcaaccgaaccgagtcagaatggtttcatattccccaatggattgtcatctttgagcactttctctgggcaaaccaagttgatgtttcttccatttgttgtgatgatctcttcgatcacgagaccgttgcagtttgcagcagatgtagcttgacttcgagtgtttcctttaatgtagctgcgatagcttctgctgttgaatccttttgctgagatgtcaccaagacaattttatagctctagtagcaaagcatgcctccgccatccacccaatgcgtgaagcggtcagagtagtcacggatgtctgacatttggctgcttgagcgtgacagatctgtgtcatctcttccctgctaaggaggaaaagtttcaatatcaataaatgtacagagtaaatgcctgatggcagaaagaacgcgtcgatagattacatttgaaaaatgtaaaatctgggttggaacaaaacaaatgtacagcaagcttgagtggcatatatctctactattataaaaattgaagatgtttttgccggtattttggtacgtcatccgcgtatgagtcggttttcaagtccgttcgcttttggaaatacaaatccgtatttgagacagttttgagtcagtttgtaagttcgttcgcttttagaaatacagaagaaatcgtataagaaatctctttaaaaactcacatactaacttgagacgatcggacacctaattacagctcatgattttctaacaaaatatatatccaagcgaatttaacacagtgaatttcatcttaactcgatataataataataataataataatattaatattaaaatagcctttacccgttgcaatgcacgggcattttttctagtaattttaaaaagaaaagaggggaaaagactgacctcatcattgtgtccctgttcactgtatgatgtagttgattcaatactgacaacatccatgggtgaattgatgagtgatgacctgtaaatgagtttgaaacatcttattaccgttaaccattacagcagttccctccaaaaaaatgaaataaaatactatagtgtgagtaatataacatctcagcctagaattcactcctttagttgccagatcaaggggatagaatttgtgcagttggatatacaaataaatcacagatgtgttacctctcataaatttcctcctcacaagaatttcctgaagatgataacagatcaagatcaagaaagtttgaagagtgcaattcaggataacccaatcttctcaaataattctgccgctcttctgaaattgagtgtctcccagacaatgtgctatagtttgtactgaacatgagaaaaatgcagttagttcatagtatggacaatctgaagttctccaacaaccaccaattcgttttcaaacaaggatagagcacctggagcacgggttaggttctatagagatctctggtgcagaatcagaaggttctctaatatcctccagtggttgcattgggagcaattctgagcttgtgttgttttttccaacattacagtcagatacaggtccaccagtgttgtcacataaaatattaccgtccgataacgacctctttatgaatgatctgctgatatgaaatatggatgttactaaactagacatggaaattccaaaattcaataaaataatataacaaaaacaaagtacaattggcagaaccactaattgaccagattctagatagcttgggtaacccaacacatcattatatcagcaattaataccaagataggttctaccttaagctaatcaacatattatattctagatcattgattatcattactaggtggaacatccaaatataagttctctgtgtgaatgaaaggctctcacacccttattaatttgcagttccaagacaaagttttagtattgttcaatccaaacgagcaaacaggcagctagagcaaaataaaatggtgacaccttttgaatttataacatggattgagaagtgaacagtgtcagatttacttggaatctttcatattccatatgattgtctggtaaactgtctaaatataagctgaagttgtactgcatattacagctttctgaacaacatttcttaatggaaattgacttcagtacctcccagtttcttcagttaaagttccttgcctgccaatgttgtaatgctgatctgagtccaatttccaaagcgcaggttttccttcttgtggttggaaatgacccaagaacctgcaattctaaagtcagacagacccgtttgtggtaatatactagagcgataccaacagctcccatggttctgtcatataattttctccgagaattctgcctattgtacatgtatagagtaatacagacatgagaagcttacacatttatagaatcctgcttctcaggatcagtgtaggcattactgtagtagcgctgaagggtccggaggaactcctgagattgtgttgctgccttccattggcctctttgctcacagaagatctgtaacatatatcagcagtatggagtactcagacagtcagactaataactcaaaagagaagtttggacttttggggtgtaaagaaaaaaaaatctttagaagaaaaataatattatgactattgacttcaccgccaattaagaagaaaaatcgctttgaaagaaacaaaaataggacaattgaataagaatatgaagaagggtttaatgaaagatgcatttgtttgagaattgtattacacagtagaggaagcacaaattatgctccaacgagtcagtaaatagaattaagcaagtaccttgttgtgagcagcagagccaccatattgaatagctagcgtatcacccatccgttcatagaaatccataagatcatcggccaaaggagcatgcaattcaattgtaggggtttcattgagctggagcacatgaagttgacgccctaaagcagctaagccatacgcaaactgtgcaacatttgtgcggtccaagcagtctatgcagttagtcctgaggacacccttttgcagtaaaagaggtactagcttagttgcacataaattttgatcctggatgttttcgatgtcacctgagttggcaacagctccttgtccactgatgcatttaaaaagaaaaaaaatgcattagtactgttatgtgagctcataagataagaccaaataggagagcagctactcccaattgttccaaaagctgccttatttgtgtgttctactgttctccaaggcacagctttgactaatccaaagaatgaatatgttacagggtaacatcatgaaggaacattttttgacaaacaacatcaggtagtttctggtggccaggcaaaattttaatataactcttataactcttaagtaggccaaatgttaccttgatgcatcctcatactttgatgtagttatctcacagtggaggaagtcagttagatccaacacatctgatgctaccttgttcaacagcgaaagcacattggtacctttcctgtaaatagcacttagtacttaacatcgaaggcaatttacaagtaatta

SEQ ID NO: 78734 - DNA, 724 bp, Oryza sativa
  unsure (1)..(724): unsure at all n locations
agggatgtagncctgattngcccactgananccagctnnnnnnnnnnnnnnnnnnnnnnnnnnnnnnnnnnnnnnnnnnagtggtcacgaacacaaactcagtcgatgcaccggaatatatttggtgtccatgccatgattgcaagaaagacagacaacttccagctaagcgggtccatttacatctccttacaaggggttttatggacaacttccttggcgaggaggagcaaggtgagggaagtgccggcaactgtcacgggcatgatgcagatgtcggctacgaggaggaggaggaccaaacatgtgtcgatcacggtgaacctaatctagatcagatgctgcgacacggggagagatttgacactgatgataaggaatatcacaagttcacaaccatggtgaaggactccaaaactccaatttacaatggatgtaagacggagcacagcaagctccaagtggtcctatcgctgcttcacctgaaggcgagcaatggatggtccgataagagcttcactgagttgctagagctcttgaaagaaattcttgctatggacaatgtcttgccagaatcgacctaccaagccaaaaaagttatatgtctccttgggcttgacatacagaaaattgacgctggactaaatgactgcattctgtgtcgtggagaatatgcatatttggagcaatgctcggtatgcagggcttccgctataaagtggga

SEQ ID NO: 78735 - DNA, 744 bp, Oryza sativa
  unsure (1)..(744): unsure at all n locations
agatgtgtcttgtgggtaaagatgtacacctctgatcagagtataacctattcgaatagacgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaaatgctgtttactgcaaaacctaacccttatattattaccccttgtctcattcttgctcaatctttcccccccccccttcagtaagagaagctttggagatgaagtcctaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttcctgggatggggattaatacactagcgttcgggaaaatgtatttttctcgnnnnnnnnnnnnnnnnnnnnnnnnnnnnnnnnnnnnnnnnnnnnnnnnnggctaccataggttctacaaannccgtt

SEQ ID NO: 78736 - DNA, 718 bp, Oryza sativa
  unsure (1)..(718): unsure at all n locations
ggggggtagncctgananccgcactgagnatcgtgctnnnnnnnnnnnnnnnnnnnnnnnnnnnnnnnnnnnnnnnnnnagcagtagattagcactactagaaaaaagatttttccaggcggtccaaaaccattttcgcaggcggaggagaggaccgccgctaccatctcgactgtgaaaatagaccattttcgcaggcgggccacagcccggctgtgaaaatcatctcaggaaaataaaaaaaaccatggggcgccgccgccggcctcaccacgggcgccgacggcagcggacggaggggaggagaggaagtggccggcggaggcggcgaggagggaagccggcggcgcgcggatctggagccgtcgtcgtcgctcgtcgtggccagcggcggagggatgcggcggcgtgcggacgtcgtcgtggagggagccggcgacgcggacgtgggagaggagagagctggcggcgcgcggatctagagcggagggagctgtccgcggcgcgcggatctagagcggaaggagctgtcggcggcgtcgcggtcgtcgtcgtcgtccaagagggaggccgccngcggccaggaaggatgcngcaacgcgcggacgtcatgaagganggcgcccgccgccccgacgttggagaagaaggaacccttcgcgttttcgcagtcgtcgtcattcgtcgcgaggagggaggccaccgcggtgaagaggaa

SEQ ID NO: 78737 - DNA, 3252 bp, Oryza sativa
ttggctactttctatattaaggatagactctgcaataaataggggcaaacaaggaaaaccatatataaattggtatgcatgctttatatttgaaacaagatgagaaaaactatatgccttatagaaagaaacagatggggtacatacatttgataatgttttttttatgacttggacgagtagtggctaagctattttgttatttagttgctaacctttcaataaagcatgcaaaaagggtagttgcttgagatagcgtaccatgattaatttatgtatatgttttttagcatatttaaaggcaaaaaattttcatgcatttgtgtacgtaaaaatcgcaatgttatccatgtcatttcacaatgtttatccctaggcaatgtcggaagtatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcatatgctgaggaaaactacaaattgtactgtgagatttatgttccttgatggcatatcaattaattaaacttagctatcctttgtttatttgcatatttgtggagtgattgatggctccatagtatatgttgtcaaattttccatgtttatttagatggcatgcatgcaagaaattaacaataatatatgatcaattttaaggtctaaaaagacttctccatagtgataatagagctgtaatgtgtgtgagtttttgtccaaatgcatatggaggcatgtagacattcatagaaaaagttgatgacacaaccaatttagcattttagccacaaaaccaaaattctcaagtcagaaccaaacagccgacctaggaaactaagcccacatctaatggcgccatgcatgaagataagatcagaaattaagccatatacatcaaacccacacacactgacacagacacatttgcaagaagacatgaattgcaacatacactttaacttgacacaaagctatccataatctctctcccccatctgtaattaatcaaaccaaaaacctctcattatatatccccgataagatatatcatcacctctatccctatcaagggcttagcgtgggagcagatggctttgtggcaatcaaacaaaggctccaaaaaggcattgctttcatgagggagaaggttaaaaaaatgaattttacattttgtggagtgaaagtggtgtgtggacatgtggctggtgaggccactgttctcccattcatctaaatgttgaattcccagcatcctatttatgttgaaaaatagataggtcgcaatcgcttatacgtgtatgcataatattatgtgtttgcaaaacctatgctccatcaagatcaacctcaaaaagaaatggagacattgttatcctctttcttttgtacactctctctggatttattgattatccacttgaaaattttgtaactggtagcatatatccaccattgtaaacatactttctactttgatagatcaaagttgtggcaccatacaagtttgcactccattattgacccactgaaatgtgcaataatgcaaattcatttatgtattcatggatacactactctattattgacttatgtgttcatacctgaggtaattgttatttgtgcaaaattataagacaattaattaaatggaaataaaggacaaaagaaaggtgacaaaggctggaagaaagtagaagcattctttagagctaaggctagcagtatcatctgcctgctggtggagctcacaatctatacatgatgcattcaataagccctttcttgtcctgcatgctacactgcatgtgggcccaggacatgttatggtcatagtgaccccactattaagtgcaaatgaaagtgacctttcatgacttttgtagtactgctatttcatttgagaaaaggctcttggggcaaatcatgcatgcatccttcatgatttccctaccaaatcactacactgcatttatttgagaggaaaatcactctacatgtctagtgttgcctttgtatatgtgtatggttagtgtaataatttatctgccaatcatcacaatgcacttacttgtactgtagttttctagggcttgaccatatgaaaggcattcttcaaccactcaagtattcaatatatacatcctgaataataattacttgggttaccaactggtacatactggattcatattaaccaaagtttaccttaattttctttgtttttttttgaacgaactggtacaaggtggtgcaaatgtaattaatagatatctaggaaaaaaactttctatgcaagtatgaaaaggaaaggtataaaaaggaaaaagttctatacttaatttttattaatgcaacattaccttctgaaactagatcatttatactactcactctgtcccaaaataagcgcaaccagtttatgtgtccaattttgatcatccgtttatttgatttttttataattagtagttttattgttattagattataaaacatgaatagtactttatacgtgacttatgtttttatttaaaaaaacaaataaaacggacgattaaagttggacacggaaacttatggctgcacttattttgggacggagggactatatatcaaattgaacaacaaaaaaaaatgttcattgttgtgatttttcatattaactaaactgatctaaatcttgcaaaatcttaatgagagcaacattgctgctgactgatgagagaggtagcagtatagcatgtcttctttttccttggaagtcagctgtagctgatgtgatcttcccttttcaagctgttcaatttgtagggcctgatcttccctttgattgctatgcacattgcaatgttctgaaaaacaaaattatggtttcagaatgtctatccatagatcctaatactgctaggccttagaacacttgaagaactacactcatgcttataaggctgtgtttagttcagctcaaagtttggattttggttgaaattggagatgatgtgactgaaaagttgtgtgtgtatgacaggttgatgtgatggaaaaggactgaagtcagcctaagttacaatgatctttacagtgatcgatctgcctttcttgctggtgcaacctatgatcctctacctactcactaca

SEQ ID NO: 78738 - DNA, 1115 bp, Oryza sativa
  unsure (1)..(1115): unsure at all n locations
agggtgtgaaatgtatcgcctgctagctgctgcgtagatgctggtannnnnnnnnnnnnnnnnnnnnnnncgattgagatttttcctcacatcagtgacctttgcccattgacgggggccttacccgatagtgatgatgctttcagcccgtcacagataagcgatcctgttctagtgtatgggcttcacaatttattttttttgaaaagtatgtcatgtttattttgtagtcgtattcgaatgctaaccatggttattttgagctacgatcgacgagccaaattttccacttcttccagattaaataagaccttggaacgtcgtgacaatgaatgaagaaaattaaaactaaatttaaagaggttggtgtcaaatccatattagggactcataatatattatatattccataaaaaactctgaactttagttaatgaaatgttatatattatatatttcaagtttttctttctttttagttttctgaactctgtactgaacatgtggtaatttgcattttgttaatgaaatggggagcttacgctctctttctcaaaaaaaatccataaaaaactataaaaaaattcgagcacaatttgaagcttgaaatcaaatgcctaaaactgtggtttggatcggactaacttttattgccaatgttttacgttgaactatctttatctaatatttttacttcggactagataaatctacctttattacagtttgaaccacaacaactcttttctcaagcacatcaacagcctcaagcgcacttacatccacatgctggcaatctctcacacttgtgttcaatctacttctttaccagagacgaagttgtatgtggctaaaagaaaatagagttaggatgtgtttagttccacgccaaaattgaaagtttgaagaaattgaaatgatgtgacggaaaagttggaagtttgtgtgtttaggaaagttcgatgtgacggaaaagttagaagtttggaaaaaaaagttagactctaaacagggccttaaaatggtgcaaagtgaaaatgttaccttaaaaggaggtccagggttcgnaatcgntcgggttggntttgncnaactnccngaagtgcactgccaat

SEQ ID NO: 78739 - DNA, 2007 bp, Oryza sativa
ggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtcatgcttagcggcggccggtccggtgttagtcttctcctggacttgtgtgttggcaatgtcggtgtgtgggtggtggcatatttttttcctggttacgaccctccaaggttgtaatcttgtattttttttctgctctatcaatagaactttgcaccatctcgtgcaagtcgttcaaaaaaaagactagtttacagtgatgggggatatatactctctacatgcagacttcctcaaactattttttaagataataaaaatgttttacatctacatctccaacctctgtagttgcgcacacaactgatgagtttgaatacttcaaaaaaaatgaaaaatatataagaaccaaattggtgggacaaacactcaacttcctcaaaactgaatagaatatatagtgaatattttgataggactatagttgggatttagattcaagtaaaaaaatatgtatatttttctagctttttattgttactagagattccctgttttcctctttgttttatgggggcaaacttggacagtgtcaatgacttacagctaaccagcagttgatgggagactacgacatttttttgcagttggtctgtcaaatcattttaggttgtgatcgcctaaccaatgcagcatatacccatcaaacaataattaagcacacatcatcaagggaaaagccagtagttacacaactaaatcattatcccttttgcttatccattaataatgatgagaaaaagaagtgtgagtggggtgttgtctctataatttgtgacttttagtgagtttagaatgcatactagtgtccttgctagtaaaaaagaaaaggacagattagtgtttaacatgtttgattatatatggttcaaattaaatcactcatactactgtggactgtggcgtgtgctttgtacgcttattttaaaaataaagtctatgaatctcaattaaagcaagccattgctgtgcatgttttgtgagtgcaaatctctgctttagctttaaaaataaatcaatatctatatataaccttcaatctaaaattttatcatatgcttcatccagatttgcgctcacctaatattaactaccttgacgcgaaagggcctgtagcctagtggttacaagagtctcagtagcacctgaggtcctgggttcgactccccatgggagcgaatttttcaggatttaacggcgttgtgctttcagtgataggcgacgtacccgtcgacagcgaggcgcctgtggtgacttcgtcaatctctccagaatttgccggccaagtcttcgaagatgctcataggggtaaggtttgcgtgcgtgtgttcataggggtgagtgcgcgtgcgttgtgagtgtctgcgttgtactgtgtaattctcaaaaaaaaaatattaactaccttgacatgaaattagtagacttttgaaaagaggtgtaccgaagcaacgccctacctgcacaaaataagcaatgtagtatatggagagatcatggcaggatgaacctagctaccagtcaagtatctttagggcatcaattaattcttgccttctattatgtactttactctttgagaaaatcataatatagttctgttttgactaaggatttttttaattagtttagttatgcaaaatttaacattgtgccaaaaacatcttctcaaccttataaacacaaaaagtccagatatgaaggccaaatggtgcaaaa

SEQ ID NO: 78740 - DNA, 4113 bp, Oryza sativa
  unsure (1)..(4113): unsure at all n locations
agggaagtngnattganagccnnattgtannncattgtataccgcgctnnnnnnnnnnnnnnnnnnnnnnnnnnnnnnnnnnnnnnnnnnatggaaatttggataaatttgagacacgctctaccgatggaatgtttcttggttaccccgcacattcacgtggctatcgtgtacttgttttagagactaacaaaattgttgagacttgcgaaattacatttgatgagcctagtccaggtactagaccagaaattgcagttacattatcacaggtttagggggaggatggtcgtatttttgaagacgagagcgacgacgacgacgaagaccgggcgccaggctggttagaccgctggcacgcctccagtcagaccagcataggatgtgcggtcagaacggccaaggttgtcgggttctaattctgttgatgctgatcgggatggacctccagaggctacaacttcgaccagtgaaggtacagaatgtgaaacaacttcagaagacgctgcccctatgcatattcaatgatgacatccgctgaaacaaattattggtaatctaggtgagcggactacgaggtctaaggtaatgactcatgatgtttgtgcaaattctgtatttgtttattcttttgaacccaaagatgttactcatgccttaactgatgattcgtggattaatgtcatgcatgaagaacttgaaaattttgaaagaaacaaagtttggactttaattgaaccaagtgagtttttaaaaataaacaaaatgagtatggtttaattgtgagaaataaagctagacatgttgctcaaggttttactcaggtgaagggttggatttttatgaaacttttgctcgtattgctagaattttggcaattagacttttgttagctgttgctgcttcaaaaggttttaaattgtatcaaatggatgtgaaaagtgcttttttaaatggtttatacaagagaaagtttatgtcaaacaaccaccaggttttgaaaattctgattttcccagccatgtttttaaattgtctaaagctttgtatggcttgaaacaagcacctagagcatggtatgataggcttaaaaactttttgcttgcgaaaggttttcgaatgggaaagattgacaaattactttttgttcttaaagatggtgataatcaactgttcgtttagatttatgtggatgatatttactttggttgttcaactcacgcttgggttgcagagtttactgagactatgcacagggaatttgagatgagcatgatgggtgagttatcgtaccttttggattgcaaattaagcaaacacctcaagttatatttgtgcatcaaacgaagtatacaaaggatcttttgagatggttcaagatggagaattgcaagccaatttcaacactaattggttctataactgtgttggattctgatgaagatggtcaagctgttgatcagaaggagtatagaagcatgattggatctttattgtatctaactgcttctaggccaaacatacaatttgttgtgcgtttgtgtgcacgtttttaagcttctcctcgtgcttcacatcgtcaagcggtcaagcgaataacgaggtatttgaatcatacacttgagtttagaatttggtattctacttcatcttctatatgtttgagtggatgaaatgcgataagctaataaaactattaggtttatttggaaaaataaaatattctaaatataccttctcacccccgaaggggtacctccgatatagcgtcacgtcggtcactatcgcaggataggatccctttggaatccatccagtgggctcttcccgctagcgacaggaaaagtggtccacaaccagtgccttcttgtcttttgttgctcaagtctttaaccttttcttgccagggaatgtccctaacatcgagttcgaagtcagagttttccgttatccccaggggctgattttctagataggttcctatggcacttcttttgactgctacattaagggcaaagcaactacctctcgtaatttcaattactaaggcagtagagatctgtttaagcgagttctatgatggttgtccaactctagaccttacgacaaagaaagagctagaaaccatgttttctattccgatgctgattttgctggttgtagaattgataggaaaagtactagtggaacatatcaattttttgatacatcattgattgcatggtcttgtaggaaacaatctagtatagctcaatcaactactgaatcagaatatgttgctgctgctagttcttgttctcagattcgttgtctaatatcaatttcgaaagattatggtcttacttttgagaatgtacctcttttttatgataatactagtgctattaacattgctaagaatcctgtacaacactcacgtacaaagcacattgatattcgctttgactttttgagggatcatgttgagaaggaagatgttgaattgacatttttggatacaaagttacaacttgctgatattttcaccaaaccattggattcttcttgctttgcctttcttcgtgtttattattcaatctatgtgcttgtaaagatgttgcattataaatcatatgaaatctgaattttgattgttgatttgaacttaattgtaacatctatggttcatgattatactttagtgcatgcttgctatgttatggatgggttcatcttcttcttattgcaacacataacttgatgtgctatatgtatgctaagctcttgaatattaatgaacataattcctatgcttgctgaaatcattatcaaaagggggagaagagatacaagtgcatgtttttcaggtcaagggggaatttctttctttttaaagggagagaagttttttttttgaatttttgagcactccttgctttttaccacttttgtttttatttttccaaacaccaaaacattttatttatgggtttgccaacgtgttcatcaagggggagattgtaaaatcaaagtgtgtttgattcttattctgtgatgaacaattggcatatgagattattggtttgatatttggagtttattggtgaagtggtttttggagatgaataggtactgctggagatttggtcctgtcagaccgggcagtgggtgccggtcagaccggtgtgctcaggttatttcgttggatatccctggataatttgtgtttatgactttaagatggatactatgcgtatgtaatactattgtttgctaatatggtttcttgtttgattcatgtgaaggtaatcttgacacctcgggagagtgttgctggtgatggatcgggagtcaactttgagatatggtaacgtccggatggtcagatatcatgcgggacactcacactaaagatgaatgcatgtggttggtgaagattccatatgacatacggtggagatattgtgtgagtatgagatgcggtgtagaatttggaaggagtccaaatttggtacaattgaaatttgtaaagttggtttcttgtacgggaaggtttcctagtgggattaggacttcttatacgaattttgtccgaggctttaagctgcctacctcatgtatcaatagagagggagggtgtgcatcccggtatcgctttagagagcattgagttgagataatagttagggttttgagtttagtcaagattttcgtgaggagtgttgttgatgcactttgtaaacacatagagaagtaataaagttgtaatttagtttgagagttcgtcgatttgtatttgctcgggttcggcggtccaaccggcggaacaccagcagtcagactggtggcaacgcaccggtcagtccagtggatacacggcggtcagaccagcgatgatgacaggaggcagaggcgacttcacggcggttaaaccgggcgatctacaccggttagagcggcggcgcatggtcagaccagcggatctacttcggtcagaccaatccacatcggatccaagggtaacttttaattccgataaaagttttggttttggggtactacaaccattcacccccttctagttgnnnnnnnnnnnnnnnnnnnnnnnnnnnnnnnnnnnnnnnccgatatcac

SEQ ID NO: 78741 - DNA, 3372 bp, Oryza sativa
ggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaagatgtattgtgcatgcaccagcacctacctgaagcagacaccttacagacagaacaatcaagtggaaagggacaaacaatattcacaaggtgaccataatgatgcgatggtttctcttgtagttccattggaaaaaaaaacataaaaatcaaaaccggccatattgtcaaagtatatataagcatccatggttcatgaaaactagcaaggggcattaagaaaatgaatttggacaaataggtttaaaccatactctttgcgatttttttagttaaccaatgattctttaatttagattccatgtgtaatgtataaatcatcaaacaaagttatttacgtcgaacaaaataggaaataactagggtaacaagccattatttacatcgaacaaaatagaaaacaactagggtaacaagccattacttgtatcaagtaatcacgggaacaactgtaattggtattaaaaggttgttgctattgatatttcacaagttctacaaaacactaaaatatatcatgctatccattcactcattcatgtcctgaaaaatcaaaatgtggtgttgtagctgataaatccaagcctagaccaccttgcaaccaatccaaccgctgtccatcccagcaaggaaaatgagatagtgttgctatcaaaagacaaaaaaaaatgtaccaaatgaaatcataaactacacagagaaaaccatacgatgtatctggacatgtacaccacacgcgagagtagaagatcccggaaagcacgtcatcaccgctctttggtgcgcgctgtgcttgtaggacggttcaccaaaatgttcttgatccaaaatgggagataacggttttcctaatgttataaaaaatgtttaaaaacagttgaatcccaacacaatatgatcaaattttaaatattagcttgtattttttttgaaacttaatcagaaaggagccaacgtcaaacttcgaattttaaaacttaattttagagttgatttgatgtttttttcggcgtagtttttttcggctttaacttttaagttgctatggatggatatacaaaaattttactcacaatttttttctcagtaataaactgttactaccttataatcagtcataaactaccgatgagcacggtcattccggggggatttgtttttggccttttggaaaaagaaaaaacgccgatccctactgagcacggaaggcatcatcccgcgcgcgatgcgcttgtggccgtgtctgtggcttcctgaggccgcgccacgtgtacttggtcgaatcggcccggtccaaccgaaagcgaggtgggcagtgtggagcccaccagctgggccgggatgaactgtatctttttgggagggtttgtttgtgtagaactgtagatcaatcagtgggtttggcttgtgtacgtaagcatcaaattatcactgtcaaatatatacgtcattgtccagtatttaattagttagtaaaattttaactagtctctcagtcccaaaatagttgagaccagatgtgacacatcatagtataataaatctagatataagtgtgtctagattcatcataatatgtcaaatccgataggaagttgagtttattttagaacagattgagcagttcttaaaaaaaaagtacactttgacgtgtgacagtcacttatactgccagtttaatagctccaacccacacaatttttttaatatgttgtatagagtttgtaggctaaatcagtggttattttactgattttgctagaaagctgctaatattttttcctctcaaaactaattttcagtttgtggccatccagttgtcgaacccggaatccttggtgggaagccacgttagccaaccaaccatgagtaatttttagctgaatttacactagttacatatcgtatatctacaatataagtacactttaattatattatagtatatttgatttaaaaaaaactgacgaatttgtatagctaattttttaaaagacaaatcagtggcttcgaaccactatttatgttcttccataataatcagatgatggctcaccaataactttgtctaacctaactctatctcaaaaacctagctttatttcaaagaatatttagagctaagataccaataaacccaatgaatactttgaggctggttgtacgatactaccatctccattctaaaataagtttatttttcacttatcccacacataccaatacaaaaccacaaatactataatatccctacttattaaatatctcaatgcaaatatttctcactttatctactcccaacataattattttcttttttataaactctaatgcaatgattattaaaaataaacttattttgggataaataacaggagctaatagtaaacttattatgagatggaggaacaggaagactaaattaaactgaaatgattgtgctttttttcgaggaatgattgtgcgatttttaaccattattctaactgttaatgtgattttcaaaggtacatttgaaatgaagtagttattaacttatttatatatcaaaataggcagcgatagcgttttcagaacacgacagttattacaatatcatagtatcacgtgaacaaccgtatggttgatatgaccactaacttctatatagcatcgatatatacattttttattattttgaataatttcatatggtttgtttttttttttcatgttggatgtttggttcttaccaattaggaactatcatcaaaattgaatatacttattttgattggtacaaaactgtcgatgttttatatataaaagtattgtactgtttttttctctgtgtagctaattttgatattcatattaagttatgctataaatgacataacagaggcttccagtttttatagcaacccctcagtggccacttttttttaccaggcctccaaagccatgattattaaggcgctatgaatctcgaaggaaattcataggaattttagagggtttcattcatatatgattttttactatatagccctttgaatcaaaggaatagatcctatggaat

SEQ ID NO: 78742 - DNA, 3071 bp, Oryza sativa
aattaatccatcaattttaatcaccactaaccagcacacccatgctgtcaaggcccaaccatcctgaacacccataccgggctgtacagatctatctccaaaccaggaatataccattccaaaccaggagctaaacaaattatttccatttatagcatcttttattacggtgagaagtgtgaaactaatcacgaaagacattgttagacccacccataaccgcggacacggctattcgaatagttttactctggccagaggtgtaccactgtatccacaagacacagccccacaacatgtcaccatgtgcctcaataccaccacggtacctcggaaaggagatgtgacagtacccctcgcacaacacaatccaccacagtgcaccgttcctggatcataatcacccccttataaacaaggcatggactccccagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcatgattggccatcgtgagctatcattaagccatcattaaataatagtgagtcataagttatcccaatagtgtgctaatgtttctaagcatggctaagcaatcatatctaatatctagctgaaccaatatatatagcccgactagtccagttataataacccaaggtatcaaggaataaagtaatcaagaacaaaagggctataacaaacaataggttaattccacccaatgacattcgaaaataaatgcaatagttgaatggaaacaatagctttaaatgggatcaacatgctcaaagggttatttgggatctgtgtaacttgccttgctggccttggaactcttcaaattcttctcctgcgaaaacgaactctccgaaaacgtcggaatctaaacagaaaggagcaaaacaccaaaacagcacataaacaagcatgaacagtacatgtggatatttttaacatgtatatctcaattttagaaaaattttgagacttgaaccaactaaatccgagctgtgatgaattagttatgaatttttaaagattaaatcagattaaaacacttatatgggtattaattgaattatgacgcaataatgaattatttttgaaaaggaaaagggaattattgcgtcagcggctagggttcgcggtgaaccgggtgcacggcggcggctcacggaaacgaacggccgagatcgatcctatccaaaatggacggccaagatcgatcggatccaccgtggctcacggatggacgacgacgatgacgtcagcggtgacgtcaccaccggcggcggctcgagcgtgcagctcgccggcgaacgacggcgcgacggcacgaacggagggcaccagcacgtagagggcgacgcggcgaactcaccggtgaccaaaacaacggcggaagatccacggacggcgacgacgtcgaggaagagcggcggcgacgatcggcttgacgacgacggcggtgtttcggcggtcgacagcgacggcgaaggggcggacgatgacggcgacgcgacggcgaccacgatggcgacctccccgagcaacggcgacgactggagcgacggcggcacacggctggagcggcggcgacgacggcggtgagaggtctcacggggctagggcgctacggacgacgagaaacgaaggcaagggtggcgacgggttgcggcgggcttgggggtccttatataggggttggaaggtggcggcgaaggtaagtctagggttcggaggagagagatcgatccgaatcgaactcgaatccacggatttccaaacgaaattagccgacgattccataagagaaaagatagaggggatcccggggatcatttcccctctattaatttcatcggaaacggaaaggggcggcgcggctcggctagggttcggccgggcgacgacgcgaggaagacgacggccctgacaggtgggccccacctgtcagcggcgaacgcacgcgcgggcggactgggccgactgggccgaggaagagagagagagggttttgggccgacttttggcccaaagccaaaagagaacttttaaaaccttttccaatttaaattattcatgaaatgcaattccatttattaaaaatacttccttagctcaaataaatcccagaaaaatctaggaattatagaattaagcaaagtttttaatgaaattttatctggccccattttatattggaattttttaattaaaattagatattctcttcttggcttttaaaataaattctaataattctaattaaacaacaatttatatatttaggatttttagggtgtgacaaacctacccccttaaacagaatctcgtcctcgagattcggaagaactggcgaacagatgcggatagctgacttcaattccccttctcgttcccaagttgattcttcttccgagagattactccattggactttgcaaaaatggataactcgattcctgggtcttctctcatctatttccaagatacggattgggttctcaacataggttaaatcctcttggacttctatctattcaagaatagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaattttcctttggtgtgaaaacgatgaactcctcgaagaggcgtgacacgaaggtacacatgatctccttcttcaaaacttagatctctacgacgattgtcggcataactcttatgacgagactgggccacacgcaatctttcttgaatgattttcaccttttcttctgcttccctcaggatatccatcccgaaaacc

SEQ ID NO: 78743 - DNA, 1187 bp, Oryza sativa
taatttttataactcacatatactatttatcatgtagtttttttttaataacgcgtgtgatttctatctagtaccaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcggcgtcggcgtcggcatcggcgtcggcgtcggcgtcggcgacggcggcggcggcgccgttgctggagaagaagatcacgtactgggaaggttgccctggctgcgccgtcgagcggaggaaggcggagaatcccggcgtcccctacctgcagttcttccacatctggatcatcatcctcgtctcctgtacgtaatttcatatgtactagctcagttagcttaattaggacactaatttaagtaattaggattgtttttttttgtcctggaaaagattcctcctcagaatttgttgattagcacgccttcttacttaattagcttaggtggaagttgcttaagagcaagtttaatagtatagccaactactagctccaattcatctatagccaatctaatagctcattca

SEQ ID NO: 78744 - DNA, 750 bp, Oryza sativa
  unsure (1)..(750): unsure at all n locations
gagtgttctatgataaatttaaccttgcaaaaatatatgttatttcaagttgtatactaactaggcgcatgtcatagaaacatcgataaaaaaatcttaaataaatcaataatatatatattacataattgtatatcctttaataacatgcatagtaaaattacatttacattttcaaaactaaaaacaactccagttgtcccaaaaattactcattacttaaaaaatactgaattacatattactaaatttatcatgagtgtatttttatgtattatgtgttttatttattcatatataattagaagttgaagatcaaatatattcttttggcaccatttctatgtcctttatctcgtacttaggcatataataatacacgtaccaacgtacgttggagtgctcaatttcatgcgtggcgctatcggtcgaaaggacacggccggctgtatgttcggaatgcatcattctcatcccaagctcgtaaaactcgtgcaactactacgtgcctaattagctttgaagattttaaagcacctccagtctagattcataggagtacgattttcacctgtctttttccttttttttttttgggaagacagacctaggaaacctttattttttctcgaaccactactagaaaacactttttttttnnnnnnnnnnnnnnnnnnnnnnnnnnnnnnnnnnnnnnnnnnnnnnnnnnnnnngggatgaggttcatcatgagatctacaaatnnccgtg

SEQ ID NO: 78745 - DNA, 1180 bp, Oryza sativa
gttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcctccgaccacctcgctcgcctcgcctcgacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcggcggtggcggtgctgtggatgctcgccgctgtggtggcggcggctgcgctggatcctgatcaggacgagctcgaacgcgcgtaagtgcgattcaccagaggcagcttctgattgtttgttttttttttcaatcgtatagcatcagactctgcttttggttgcattctgttgttgcctagcttaatggggttgagatacatggagattccggtgtgcatttttcgtgttcatctgtcgcacgcgatgctgtcatgctgcgaaattcaagttagtacggccgaattgcggctgttttttttcctatctcttaacgccacattggaaatgggcacttgagatgattgtgtgggaagtgggatattggaggggagcaggtagctctgatgcatggttgaaatgagaaaccaagtggattattcatgtgagatgtggagtaggtagccggtgtgttgctacttgcatcaaccggactaattgagcgtggtgggtagatactttgttggttaatggatgtcaacttgctaagtttcacctacatatgtggataattaagaaagggaagacacatcttgaagatggaaaattttgaagt

SEQ ID NO: 78746 - DNA, 31870 bp, Oryza sativa
cggtgtggtggtgcaagatgctgccgacgacaaggccaccgcacctgtaccggacgagcttcacctgcagcagcgcggcgccgacgttgtcctccggcaacgcggggtagaggtcggcgacgtcggtggccatggcgcggccgctgttggcgagcacgtcgtctaggtcggcgccgtcgacggtggcctcgacgacgagcacgccctggtcgttcacgtggaggaagcggcggccgtggtggtcgacggcgaggcggccggcgaggtgagggtacgccgcgacggccctgaggaggccctccttgatcgcctcgttcgacggcgccggcgcccggtacgcgagcacgctgggtacgtacaggtcgaacgccgcccggtcgaacacggtgagctggacctccgcgccggcgagcgggtgcggcgtgccgtacaccggcgccagcatcgccgtgcttgtaatcttcatcttaattacacctcgtcacctcgtcttaattactttggagtggcatgcatacaaccgcttatatagagctccgaactatatgtagaacagtgtgtgatcaaccacccccagtacatttattttgggctatttatttgtacacgtcaagaccaaaacgagagtaggtatcaaccactccgcttataaaaatgactaaattcaaatcaatttgggaaataattccatgttctaaatggggaaagtattctaaactcttgagaagacaccaattcttgtttgcatgccactcaaatagttatgcaaaaatttgaaaaaaagatcaacatgatagtttaatatgtgcttgatcattacacaagcatgcaaaaataaaatttaacttcaacatgttgcaacgaaaaatacactaaaattcaaatcggtttaggaaataattccatgttccaaatgggtttagagaagaggagaacagaaaaaaaggaaaaagtacaccgaaggtccctcaacttctcatcgagttacaaaatcgtcccttaaccgcaaaaccagatatatcacatctttcaacttacaaaaccgttcactttacatccttttgtggttttgatcccggttttatctaacgtggcggatgagtcagcgtgagacccacgtgtcaggtaccacgtcatcactctttctctttcccctcttctatcccttccttctctctctaatttctccttcgtctgggcaagccggcgggcggggcgaggtgggagaagaggtcgggcggccggcgaccggcgacgggcgatgcggcagcggcggccgcggcggcggtggcgatgacgacgacgtgggaataggagggccgccccctatgccgccagcctccgtcgcctctccaccagctcccatggatgatgacggcggcctcctcgctctccccgttgcgctccccatcggctcctcatccttcgtgctccgtgaggacggcgtctcgcgcgccgctgacgaggctgccgccccgcgctgcttgccgctgctgttcgatctgaacctgccggcctcgtccccgtcggctgctgccgccgccgaagtcgacgagatggattggtgttgcgacacgctgctccacctctagcctgcacatcaccaaacaatggcagcaatcgccggcgaactctagcctacgacgacgacgacgacgaccaaccagcaagcaacaagaattggaaatttgttactgggttgctgcgctccaatccaaccatcaccattgttgctgctgctactgcgaagaagctctaccatctcctccatagacacggataattttctttttattttcgttttcctccatctctttttcaccactcaagatttcgtttccgccgcctctcttgtgcatctctgtatccaaaggggatgctgctgctttcagctgtaccaatagctagaaaatggtagagaagatgataaaatttggttcaaaatttgtaacgtaaatgttatcggaagacgacggggacgaggcgggcaggttcagatcgagtagcagcggcgagcagcgcggggcggcggcctcgtcggcggcgcccgagacgccgtcctcgcagagcacggaggaagaagagccgacgggaggcgcaacggggagagcgaggagaccgccgtcgtcatccatggcagctggtggagtggcgacggaggccggcggcgtgggggcggccctcctgctcccacgtcgtcgccgccgccgccacgtcgcccgtcgaggtcagctcagccacgagagagagaacgaacagaggggcgggcgtcgattgctcacagtgtatcagaagcgtgcgcgcggaggatacggtgaggaggtcgacgagcgacgaccggaagtcgaacacccgcgcctgcacgacgatggcctccacgaatgacgcgtcccctgcgcgcgacgacggcctccacggtcgcgcccacaccctctcccctcctccatgcttctacgtcatcgtcagcgccaccggcagcagtagcctcttctccgccggaagcggtggtggtggtcaatcaccgaagcaagttagctagagtcgatcggctcggtatttgatttggcttcgattgcttcgccgcgtcgaggccgacggatgagggggacggccgccgcggccatccgcgcgacggcatccatcggcggagccgcccgtcgcatcggccctcctctctgccgcgctccttccccgccagccgccggccacgccggctctcctccccgccgcgtcgaagacgccgccaccatccacgcccagggaaaaatgagagaggaagggagagaagagggaaagagagagcggtgacatggacactctgacacgtggggcctaggtgggtcccacgctgactcagctgccacatgagacgaaaccggggtcaaaaccacctaataccttgaggttttgtaagttgagggatgtgatatatctggttttgcggttgaagaatgattcggtaactcgataacaagttgaggaaccttcggtgtacttttcccaagaaaaaaaagaagatgaaggcccgattcaaatacggcccaatataagcagcccaatgttcaaactgggctgtacgatcagcgctcgtcggcccagatctaggcggagggggaacgtgcggggggcccacaggccgaagcagcgtcttctccacaagctcaggctcgcctcgccacgccatggccttgtcctcctcttcgcacctcctccccttctcccggcctcccgcgaccttcccacgagcacgccacgccggcggcgggaggggccgagccggcgccacggggaggttcatagcgtgctcctcgccccctcctcccgacgtcgtggtcacccgcgagcgcgggaagaacgccaagctcatcgccgcgctggtttggttcccaaatcgacactcctgcattgttcacttgtacctaacgcatagtttttttttgggtggggggtgaggggaagcgtaggggattaggggattagcaatagagatggagaatacgcatcttccatttttgttttgtgataccctgtgagatcgtcgcgtattttagtgttgtgattttaggtggcctggccgactgtatagagggaaatttacgggctaattatactgtttaggacccgggaggctcactaattggtgcgagatttcagttaatgtactgatttccatctaggaaaaggttggcgtgtgctggatatgagatatttggtgctaactcgttgaacatggtgccgcgtgctaatggaactcaccattcatgtcttcaactggtcggagcttggagtttagagttagttgttttgcaatacagttcagttttatctgattacaaatgcaatgcaatgctatgttatggaaaccatttgtcattttgttagtatcagtctttcatgtaagaacatatcccttctttcatccatttcatatgatacaagttgggcatatgatctgcattgcctattttattccattagcttagagaagttttgtggatggtatgacttcctctctttttttttatgatcattgacctaataactttaatctactattagtttattatcttggatcacagtatatgagatctttacctttattctcagctgttgtttagcgtctcatgaatcacgatacatcattaatacggagtgtgaagtctgaatttttctgatcatatctagccatattctaactgctatacgtattcaactgggccatagatggttgttactccaatggatttgagaacattcctacattgtaatacttgtgaaaaggtccaattgacattagagtaatgcaattgttaccgcgtgccttgtcgaacagtgtgctaggttactagacttgattgatctctgaagggcccttggagggagtctaatgattttactcaatgttctgataaaattagagtctttgcctgttgattgtgtaatggaagtaatcttttgtgtgttgggtggtggggtcttcatccatcttaaaatgttgtaagcatgcagagtacatgttaaagtaatcatgaatgtgctgctgcagccacctattattttctcagaagaagattcaatttgtgttcaaaaataagcagtccttttgtatcatccagcttattgctatctagttttcacatcagttttctaattgaattttgtaggaaaaacataatgtacaaagtcttgagcttcctcttattaaacatgttgaagggccagatacagataggctttctgctgtcctgcgcggtaagtagttcagtctttatttttctagtaatataactttatgtgtttctgtcttgcgttgtatatccattgctccacatatagtatattctcattacacttgctttgcaaaatcataataaaagtattccatagtttagtcacttaatattttgtattttcagatgaaaagtttgactggatcactataacatctcctgaggcagctgctgtgttccttgagggatggaagtaagattcaaacatatttcaattatcgtgcgcaattgctacagaaatataaattgtgcatcatttcacacttcattcgtcctaagttctgggctttgtggcataggtttgtgcactctgtgatttgcttgttgtctaacccaatatatgatatgttcttcaatcaatccattattctgtgatgcaccagaacaatccaaaaccaccatattaacacaagttacataacgacctatcagggctgctggaaatcctaaggtacgaatagcggttgttggagcaggtactgaaagagtttttgacgaagtaattcaatacaatgatggatcccttgaggttgcattttctccttctaaaggtatcttgcctcataggatgtaattttcattgcatgtcaactaattcgtatggtgctctcatatattgaagacttggaactgttttcagtcagtaaggtatttctttttcattttttttatttcatcagctatgggtaaatttttggcctcagagcttccaaggaccactgaaactacttgtaaagtgttatatcctgcatctgcaaaggctggccatgaaatccgtgagtcagatttggttttatccttctggttacatgcttgcacctgcatttccacaatgaccacatctgcatcatatcttcagctgttatgttaactaattatgcggattgcagagaatgggctatcaaatcgaggatttgaggtgacaagactgaacacatatacaactgtatgtttttcttttaaattaaattattacatttgccttattaattcttatttgcttactttatatgagtaatgtgaaattttggccccttgtcttgtgcactttggacctcgttctatttatctgcattcagacatcccttacctgatagtatcatattttagcttgatatggttgactgtgacatatgttaccgtagtagaggttttgtatttcaagaaacagtagtaattttcatggattacattttatcttttcaaagtttgtgtgcacgtgaatcttggatttttgttttgacctatgaaatggttgtatatacatgcaggtatctgtacaggatgtcgatccgctaatattaaagcctgctctttcagctccagttgttgcagtagcttctccttctgctctccggtaatatataatgtgtctatggctgcctcggaacaaatttaaaaccgtgttcatataataataatggtatgctagtactccctaattagatggttcaggtaaagtacgtatgtgggagagatcacaaattctgcattgaaacattttttttttggaatacgcaagagatttgtgtaccatttcattaacacggggctttgacaaggttggggctgatttctatttggacgtgtttctttatgatccataaaggggtataccgattcaaaggcacacaaacagctttatttgccatctcagttatttgcaaagctagattatttgcgaactgtctccctgggctgactttatgttacatattaccatcacaattttccttttccacagtgcttactttattcagttttggggttatcatgatgatgcagagcttggctaaatcttgcttcacaagttgacaactggggcaacgccattgcctgcataggcgagacgactgcctcagcagctaagaaatttggcctgaagagcatatattatcctaccaccccgggacttgacgggtaagcacacatcacgaaccttttgaataccattatccaattgtcaaggacacgtctgaatggtggacattcagaactggtatcaacacagcgtcacatcatatgttgtgaagcaaaattgactactgtatcatccatatgcacaattttcatattgtttttcacaggtgggttgaaagcatccttgaagcgctcagagcccatgggcaatcgaaagaggtcctctctcgtcctcgtggatactttccttgaatttctcagcttctttcgtcacacttttttctgtttctactgtaggccccagggtgttgaacttgaagacgggcaatttacttgtaccagatgctggaggttggtggacatttgtggcggctgcatattgaactctgtgcttccttgactaaccgatcacacactttttgttgtttttctaatataattgagaggagaaaccaagtcggcaactactgtagtagaactacttgtaaattgtgagctgtttattgtagctactgaacacggtgcggtatattaccagtgttgtaccaattgttgcttagtttataccagtttggcacaaaaaatgagccctcctccaaaaatatggaaatcaatgaatgcaagaggctcttgtactgggctttactaaaccgcaggtgtttctcaggtcagaaggcccaaagctgcactaggccattattaaggccctgtttagttcgcgaaaaaaaaaattttgggtgtcatatcggatgtttgactgaatgttggaaggggctttcggatacgaatgaaaaaactaatttcatagcttgcctggaaaccgcgagacgactcttttgagcttaattaagccatcattagcatatgcaggttactgtagcacttatggctaatcatggattaattaggctgaaaagattcatctcgcgatttccatgcaaagtgtgcaattattttttatttttatctatatttaatgctttatgcacgtgtcaaagatttagaaagtaaaccaggcctaatatcaatatatgtcttctcataaatgtgcatagatttatcagtcaacctgagccgtccttgtcctcactccgagagagcatgcaacgcttcgcagccgcatcataattgtggccttcttttttttttttttgacacggtcagtgccgtctactgcagaatctccagttaagttgccgcggtgatccgaatgaactgaaattgattgccacgacgacttggcaatgccacggaatctccgtcctcttcacctccaccaaacctcttaagagattccagcgtttgtgtccaccacgcaagaatcttcttcctctcggagacatgactgactgcccacggacaagtgcactaatgatcaatcaaattatgaaatgaatgaatgatactctccttcgattgcgttaatatctcgctaatctccgtggctgtcagcatcctaaacactgcaaaaacagaacgtaacaaaggtcgacatggacaatttcttttagtttcttttgttactcggttagcacttacgtacggttagtcgtccaccccctcctggacggaaacacgtccatgtccagctaacgtcgacgtctctattgcagatttgtaggtctaaccctcctgcttaactaaccaagcgccgtaacgaaaaccggcgagcttcttcctccaccgccgccggcctctgcaccggcggcgacgagccggagagagccagcgtctctcataaaaggagattaaaagttactacctccgttttaaattataagactttttaacattgctcacattcatataaatgttaataaatatctggattcattgacatatataaatgctagaaagttttataatataaaacggaggaagtactatataagacaacgatagtagcagctttaggttcgcgaatatttatatcaaaatctatggagaatttggcttctctagctatcctgttggatagattcgaggccgacttcacctcacaagagaaggaattaatcaactagacaggaattaattattaaagatggagttgtttaaccagcaacactgtgtcaactccctgtacaattaagtactaatcagtaatcacctgtactagttgttactgattacagtattactagctacgtggcacatactgtcactgagatgctgggagcctgacaaaaaaaacagagcaatcgctgaaaaaaaaacaatctccagtgcatcgtttttgtctgtaatatcctagtggtaacttggcaagagtgatcagtgagtgagtagattctccttatcgcctcgtagctcacggtggttggagcgttcagatcaacgtcaactgtctgtttctctgaatttgttggagtaaaccggagatatatatatcccctcctaaacctaaatgtggtcgttgcgaatgaaaggattattagcataggatgagttgttggagaaagactgcattggaatcaaaagccaaagtacagcagttgtgccctccatttcttcgcaatactgcagtgtaggacagaaacggagttcttttttttttctttttgaaagttcagtttcatcaagtgattacttaagtagtagtactagcatactgtatatattaggttttattgagtgggattaatttgatttgacagtgtgacagctaaaagtacgtatccctccgtcccaaaaaaaaaaatcaatcccaaaatacgtgtccagatttatagctagagtttacctttttttaatagagtagtactccctccatcccaaaatgtttgacgccgttgacttttttaaaaatgtttgatcgttcgtcttattaaaaaaacttaagtaattattaattctttttctatcatttgatttattgttaaatatacttttatgtatacatatagttttacacatttcacaaaagtttttgaataaaacgaacggtcaaacatatttaaaaaagtcaacggtgtcaaacatttagggaaggagggagtagtatattgtacaataagagtcatctcaaaattagacggatacattatatataaattttgaaatatatatacaagtgttgtgaaaatataatgttatctaaaaataaaaattgaatactaatattaaagagtgtgtaatttcattgccaaatttttaaatggacagattttaaaactaaaggacagcaaattttctcggccgacaaacaccggacactaaaaaggggagggagtacgatggacatggacatctgagaaccggaaagatcatatttactctcatttgttcaaatttgtcatgaacagtaggttggccgtgctactgaaataattgattcggccatgatttcgcaatcaatcttgaacggcagccaggagctaagccatgagagttgagacccactgactactgtagcttaaagctactccctccgtccaaaaaaaagactcaattcctgggttttcgtgtcctacgtttgactgtccgtcttatatgaatttttttcatgattagtatttttattgttgttagatgataaaacatgaataatactttatgtgtgatttatctttttaaatttttttattttttttaaataagacggacgattaaacgttagacacggaaactcaagaattgagttattttgggacggagggagtagtaagctactgctcttctgccaatcaaaatggcacacatttatgcaggcaggcaaagtatccatccatccgaggaccacaggggaaacattggaaatgtttcgaaggacaggaaagattgctacggatatcactagcagatgaatgagagatggaggggaaatatttggtagcgagcatgttcttggtttatcgcttcactgcgcaataagtttggtatcgtttggaacgcatgaatttcatagggattatcctgaaaacgtcgtcacttgaaagtggctatgattgagacatttttataaaaattatgtgttctaaattagtagcagttgtgcgagtgagtgatttatgactgatcggatatactccctgaatttcataattaaagatgttttgtttttgttttcatcatttgtttaagtctaattaagcttattacaaaatatagtagggatgtgcttctatgctctgcaaaaaaaaaaattgcacgaaagttaaagctaatcagcggctatgattaaaagggagattagcacttaattatcattagcgaggggtaatttcgtccaaagatttttgagcccatatccagcccagtccatctgaagcgatccccacattctaccagtccaccacggcaccgctcctcaaccgcaccgccgcgccgattttcgccttgccgtcgttgctctgccctcttcttcagttaaaaggatacccgagcaggtatggcctgagtgacagtaaattcagtttcagccttaacttgtctcctcaaagatttgccttcaagttacagaacagagtcaatgccttattgctgcaacccgacttgcaaatttggttgtacatatacacatctggcacaagcttcatatttacaagtaccataaaaacctcatatgcagtctaagcgctgccacttttcaatagaatcgagagaatggcattcgtaataggtgacgatggttgggcagcgcagccgacgcgcgggttgtggaggagtgatggcagcgccgacggtggcggagggaggcaggaagcggcgtggggagggaaccgggcggcaaggcggcgttgcgaggggaaaaagaaggcagagcagcggcggcaaggcgaaaatcggcgcggcggtgcggttgaggagcggcgccgtgatagactggtaggggtggggatcggactgggctggatatgggctcgaaaatctttggacgaaattactcctcgctaatgataattaagtgctaatctcccttttaatcacagccactgattagctttaactttcgtgcaagtttttttttgcggagcaacaaattaatttcattaaaaccataactgaatttttagagcatactatttgtttagtgttaaatttttgtctattttttctataaatttaatcaaacctttaaaagaagtttaacttaagttaaaatcaaaacattatatatctatactccttttaaagaagacaatgatggtgacggtgaatctgtccccaccaactgttgtatggagttttttttaaccaactaccccttcatggtttttaccatctactacttcatgtgctctaatattacaaaatttcttttatatataattctatctatttcattcctgtaatacaaggttatgatacaaagacatcagcaaggacaaaattattaaaaaacatcacaattaatttgttctaaacaatattaacgcagagataatttatttttaatccctagcaaagcatgggtatttagctagtattcaaaaatagagggagtatgtgggaaatgtggcacatgccgacatgcggtacaatccaatgatatgattgataaaactaaattgcaattgctataggatgaacatgcatatctcttgcacaaatacgtcgctacaaattcttagtagcatgtgcttataactatcctataacctttatctgcttttggaagttcctatcacccatatctagatttataagtactttttggtgacagattccctaatagttctttctcatcctgtctggacaaaaactggttgagaaaaagtatgctacatctctgcactttcgccgtgtactgactggttttgatttttcctggctctgaactctgaagtttagagacgacggtcgtcacatatcagaaactgttgctttcccaactgctgccgttccaaacaggaaatgatagatcacttgccacattgtctgtagtcttaaagaaacaattaaaagttgtagataattaattaggcttgtgactgcaatttttctaagcttatgaatgctctcggttgtagtcgtcctcctctgtcggcaaagcatggcataaattcgccattatcttgtggcatgacatgacagcagcttatcaattctgaaaaaatggcatgacatgactgtatactgatattagaaaacattatggccatgattagttaaaaaaaatcacgctatcacatcaaatggttggacacatgtatagagtattaaatataggaaaaaaaaccaattacacagattgcgtgtaaattacgagacgaatcttttaagcttaattgcgcaatgatttaacaatgtggtgttacagtaaacatttactaatgacggattaattaggcttaataaatttgtctcgtagtttcctggcggaatctgtaatttattttgttattagactatgtttaatacttcaaatatgtgtccgtatatccgatgtgacaactaaatctaaaaattttccctagctaagcaaggcctatgttggtaattgctactacctccttcaaaaacagttttacttttctacacaaatatggatggtcacatccaggttttttagaacaataaagatttatttagagggaggtagtacttaccagccgcgtccatgtattaggtagtatgattgtgagaaataaacaaaagaacatttcttttttttttacaaagtatgatattccttctattcctataaatattatgtacatatagttgttatatcaataataagttaataagatcaaagagttatcgttggtctatgttctttaaacgtttgttaggaccatattcacaggtacatgagcgtgcgtgtgtatctttcgtgtaatgaatatggatgctttaaaataggtgtactctacagtatagtttgtacgtgcgtgaaggtgcaaaccggcatcagctttggagtgcaggtggtgttaatcgtccacggtcggtaactaacgcctcgattagtcaaaaagtttgcacggacaatccgttcactgtagctaaacacttagcgctttgttgtcattgatgacatccaaaatcacctaatcaattttttatatatatatcccgaaaaaaaatttgtatataaaaaaatactccctccgtcccataatataagggattttgagtttctatttgcactgtttgaccactcgtcttattcaaaaaattttagaattattattttttttgacttactttattatccaaagtactttaagtataacttttcattttttatatttgcacaaattttttaaataagatgagtgattaaacagtgcaagcaaaaacttaaaatcctttatattatgggacgaaggggtactatcaacccatgtagtaccaatcaccatgtgagaccgtgcaactgtgcaaaaattatttttgtttttttcaaacacaaatgtaatgtaatggcaaaggctcgtaattagagggtgtttccaggggcaaaagcgggagggcgctcacccaagcggaaagcgacacggcaccacttgagaggaggacaccggccgtgcgagcgaggggccccaccgtcagattccgcggggccccgcatctcgatgtccacgtagcgcaagcagccgcccccggcgcgggtgttattatatgttcaccggaatctctagccacccggggtgggacccaccggtggggcccggtggaagtggacgccaggcgggtaaggaaggggagccggtgaggaatccgcgggaacagcgacagcgccgccaggcgcgaggagattccaccgttcgatcgacgtttggtggacacgtgtcgaccaccgagacgagctgaggctgctcaagcttgacacgatcactaatttgataaaaaaaaatgtgtcacgtagtacacgtatagtgtgaacgtgtggtaagctttgattaggaattgagtgtaatgacacatgattagcaggaaattagtgtttttttgtgctgaagggttaaacagtggaatgattaatttgtggtaattacgatagtataaacaaatgacttgaatattataaatacacttaggttagcaaattatggcatgcttaaaagatttgtaaattgtttattaaactgatgctaacgcttaaactatgtgtataggggggtaaaaaagccgtggcgatggttcgtgttaagcaaagtagcttttgactatgcatatctgcacctaaattattttcctattctgccgtttgagtcgtcatgctgcctcttggaacgggagatagtatcatgcaaaacttcggaatgggaattcagctcattgttcaatgccttattttaaattttgttttgagaggttttccttcgatattaattaatcacggttaatggggaaaagttaataatttttaacacgccgctaaagtatgattccaccattttaggaggacttgccctacctcttacatgtaggtccaccaaaactacgacctttggattgaaatggcttataactcaaagagcctgttcagtagttctatttggcagccagctgctacagtgaaatacatagaagatcaatagtagcagctgcagctgcaacggatgtgcagctgctgtatagggctaccgaacaggcccaaagtttttaatgtataaggtcctccaaacctacaatatttatttgaaatctatatggtccatcaaaccattgttatcattcaaaatggttacaacttagcaactttatgcttaggatccgtcaaacttagcaactccgtatgttcatgatttatgaaacctatagcatcaattcaaaacagttacaaactcaactacccttatgtaccgtaggatcaccgaaccaatggagtatgtttgaaatagctacaaatcaaaccccttacctgtggagttcaccaaacctccatcttcagttggaaacaactctaacgtacttaatacctcttatatatacctcttatatgtgtaaggtccaccaataacacattcaaaataatatacagcttaccactctccttacatgtaagatctacgaagtctacggcgtcgattcgaacacaactacagttttagtgggatcaccaaaccttccacggtgttggtataaaacaactacaactcagcgcccctacctgtcacgtgttccatgtcatgtgggatccaccaaacctacagtgttggttcgaaacagctacaactcaatgccaattttgtagggtccaccaaaactacgacatcagtttaacatttttttatataaatgttaatgctctaaactcatggtgggagacctcccctaacttatattgagtttcacttttttttttgcgaggagagttttgtgcatatcttttcacatatatatacttatttaagatgtgaaggaaagatggacaactcaatttatcaatgtggttacgatttgacatattgtggtatgcctagtcccagaaagtggacaaacaataattgcaaaatgtttttatagcaaacatatattgttctgaggagaaaaaagggggtcctgcggaggtatattacaaacagtacaaacctctatggggaaagcacatgtgcatgattggtcatgtctcatgtgggtagtttcttaaagcgattttgcatgacagaaaacagcttgaagtagggttcatgccacacacacaaaaaaaaagacacataatattcttttgttttgagccaatgtcgtatgacataaaccggcttccaatgaaagttgacgtgaaaattaaattaatagaacagccagaagaagcatggttttgcttggctaatgctgatcagggaatctgtcctgaccaattgtaatccttggaactcttaatatggtagtattctaaccaaggccagatcaatgatgcttaaacaaattaggaagaagattaaactttaaagcaagcagcagcgattagtggcgagcacgatgcatatggccatcggtatacagtggcatatcacaaaaagctcaataatactgtgtgtcggatcgtgatgcaaatgcttcttgggcccaaaaaagggggaaattaatcaatcgtggtttgacaaaatgatttaaatttctaacctgaaggccttaagcattattggtcttctacctgatgaccatgaacatgcatgacgattaattcttcgccgttgaaaaggccctaattaagcatatattgacgatttcaatataatcaggaacatgtattgaatatacatgtacacggccaattatttctgtataattatgttggataaatatttccaatcagaaaacatctctagttgttacaaagtactgcctctattgtttcacaaacaatttgtctattgtttcagacattgactactacattttttatacgattggacaaaccaaaacacctatggctttgcagcaataattggccttatatgtatacatggagaagacgatggagaaagtagtagtagagagtacgtttacatccaactacatggttctgggtcctgccagaatggacgcattggtccctgggctatatatctctctttcaaaggcatccaaatctatcaatttggatgatatgctgcatggagctaattaagctagcatgcaaacctgataagctagctatatatgcttctgctttgaggagagtgcatgaaatgcaactcatgctactgtttttttttttgtttctttggtttttttttaacagcattgctatacgaatgatagctactgtcgatggaatataggtctttagctagagtagatggttaattaggacaatatagtgtgattatatgtagttctagctactagcgtgggataatttattgtcaactagggacaagattaatgctcaatctattttgggcaccacattcagattccattaagaaaaaaaaaactacctgtattcaagcagaaactttttttttttacggtaagttccttttctagaaaacgtgtccatgacacatttaggcgtaatggctaacaaaaagtgtacagcaaatcaacaaaacactaagctaacaatagatggtcaaacttgtgtatgtaacatatttagtatataatcattttttccaactatatacaaattaaagtcctagggcttacgggaaaaaagtgcctgagatatatgtatgtatctctataagaaaaattgtgctcagttatgtttcaaattatactactaatatttctaaactccaaaatgtgtctcatatgaaaaaaaatgtgattccaacaacatccatatttctaaaaatcacataaaaatgtgatttcctatggaaaagaaaaatgtgattcctaacccgcatcacccgaatggtagaataataattttttaattatataaaaacccctcagatttctttcccacataaaaacaaccgaaatgtaacatatttttcttttttagaaaaagaaactggtttataccttcttttaggaaaaaaatgaatatcttgtcgatgttttctaatatggtttgttgggtatatttgaagtaaaccaaaccattgagacgaatgattccaagtttttatggattaaagcctttatttgcccataaaagtttacatgttctcttatttgcccctgattgtattaatggtgtgcgggttcagccatgtgtaagagataccaggggcaagtaaggaatcccaagaatttgccaatagcaactaaggaatcatccaattttttttgtaactatggttgtaacgttttgtcatgctatccatagcattaggcatctaatttgacattagagctgaagtttttgtttgctactactccttacttcttatttttgctagacagcgctttatgccatttttttttgctaagctatgtttttactttcgtgatgttcttattctcgccaaactataatctaccatcgtgatgcgtatatcaattaaaatgcaacttcacatgttgcttgtccaataatacgtaagttgaggggttcttgttttcttaattggttgcaagcgtattctcttcatcagatttataccaagataaaatttgccctccttctttagtgaccgacaatgccatagaggtgctgttggtgaatgtagccagaggaagcatgccgtagtagtctagtagagggaggcacacgaaagtgtgcatgaggcggcgtcaaggatgggaaggtggtgtatataaggggggagaattaggatcgatgaatgggtatctagcggtccaaaagttggcttcttaatgaaaaaaggtgctcaagatatatattatatccctataagaaaaggttgtgttaatttgtattttaattactccattcaaaatgtattatgctatgaagaaaatgtgatccccaacccatattcatacttctagactcatacaaaaatgtgacttcctattaaaagaatttcttgtagaaaagaaaaatgtgattaccaatgttagcaccggagggtagaccaacatatttttgaacatatatacaaagccctagaatttcttttccgcactaaaaccaaccaacactcatcacattttgtttttcccctttcaaaaccattcatttttccaatttggtttccttgagaactttgaagggaagtgagccattgaggttgttgatttcaattttcatggccaaatgatgatggttgcaacgttttgtcatgctatatgtatataattatacatctaatttgacattgaatgttgtccaggaagtggtgttttcaatggtgcacgggtgagtaacacgtacgaatctgccctaactttgttttgttcttacttttagtaggtggtagcatgagcggtgcggtgagaggaaacgaatggtaggacaggaaggtgtagggggtgcgcgatgctaacgtaggaaattgagtttagccgtgtatagaaagggagaaaaacataaaactttagctaaagatcaaatcacaaaatcagcttttaaatataaaaaaattatcagacacctattattccattcttcttttagcaaagtttatactattcttatttgtgggctcactcaaaaatgttgatttcaagttgggaaaaagaacatgtgattcccaacagcagcagcagcagcacatgggcataagggtaatttttttcccaaacctcaatatgtccttgggaatttcttttcaacaccaaaaccaaccaacacccaacgcatcattttccttaccttttcttttctcccctccctcccttctttttcttgcctctcccctcctctcctttttatgttttttttcccattttttcttccgtggattcccatggccaccacagtgaagtctcggccgccgccaccgccaccgccgccgccgccgcatgccctccccgccgtgaccacccgccgccgcggctcctcctcctcttcgccggcggcggcgaaggcttcggtgttcttgtccgctcctcggttagtctacccactctatccttgtttcttgcttctggttatccccggagcaaataatgaaaccgttttacccccatcttgtttgatgttgctcttcacctcgagcttgatccatggtgagagcgcggagagataggaaagctttgaattatttttttggggttttgttttttttttttttgttttttggttcttgtggttgtttttgtggaggtttattgggtgctttagtggtgagtagtaaccacttttggctatttggcgatcaacctggagttgttcctgattcttttctgtgtttttttttcttctttctttggatttcttgcagggagttgctgcttgttctttgcagcctcttggtggttgctgtgctgttcgtctcgtcgtcggcggcggcggcggcggaggatggtgcggaggggagtgatggcgacctcggcggctgcctcggtttccgggatggctgcgcggaccggagcgccctgtgcttctcgccctcggcagttgagtccatgcttgcaagcgaggatgatggagtcaaggagatggatttggtggtgtcgagagactggggaccaccaccaccaccgtcgttgggcttccggttgcccggccaccgcggcgtggtgacgtgctcgtcggcggcggacgcgctgatcacctcccggaatggggtgggacgggaggatggtggtgagaggtggtataatgtggcgtcgtgccaggcgccccttgtgcctgacaattggatgcgggcgatggccggcgcgacgccggagctggatgccgcggatgccagcaccgatggcattttcggttcgtcgtcgttggatgttgagattagcccgccggtgttggattgggggaagagtagcttgtatgtggcttccatggccaccctgaccgtggtgaatttgaacaatgacagtgccttgcgcgtgtacgagccgttcagtaccgacccgcagttttatgtgtatggttatgatgatctggtgctgcagcctagagagaatgcatcagtcaccttcatattcttgccgaagttgctaggctcttcatcggcgcatttggttttgcagacgaatttcggtgggttcattatacaggctaagggcatggctgtcagatcaccttatcagttggagccactagctgggatggatgtcataacaggtggacggctggagaggaacttgtcgatattcaacccttttgatgattctctctatgtcgaggaagtggctgtttggatgtcttcattccagggcacaaaacaatcttctcatatagtttgtcagttaggcccttttgacgagtcgttggagtttacttctttgagtagcaactggtatacagcaagtagtactgaatttggattgccgatgatccatatcaggcctagtgagcaatgggaggtgcttcctacacaaagcagcactgttgtagagttaaaactgcaacctctttcagaaggaatggtgttcggtgctatctgcatgaaattacgcaattgcacatctgatagagtagacactgttgttatacctatggagttagaggtgcgtgcacgtacctaccatgaacccactaacttagtttcggtcacatttgagcgtgtatcatcttgtgctggagttgggtcaattatttccctttctttaaggaatgagggaacaaagttactgaggattgtaagggtaactgaggataacagggatggatcaaataattttgaggttaagtacctgaatggactgatactctttcctgatactgtaacagatatagcgctgataaaatatacttcagttccaacggataactcatttgacaactgcaatatagtggtagaaacgaacagttctgttggtagttcaatcctgataccctgccgagatgtgatatctgcaactctttcttatacggctagcgctgttactgaatctgatgggccattttctgaagatgagttatctgctaactcaaggacaggatctttgggcagcattgtagaagtaaaaggcctgcaacacatgaaggtattcccttttgcattgttgagtttgccaataagtagcctatgttgtctaagttgatcttatattgttgttctatcagcattggacttcgagttttgttttcccttgtttaacataacttctccaaattatgtactcagtgcatatgaatatgatataggaagctgataatggtagcacctttcatgcttcggcgctgtttcgttatattttcagtcccacaaagctcatcctttgtcgatttgttgttcctatgatatcttaatcagcaggaagcggcatcatttagaatctcctgggcattattttttagaaaagaatctttttttcattaatgggaataagcttattgttttctattgtgtgctggttacatcattaaggaaaatatttctgatgcattgattcaagttaccaatggtcctatatttgcattatggcctaaattggtatgatcttgagatagatacctgtatctggataatatcttcgtgatcacttcgatgcacttatacaatgaattgatcatataactatgttgtgcatatcaaaatggaacactaagacggtattcttaaacatttctccacttgaatttcttgttgtgcttatataattaaaaagaattgatttcttatctcaagcaccttttcacttacaaaattttccctgttagtcttctcatgttcttttttttttaattgcagccaacaattacaagggcatataaagctgatgatacagtacttagaagatggagatctcatggtacaagaactgggatttctgttctcacagatcaaaaaatgctgtttcctattgtccaagttggatcacagttttctaaatggataaccgtccataacccaagcctagagcatgcatccatgcaactggttctgaattctgaggaaattattggtcagtgcaaaactataaatgatgcatgtgaacatacattctcgagcaggtcccctgaagttgactcaacagagactagatttggcttctcattaagtgatgcagcaatcactgaggccattgttggtcctttggagagtgctttacttggtcctatcatcttccgtccatcaaatcagtgcatgtggtcaagcatggtgttgatcagaagcaatatttcaggcatggagtggctgcctcttcaagcacatggcggacggcaatctattgtccttctggaggaatctgaacctgtttggaagctagagtttaacctcatttccgatattcagaataagtcagcattgtctaaatcagagttcaccagccctttgtgcggtcaacatttgtcgaaagaaatacatgtcaaaaatagcggtgaccttcctcttcaagtgacaaaggttaaaatctctggagctgattgtgctgtggatggattttcagtagataactgcaagggatttagcttagcgccaagtgaatcaataagaatgcttgtttcttttaaagctgacttctcttcagctatggttcagagagatcttgaattggctatgactaccgggattttcataatccctatgactgcaaacattcctgtttgtatgcttgaccagtgcagaaagtcgtacctcagatccatccattggaaaacattgatattcctttttggaactgtatccgtgtttgttctggtgttcgcgagaggtgtcccaacttctttgtcagggggctctcaagattgctatatcaagattcatgatgggaaaggtaccatcgacaagcctgttaagccctctttccttcagtgtagcagcaaaacttccaggtaaaatttagactaatgctggccgctctcgctttctttgaattttacatggtttataattcggtatggttatgcctatgtaaacaggtcaacaagggagcacaaaagagacaaagaaactcataaataccctgcggatattcataatagccccaagaggacagaagacaagaacaatgcagatgaacaactgaatacaacttcaactatgtctctgccccctagtaatactgtggaagacaaggtatcaattgaagctccagaaactagtggaaatctaaccatcagagttgctagagacaaagggaagagaagaaagaggaaagtcggtggcgcaggactcgcagcaaagtttgaggtttctagcagccacagtgggaattcgacaccgtcttcgccattgtcacctagttcaaccccaaaacaaagctggtctttctctggcacaccatcagaactgaagcacagcagtaaacttgagaatggatctgacattgaggcaaggccaccatctgctaggaataaccatgagaagagttcttggttgcaaactgctaaagagcaacctgctccaccaccttcagtaacatcaggaaatccatcgccgtcgccatcgccttcacctactgcaccaaccaatgcatggcgctcgccattgttgtcctcgccttccccgatcgcgcctcgttctcgcgctcctggatccaacctgatgaaagataaggctgtgaagagaaccgagggcgccgcgacgacgacaacaacgaggaagaaagacttcacatatgacatctggggggaccatttctccggccatctgctggggaaggcaagggaggtggcgccgccatgctacaagatgtttgctgcttctgaaggcgcctccaatagcttcttcgcgagggagccccaggccctggtgacgaagccgccatctccatctccatcttcatcttcatcttcttcgcctccggtgacccgcggtcgcgggtcgctgccgtccgatgtagcatctggttatggaataaattaagaagtttgaaacatttcggccctggctctcctctgcatcatcctgcattcatctgctctgctctgccgttctgctaaccatgcatgccctaacttcttcagtagcttaaaacttgcaaaggctaaagaaaatcgaagcaggctaaagctaacttttttacctcagtactgatggctacatgtttaatctgatagtcacattcaacaaaactgaattttttactgaatttccgctctactagaacattcctctgctctgccattctgctaacctacactaacttcttcagaaagattaaaatttgaaaaggccaaagaaaatcgaagcagggctaaagttaactttttttttcatctcagtactacttgcattgtttaatctgacagccagaatcaacaaaactgaaagctttactgattttccgatccagtgcacgctaaaggcttgtgcatcattgccctaaactaaaagtactttactagtgctaacttttaaccctggggataatttcgcaatctgaaatttttatgtacatgagcgagatctggacgcattttatcgtcttcccggtggacgagatgagtttgctccaacctttgcacattcaactgtcagataatgcgtttccagctcaagattctaaagctgacatctcacttttagtccaatccatatgacgcaatggaacatatcttgcccgcccaaagcatgcaggcctctattttaatggacgatgcatgtcaattcattagttcccaaaaaaatcgctctttgtataatgcatgcagattagcctgaaagttagatgcgatatgcttcgcttgtggattttcctcccttggtgacattcatcgtagtcttattttgcagactttgctttcaaaccggtaagaatggagatataaaagctttacctaaaaatgacttttgatatattgtcctatttgcctttgtttttctacggcttatgaactgtaccaagctagctagaactttaagaaaaaatagcttatttccctgtaatcggttgctttcagctggaattgcagacactcgattacagagccattgacaacatgtatgggagtagaattcaggtaacatccaagaacagaagaacttgttcgttctattgttattatgtgtacgataatagccagtgactctcagcacacacacatcatcatctggcaatctaaaactgtgttatttgttgcagtcttgcagtgcatgcactgatcatttggcgatgcaggcatgccatccagctgtttcctctcagttttagtttccagccatcacttggagctgaagagtgacaacctgccacatgcaaaatcaatcagtaaacaactcatcatctgaacctgaatgttcatcatcgaactaacctctgttgtttcttgacacataaattcaggtaggagttggaactgaaagtatgggagaactcacccgagcctgagagatgtatcagagctgtagtcgttgtcgggtggaggtcgcgggtaagaagcattggtgacagattcagacgactgcccttcctcgtacacgatttctgaatcaggcccaggctgcatctcctccattcttgacatcctggacacctgcagcttcagatcgtcgtttaatcaaatgaacgagcagagcaagcatagagagaaagttttctttttagataatggaaaatggttcacatctccgagcctctgtcgagtttcgacagggcagataaaattaagggtacttacttgctccttcagccttaaattctcctctatcaattgcatcctctgtttgatcacacaaatggagcagttttgtgatgagaaagagaaatcaagatctaacagaagataattaatttcagctgcatttcagtttcgctctgtagctgtgtactgaagctggagattggccaaaatatcatgctcttacctttcgttccagtccatcgatctcatccagaattttcttgctctgaagaagaacatgatcaaagatcacggtgtgcaacattgcaactacgtacgtccaatggacagtctcatgttgctgcgcgtaccttggtcttgagaacagagcctagaccggactcgaggctcttctctagctcctgcagctgttccacattcagcctgtgcagctcctctcctttcatctgcctgcaggaacacacaagggaattaatggccacatatactagctgaaccatcctgtgaatccacagaattagacagtacctacaactcttgaaatagtgtaatcttatgtagcatttaatttctctctgaaaagtaatagtactcagtaactgtatataggtcctgtatggggagtttttacagctgtatatatatagttttcacgtaatctccacctccccaagcagttcatttcagattctcagattctctaagaatatgtagttataggaagtccagttttctcagcagctcgctactagccgcttctcagaatctccagctcccgaacaaagtctatatatagttataagtatgtacctcagcctaaggctagtttctgcaagctcctcctttagtctggcacaagtactgctgtcctccccctaccagatgacatgaataaatgcagttagggatacatgtactatttcttgcttgtatgatgataaacgatatgaaatgttcagagaagtaccactagcaacagtttcttaagaactgactaattaattaaggtccacactaattctttctagaaagttgagtgatatgagagggtatatcgatcatcaacatcacatatagctgttgcatttctcttttgtaatacaagtgaaagtattttcagcttacttgtaagtcgagttgagaaggttctgctctctgaagtgtcttggaatgcgagttgtaccggtcaataatctgttccatgcttcatcaatgtatatatagaaaacaaagttagacagagttggatgtttgtagagctagctaaggtttgtaatgttgaatccaaacgttttcatcaagatgctagtagtaccaaatattgttaggtagttcttctaggcccttcaaaatacaattgcttctgaactaccatattggaaggatatgaatgttctgaactaccatattgattgtttcagagaacgagaagaagaaaatacaattgcttctgtgaagaggtaagccacgcgtagcttgttctgtggccatcaatatttcatgcatggaccatgcatgcatgacatggcacaggcagcaggaatagtagaagtctagaagacgaagacacatgactatatcttatggttcttgttatgtattatgacatgatgaactagtactatatcttatggctcttttcaaacaaaggaaatttaaataaattttataaagttgagaaaaccctatatatatgtctaatcggaacgaaggaatagtcattccaaattcctatgaaattccttatggttggctcgaatcatagggatattagagaacttttaacttgaggtccaatcttttagaaaatattctttgcatctatctatcttccaataattatattatgttttttctatatatgctccatttaagcagtcatttctgttgttttcttgttttttttcttttatctctctgtgtgtgtgattaatggtttcatgtttatacatgtagactagtagtagtgctagccaagtttaataatagagatgtctaccgcctttaattttatccctcatatctcctcatcgattcgatcaggaggtgtatatatatatataaaacatgtgtactaccttcatcttaagagattttgcccatatatatatctacataagcaaaatcttttgtatttagagacaaaggtagtacaatatatctcatccataatacacaaactctaatgttatttatttgtttactatcacactagtatttgcactttttaaattatgtagaggctgctttttatactgagagattgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatacttggaagtccactgagcttgtagaaaaagatggagaaagatgcagttttatgagaagatccaaccagaagcaataatgtagatatggttatctatatgtataacaactacacatcaaatcatgcgagaacagggtaagttttccacgagtgctttcacacatgcatgcaaaacctgtcctactttagtttttttttcccaagaaaatctgctatttatctctggtcatccagtccaaaagagagaaaacacccctctctgccgagtctcttccatacggtcttaaattaactgaataagattgctgacttcaagagtgaaaaaaaaaactatatatgcttatatatatatagccgtgtgcctatcggtgtaaattaaccattttcattataaaaaatgggtcgagtgaaagatagaagagaacacgacataagtgctaaacaatatttcaaattaagcgcactatggagctataattaataacatcatatacagagagctctatttaagaagctgggacatttttttcctgggaattaaagaacattccctagaagaacatattacattactcatctagaagaaaatgaatcaaagcgccgaacaatcaaaagcattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaaacgtacttaccggcaaaatcaattagggaaatttcagaagaaaaaagaaaccctgatcgatcgacaaagagccctaacaatagtacgatattccaagaaccgacagagagatcatcacccagatccgagatttaattgcaagcaaattaaacagaaataactgcgagcgagcgaaggagacccctgcgaggaagaaagaagcatatatgtgttggtgtgtgtataactgtatatacatgcatacctggtgctggcgaattggaagagcttgccggtggcggagaaaacgacgagcccgacctcggtgttgcataggatggagagctcctctgcctttttgaacagccccctcctcctttttgaagggtcacctgcctcgccgccaggttggcgaaccccccaatgggtatcctctcctttttcccggggg

SEQ ID NO: 78747 - DNA, 721 bp, Oryza sativa
  unsure (1)..(721): unsure at all n locations
agggaagttngcctgatancnccttgnanncactgatatcngctnnnnnnnnnnnnnnnnnnnnnnnnnnnnnnnnnnnnnnnnnntattttcataaattatactatattttatatgttataatatcagttagatatgtattataccaacactgttgtacatgttgaacttaattagcaccgtctagtctatgataaaacttattatataacatgagctaattatgcgtgatgttatttgtttctattagaagtttagttagtggttttcgtgttccgagtaatatttgtttccgtattcatatccgatcatattcaatcctatttgtattcgagatcattcgtatttgtttccgtatatgagttattcgtattcgttttttatctaacaaagaaaaataaaatatggtatgagtattatccatccatatccacttcatttttatccctagttgtacaacttcatcattgcgtaccacccatactgtttttttttggacaaagatgccttgtttgtgacattttgatttggtgtcatgatatatttttttatggttcgttttaaattcatcataacaacgactggacgatgctacgtactagtctttgtgacattatcgacaaatgaaactcatcattaatctatgattttttttatatatgggattttcgtcgtagaatgtcatttcttgtagtgcatgcatggtgcaatttactcttta

SEQ ID NO: 78748 - DNA, 1446 bp, Oryza sativa
ggctaccccaaatattatactagtgtgattatggtgaataagagtaataccggcttcggccaacaggatgtatggttattacctgacaactcaggggcccgaacctgtataaaaatcctcttctccgtctcttttacctcagcctcgtgtataccctagtaccaacgatccccatagtatgcaaataccggaatcgcgacatcaaacgtcgacagaatgatccacagcactccaaatgctgggtactgtagcaaacctttgaattttctcctccacaacagagaggatccgaattgaaaaacttcagcattttaaatttatattagcatcttctcatctagtaggctttaatttatgtagtaactagaaagaattccgtgcgttgtaacgggtgaagaatgttttaatcgtattattattatatatatttttttaaaaaaagtatatgggaattttattttgagatgatatccaattccaaacccttgtacttttaaaagcgaatgaatttaaaaattaactcaaatccggatgacatcccaaaaccatcgacggaaacaacttcagtttttagtaatatataaatcacctaatcctaaatagcccaacaaaatcatatgttaaaaaatgatgttaaaaagaattatatgtagatgaatccttcacaaaataaatgaacatgcatccaagctgcccatacaaaattcagtatgttttgcatttgcatgttacaaaattaatgaaataaacacaaataaatctgaaataattcagaagataggctatattttacactgaggccccctttgaattggaggaaaaatggaggaaaaacaaaggaattgaaatcctacactattcatgcctttgattcgtaggaatgagaaaaagaaaaacgtaggaaactttcctattcctacaattctagagcaaaaacgtaggaaatttaacatccactctaacctcttggaaaactttcccagagtctatctctctcatccaattcctgcatttttcctgtggtctaatcaaacggtcattcctatatttttcctgtgttttgcaatcctctgtttttacacttgcattcctaccaaaatcctgtgtttttccaattcctccgttttttcaatcctacgattcaaaggggccctgagacagcccaaaatagagagacagcttgtgatagacgttgggcccttttacacttttaggtctatatgtgtagaaaacgtattggaggtggagaaaaaaaaggaaatatcgtcaaaacgctaaacacatatatgacaagacggtttgctggaacgaagagacgacggacaaaaatacgatgagtacggaatcatttttaattttttaataggtaaagatataatctaaaaaacgaaccggaagccagtagccagaaatgaagatccagcttttccaaattcttttcaactg

SEQ ID NO: 78749 - DNA, 3177 bp, Oryza sativa
  unsure (1)..(3177): unsure at all n locations
agatcgaccttacccgatgtagcattaagcgtgaagagaaatgaagtttctaataaanccgatgagagcttgttcgagatggtagatataccacataatctagcttaatatcaaagcctaagcctatcggccgctttcgatgatagaggttagctgatgaagctcagatgatgagatcgatctatatcatgcgatatatatgataactcagcgacttgcgtcgacaagattagagtgttatgaagatgtaagcactaatcccgagaacgcaagccgccatgacaagatttacctcttcgtcgaagatcgaacctgatgcagcccaactcgaaagcaaaaaagtcatcaaaaataagggtaaaaagggtggcgatgcgccgaagtgtattgaactgtcgtcccttgattacatggggtcgggccatatttatacccgaagtacatgacaggtccttgctggacacgactcttatctctaacataattcaaaatacaaatgagtccttcaggtggaccattaccaaactatctttaaggaaaactagaaaatgtcctaattaatagatacaattgcccttttcaggactcctatccttgtgtggcaataacgatggaggtcttcatccaacccgacgacggttatggggccacctttcttgagattggtggcgccggctttgactttgtttgatccggtgtttagccgatatgtggtagccgataccactgtagccaatttgtgtggtagccgatgctgttcatagccgacgtgtactcagatttcccgaacgggctttttccgaatcggcttggtctccaattttgaatccaacccatggtactaccaaatttggtcgtcaacaccaacgcctcaatcgcctcgacggtcgaggcatgttggcaattagacgaacaaaaagaaagaagtgcgctggggaagagcacaccgatggggaagaaggattagaatatagcaggaagatttagattaatttctcttgttgatccgaaccatcctgattacagcttttataagacttagactaacaaactcatttaacaactttgtctctaaaaatatgaatagaaaacgaaaccctaatcagctacgactttgcgcacctgaacttcctcccatgcgaccattcttcggtgtccaattccttcacagcgtttgtgaaacaaaattccccacatgacacaggaggaggaggcacacatgcgctcgaggctcctgatcctgccgacgtcgtgtcacgcccagaaatttagccctaaatttccagactattttgtgtattaaatctctgtccaggaccagctagggtacacaaaatgacaagtaatatacagttcaaaacgtaaataaagcataaaatacttacagaaaaggcacttagtcctcacatcgaaaagaaagcagcagcagcggaaaaaggcgatcttagcggggctttagctccactccacaggcaaaacttaactggggtctgagccttggtcctataacttcgtcttcagctcagaagctctacacttctgaaaagggggaacaatagcaaggctgagtataaccaccatactcagcaaactacacaaacgatgcagacgtgcaaggggatacaaggatgtcttgtggctatttgcataaaggcggttgtaaaacattttattgagcaaaacagtaaaaactattgagtgattaatgtaacattaaatctccactgatcaacactacaccacgttgaacaggcccaaccaacccacctgaactacaatgcattgggtcaatttattaagggtgagactaatcatggtgaatctggtcgatcgcccataaccgcggacacggctattcgaatagttttactttggccagaggtgcacaactgtacccacaagacacaatccaccggcatgttaccgcgtcatcatgcgcccatgatgaacacgtcactatatcgagtgattgtaacaagacccttcatataaccccctctgaccaatcacaccacacctcaggtttcacccccactcctcgcaaggcagtgggcagtcccctctcgtgccatggtgaatccggaagccgatcaaccgaacacctcggctgactcaactccatcacgcccacccttgcctaggaacgtcagccagaggaaagctatacttcaagtcaggtagttacccattcccgcttgtggcaagcattatatgtcttccagtacattccgcgaaccggtccttaattgccatgggtgtgatcagcaaaaccatgcacccacagcccaccaataagtcacattttagttggttaattatggctaatgaatatggccgaatgtctcgagcacgcagctcgttctgatactaacaaggtctaatactacaattatcccatcaactgagctagtggtaattaagcatggctaagcatatagttctagctaggtcacataagtaacatgagctagtcgatttattacccaatgttgacaaatgacatatatcaagtaaacatagcacaagcgagcagataggtaaaccctattcccatgtaattagcaaaacatgcatatttatttgcaaacgataaaacatttataaattaggatcaacatgctcaaggggaatgtgtgacttgccttgcttcttcacttggatcttctgaactcttatcctcgtgaccgcgaacttccgaaacgacggattctacacgctgacacgcaaaacgaggaaaaactctaataaaaccaagcaaacaatacataaaaagtaaacaaacatgtagagctcaattttagatgaattttgcaagttgaatggctcaattcggagttcatatgaattagatatgaattgtagaagttttgagccattttaatgaatttctagaattattatttatttatttcacaattattatttaattgctcaaagggaaagggccgctgctgacgtcatcaaagggcggtgccgacgggcgggccccacgagttagtggcgcaagaggagcggcccacagtggactcggtccaccgcggcatatgcgcgggcgcaccacgtggacggccatgtggcagccaaggcggcaaggcaaggcgaggtggcgccgacatggcggagccacgggcagtcacggcgaacgccacgtagacggcccggatcaccccaaagggg

SEQ ID NO: 78750 - DNA, 2908 bp, Oryza sativa
  unsure (1)..(2908): unsure at all n locations
cgcgtcccnntttgaagtacatgcnnnnnnnnnnnnnnnnnnnnnnnnnnnnnnnnnnnnnnnnnnnnncctgaggaagagattggatgggttagggaggaaaacaggcgaccgaagcggcgggaaaacaatgccggcgatggaactcggggcggaagcggaactcaccagaatgcgaggtggttgggattccggcgggtcttcggcgaagaggagtggacgccgaggagcggtggagcgcggtggtgctgagggtggcggcagcacgaccgggcgaggcctgtctcgccggcggggagtggccggaggcggtggaaagggcaacggctcggcttgcatggtgggatggtagttgtggtggcgatttgagggagaggagcagctgccggggtggagctaggcacggagatgccgacgacggcagtggcgcggtttggcagcgacgggagcggcggcaagaggcggaaaaagcggcggcggctcgggctgcgtgtggacacggcgtcacggtggtggttcggggaaataaagtggatgccggggtgctatgtggtgcggcgaagctaacggcggtggcggattggcgcggtggagactagcggcggtggcgaccggctggagctcgatggcaagcggcggcgcacggctcgacgtggggagagcgggagggggggcgaggagctcgggaaggagggggaaacggaagaggaggactcgagagcatttttatagcgcgagggagcaacggggaggccggggagtggcgaatttggggcggcagcagccggcgacgtggagctcaacgtgggtgaagtggggacttgatttggcgccaaaaattggggaaaagtaggggatttggtggaggagatggaggggaaccgatttcgctcggtttgggcgtgagggcgcgagtgggagggcgcttgattcggcggcgacgtgggcagcaaaagggcggcatggcggtggtttcggctcagggagccagaggtaggaggaggccctgacaggtggggcctcgggtccacctgtcggcgaggggaggagagaggaggctgggcaggggggcttaagcggacttagtgggagaagggagccgaactgggctggtccaagagaaggaagggggcgggaaggagaaggggaaggcttgggccgagcccaagagggaggagagagatttttaattggttttctttttatttaattgattaattgaactttgtgactttaaaattacttcttgagctccgaaaattcgcgaaaaaatccggaatccggagagtattttagggcacaaagaatattacaaaatattcttggccaatgatttttaaaggaaacttttaattctcccattatttcacttgattaaattgatttaacttttatttaatttctagaaaatgtattattaaatgatttttaatcctgaacgaaaatcggggtgttacacgtcgtaccttctcctctccttgcccatgagcaggtcaatgatgcagttcatgtcgagcgcccgcacgtcccgcgctgcgttgcagcacgggtcgtacacatcgttgtgcggcggtaggacgcggtgcccgtggtccagcttcacccaccgccagcacgcacgcaggatgttcaccttctgggcgtgggtgcttttcctgatccttggactaggaggggatcttttggtgtcggctgcaccccagcttcagtgctcgcctgttgcgtgcgcaacaggttaggaggaagaggaggagaactgcgcaacaggttagggggaagaggggagaactcctgctgctgatgctgctgtgactctcccggatgccattgttgtagcagaatagtagcgcggtagcactacaaggagagatcaggtctgcgggactccaggatttgttacccttttaaagcgagatcagagattagcaccctacatgtgatggctagtctaattaaatgttggatatggatgcacaaaatctttccattcattaattaagtctagtaagagatagatatatacattttaagttaattaattaattaattaaagttcaggttaaccagcaagctagatgttgttggtatttctaaacgacatcactagaaatataattcctagtaatggcgcataaatactactggtatattatggttacaaagttcatccgcaagcgcataaatataccattgtagcatttcacccgagagtattctaagggtatcgtatttgtttaatcccgtgggaagattataatagagagaaccgtactaataatttatatattacttgtaataaccagagtctacccaggggttaatataattcagtgggtagagtgacactaagcagaagcatttatactctcattcataattatctaagctaagcagaaagaatatagaaagatctattcctatatctctagtatatatacatattatacatacaccctagttatatcataacttaaccaataccctctttctgatgctctcctggtacttcgagaagccacccctgattgccgagttccttacgacaatccgtcatgaccattcaaccggggctaaatacggaggagtaccctccccaagaaattaacttaggactatatacacgcgcggaggaatacctgtactgagctgtcaccatcagtgtgttgatgaaaaacatgaggcctgggagatctgcttaactctagtgcaggtccaaaactcgccttcggatatgttagcgtgccagttgatttgatcatgcaatcaacaagaaataaagacaaagaaaccgtggttaaatctataaacgatagccgatcggctaggtgccgatgacatatcatttatctttgcgccgatgtcatatatgtatcgatcgacagtcataaataaataagaaggaactaaa

SEQ ID NO: 78751 - DNA, 5132 bp, Oryza sativa
aggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaatttctggtaaatcctatcgattgtcctccactgcactgaatctgctgggtgcctcagcatagtatcgactttccgttcttcggcatgccagtgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaactcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcaagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgcagggagttcggtagattagcgtgtcattagtgtgctaattggagtcaaagacgcagctgcatgctgatttgttcaggacgtgcatgtaggaaggatgagtgaagtctgaactacatgcgcacactgaaattagttggtgagtggagaaattagtgcgtgcatgcaggattagtggaggtgatcctgctgcatattcgtggagtctgttgtgtaactgattgaccgggttgtgtggctaaacgtggctaagtgtgtgtgtgtgcgtgtggggctatttaagccatgtaattagcctgttaatcagagtgtggtgaatacaagtgcagtagtgtgcgtgtgtgcatttgctggtgcagtgccgagacaaattctccatcgtgtgtgtgtgatcttgtgttctagctaacagtggtatcagagtgtgtgatcttgtgatcttttaagtttggggggagtggcaccaacttaaaaggggaggggtccctcacctcatgagctagcttttggggtgtagaaagactttctcccggttaggccaacgtttcccggttttgggccatcaagtggtatcagagctgggcccacaatctctctaagtgccgtgcacactcgtgtggtgtaagcccgaagcccagtggaccgcgggtgtgaggcccgtatgtgcctatgtgttgggccggtcagtggaccgcgggtgtgaggcctgtatgtgctcgtgtgtggagcccggtcagggctaaggggcaccaatgtgtgacgggggagattgttgggaatagtcccacattgaaagtttagggggagtggcaccaacttaaaaggggaggggtccctcacctcatgagctagcttttggggtgtagaaaggctttctcccggttgggccaacgtctcccggttttgggccatcactgccgagtccgagcacgtcgacagttgccgcgccgccgccaccgactactccgactccttccccgaagtcgacggcgacgccaagtcctgccaccgagatcacctctccgcctcccccgacgccaccgcttgcgacggcaaggctttctccttccaccgcgccagcgacttcctcttcgcctctcgtcgactcaccaccaccagcgggcacggatccttctcccgcgtcgactgactccgcgcagacatcgtacagagttctgggcggtgctgtcgccatcattttaggggtgtggcgatttactacatcgtcacctagcactggaccggacgggaagccgatcgaactgacgactgcgacctctgtcaatcaaagggacatcgaactggttcttactcgtcttcatgttgctatctaattttttttcttcatctgcatttgtgttccatttctgatgatttctcttttgagatagctgctgattagtatgtctgcgttttggttctcccctaagctgaagcagacaattcattactgcagtatttgcctctattcatatgttggcacttggtattcagaaaattcatgagcctagtagctctctgtgtttgtgctttaactttttgtgacgactatgcatcattttctggataaatggagctacaatttgtcttcaagctgaaagaaatctgaatcattttgttgttctagaactagcagagttgcagtacatatgttatcctgtttaactttgtttactatacgcagagactaatccctgtgtggtgtttgttctcattgggtccccggggctagttcttatgtgtttaaatgctgatgcaacaaccatacttgttgtaatttgtatcaaactccctcaagattttaatgaatttggtcggcgaaactttagtcgcccacgaaaagcaaaatgggaatattgagccctccatgcccgaatgatgatttgctggtgattgagcttgctgtgtgcctttctgatcttatcatctgagattttagttcctgcagattcataacaactttggttcctgcagattgtagtctcagaagaaatagcttgaagtctttgaactaaaatgtgtgacatgttcagacttaagaatgcacggctagcattacttctgttcagtaaatagcttgttttacatccctgaatttgcgaagcttcccaactgtgagcacagatagctatacctcttttttttttctttttttgcgggaatagagagctttattgattagggcaccaaattacaatcctgccgcagcacatgcaaaatacaagacggagcttgatcacgccaaaccgcgcaatgagctgtccgtttcgcaagctgagcaagttcatgagcaaccctattacactctctattgacatggtgcacactcacctcttgcagacgcctaacagccgcttttatttcacgaagaagaaaagtccatctagaccgttccatatcctttcctgcgatacttgttgttgccattaaacaatcggattccagtatcaccggcaagtgtatccattctgctgccaagttgattccttccgaacaagcaagaagttctgcctcttctgcctgagagcatcgtctgagatagcgccaggagcttaggagcactcttcccaggcagtctctgataaccactccgataccacatcttccatcaccctgatcaaacgcgccatccacgttgattttggcccagccttctggaggtggttgccatttggacttcgtatgtatctccttcacagagggcttggacacaccccccaaggtatttccagatttaccattaggatcggctgtggcttgtcggacgagtgacagtatttccgcataattctgcaggaaagccaccgaacctgtcacagatagctatacctctgatacctgcatggctgcatatctatctgttcctctatgattgttataccactctattcagaaatactcagtgtttagaatttagtaatttgcaactttgcaactaatatattgccccagagtcatgcgtacagttgcagaggccagagagattacctcttgaatagtcttgaccttccattatctttttttaataaaataaattcaccaaccagcgggcctcaaatgatgttttatttggagaggaagcacgaagatgaatacggtagtcatacagacagacagttggcttgacttcgtttcacttccaaataagatctctgccttggccggcgccggcgacgcggagtggtactacgcaacggcaaattttcaggctcccccaagtccgcgcgcgtattctgaagacgacggaataggccgagagagaaaatacgaggaataagttcatctgaggtcccttaattttacaccgaattcgattttcatccttatagacatagcatacaacctaacgattttgtttcccctatgaggtataaaaaga

SEQ ID NO: 78752 - DNA, 1018 bp, Oryza sativa
  unsure (1)..(1018): unsure at all n locations
ttttttttaacagagttaacaatagtagaaaaacacctatagatgccaatctttaatgtattcattacttgtataacagaattggttttttcaaaacagtacatcttttaataccgatgaattttaaatgatctcgatcaaagttttttaatggattttaaactaagtaaatcttnnnaaccgtgatccacgttgcatccgcccctgcatccacgaatctcactcttcaaagacatagaatatgaaaaaaaaaactcactgcaagattctgatccaataccaaggaacatcgaaaacatattggctgaagcataaaaaaaaagtctgaactacttatttctcctctccagtaacagaccgacgccagaatcgatactagtttggtacaaccatgcggcgccacacttgatgaaagcaaggatcatcgtggatgccaagttcaagctcgtcgtgttgccgttgtaaacaagtggccgctgatgttgtgacacgttgtcattgaggaagccgaggctgaccgagctgcccttgagtaagctaaggagattatcatcgaggacaagagccccgtcgctgctcgtgatgaggtagtgttgtagtggagagagataagggagagagagagaggatacgattggagtgtggtgtggagaaatagatgggttgatggtgtttggtgagncnnnnaagattccttgccaaagatngttttaacccttttaattgtccatttggggcttgtttgttttgtaaaaccattataagacccattgtttggatttctttaaactatcaccttaaaatcagcatattcttgggtataaagccctcccccctataccctaggttcctccccagttatataatactcttcctatccttgcccatttctctgttatggggtcgtctcaagatatggggtctctggtttaaatactactctttttttctgttgttaacattctgcctttttaaaaatttttatgagcctctctcttttagacattaagatcccact

SEQ ID NO: 78753 - DNA, 26699 bp, Oryza sativa
gatttcccccccttcctcctcctcctcctcctcctcctctccctactcgatttgctgcggctttgcgaggctggagaagaagggtttaagcgagggagagagagagaagaggcagagaggaatggggttttgggtccttttcaacgtcgtggtcctcgtgggtcaagtaaagcagagggcaggcagagggaatcgaccgttggaacggggaggggtaaaacggtgaattcaggtcagtgggacgtgtgtccctgacaggtggggcccgcacattcatccgagatgtttcgtgcttcgtgcgatgcggagtacgtgtgcgcccgtattttcgggagaaaggaaagggcacgaaaagaatagctgggccggaaaagtagttagatttttttttatccgagttctgggccggcccagaaacttggtccacggggctaaatgtgatacgattttgctatatatttgtcgacaaattttctcctaaaaatttgacagatgtaattacagtacaatcgtagtgtaattacactgtaacttgcatgtaatcacactgtaactatagtgtaacttatatgtaactttcaaaaatctctttgtaatatgttatttcggtaaaatggaggttgtgggaacaaatccttacacatatgtttgtgctgtgatttttttttcttccttaccaaaacaaatcttgtaatagatttaacgattcaaaattacgtgaaacttatatacaagttacactgtagttacatgcaagttacaatgtaattacatataagttacagtgtaattacactacgattgtactataattacatctgtcaaatttttaggagaaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggacttgtttactttgctactattttcaacattaacaagttttggcattgccaaattttagtaaggttgtcaaaattttagcaaggctaccaaattttagcaatattttatacgtacttactaaaatttgacaacaaactaaatgtagccactttttttaactttgccaaaaaaaaagtaaagttgaaaatggtagcaaagtgaacgagcccgtaaattactcatacgtaatattgtcaacctaggccttgtttagttacaaacttttaacttttcaatcacatcaaaacttttctacacacgtaaactttcattttttccatcacattgtttcaatttcaaccaaacttccaattttgacgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcggcatgaggatcgcggtgacgggcgcgacggggtacctcggcagccgcctgtgcggtgcgctggccgacgccggccacgccgtgcgcgcgttcgcgctccgctcggcgggcggcggcggcggcggcggcgacgtcgaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaaagaaactcgcgaaagttttcaagcaattccgaaaaatatatgctctataaaattgatttggtcatttggtgttaaaaaaatgggcatttaatcatatcctcggacgtgttatgattatcaggtcaatgtgggagggctcgagaatgttttgaaagctgccaggaggacaccaacagtaaagaaaatagtttatacgtcatcattctttgccattggcccaactgatggatatgttgcagatgagacacaggtaccatatttatattggagttctccttaattagctccctcagttttcaaatccttcggtctagaaaatctgccatttcttgtgtgagatgtccagactgagcatgctaaaaaaaattgtgcaaaatatgatgatatgtatacttcaaattcctttcgtgaaagaaaaacatttttgcagagtaaacaataagttgctgatattgcagatgcatcaaggaaaaacattttgcacggagtatgagaaatcaaaggttcttgcagaccagatcgcattgcaggcagcagcagaggggatgccaatcaccatcgtctatccaggattcatgtatggtcctggaaaacttacagcaggaaatcttgtttctcgcatcgtaagacaatttctctactcctagttattcatcctgcatatatggtatatctgaatgacccaaaaaaaaagaacttgttcctgaaataattaacagccatgaatcatgatcagaaacttgaacatcactggctcttaatttgcagttgatcgagaggttcaatgggcgtttacctggttacgtcgggcatggccatgatcgagaatcattctgccatgtcgacgatgttgttgctggacatgtagcagcaatggagaaaggcagagaaggtgaaagatacctcctcaccggagagaacacgtcgctggttcagatcttcgacatggcctccaggatcacgaacacaaaggcgcccagattccacgtacccctctggttgcttgaaatttacgggtggatttcagttcttgtttcaagaatcaccgggaagctcccgttcatcagctaccctgtatgtctctttctgtgctccttttatttccagtacttacttaggttcagagtttgtttttgcagggtctagttagattcagagtttgcacattggtgatgatgatgatgtattgatgtggttacttagatttcagttcttgtttgggttttgcaggcagtgcgtgttcttaggcatcaatgggcatactcatgtgagaaggccaagaaggagctagggtacagtcctaggagcttgactgaaggtctatcagagacgctcttatggctcaaggacagcgaaatgatcagattttagtgttctacatttcactcatgtaaacatatcagcattgctgtaactgcataaatagttaaatcaaagaaaacatgtggtttgaaatttgaagatgaatgcgtgcaccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggttggattggcggcggcggcggcgactcgacgatgggcggcggcatgagggtggtggtgacgggcgcgacggggtacctcggcggccgcctgtgcgcggcgctggcggccgccggccacgccgtgcgcgcgttcgcccgccgctccagcgacgcctccgggctcccggcatccgtcgagctggcctacggggacgtcaccgacgaggggtccctcgccaccgccttcgacgggtgcgacgcggtcttccacgtcgccgccgccgtcgagccgtggctccccgacccctcggttttcaccaccgtacgcgtgctgattcatttctgatgttttcctgtggcaagtagagggtaactatattcattcaaatcaaagtggggagtactatagaacgctagatgaacctagacattctgcctattgtgcgatgctgtttagggtctttgaaaattatggctccaagtccaacaataattgattttccgtttgctgttctgttcatgaaactaaaatgcatgcaaattcggtttggcttggtgtaagaaatggcacttgagcatgcgcgttctgtgctatgattacaggtcaatgtgagaggactcgagaatgtgttgaaggctgctaagagaacaccgaccgtaaagaagataatttacacatcttcattctttgcaattggcccaactgatggttatgttgcagatgagacacaggtaaaacatgactttgaactgtgtaagctttttaccatttcatgtttgaaaagcttgaatagtaaataaaaggattgtattatgattgtctttagtagttctgcccataggttctgttctaagctcattccttgatatgtactccctccgtcccaaaatataagggattttgaacggatgggacatttcctattactacgaatctaggcatactctctttgtactttcgtagtactacaaaatgtctcattcatccaaaataccttatattttggtatggagggagtagtatagatagcacttggctgacccgacattcatgttaataggagcacataaggtgtccattagtagtatagatagtagatagtcgtttttcttgatttccattgaacttttaatgataaatttctataatgggcaactcactcttgaaacctagctgttcaatttaccccattccaaagtattttgatttacccctgacactctcttatttctaccacttgtataattctttttgataccgacttttagtaacaattatccaacttatgcatgtcctgttgaaatggagtaaccatttcatcaaattatcctctaattacaaaaaggccttttacaaattaaagtaattctataagctataaacagagttcaattgttctaaatttcagagacatcaagagaaaacattttgctcagagtacgagaaatccaaggttcttgcagaccgaattgcattgcaggcagcagcagaaggggtgccaatcaccattctctaccctggagttatctacgggcctggaaaactaactactggaaatattgtttcccgtattgtgagagaatttcttactcatggctatgtcaaatatgtagttatttattatcgtatatttgtttcaattttaaaatataacatttcctgaaagatagccatgaccagaagaaattaaactgttgtgattcttgcagttaattgaacggtttaattggcgcctacctggttacataggagatgggtatgatagggaatcgttttgccatgttgacgacgttgttaatgggcacatagcagcaatggagaagggcagaccgggggaaagatatctccttactggagaaaacttatcattcaaacagattttcgatatggctgctaacattacaaatacgaaggcacccctattccatgtacctctctggttgattgaaatatatgggtggatttcagtttttatttctcacatcactggaaatctcccacttatcagttaccctgtatgtccagtattcttccttatttaagtttaccatctccagataggtcatgctgttgtgcttactagattctcaatgtggattgcagacagtacgtgttcttagacatcaatgggcatattcatgtgataaagccaagagggagctgggctacagtccaagaaacttaactgaaggtctatcagagatgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgttcttcgattgaatattggttgatttgattctttacaggctgcagttgcataagtagttacagtaaaaaccacgcaatttcaaatttgagaacacgtttaaatggaattttatcgctacctaatgctgggaaggtatatgcagaaatccttacactcgcattgcaatttcaaaacaatacagaatgttttgaaattgcgagatgccgaacacagctcacgatcaaaatgttgagcagaagaaaatcagaacatgtagcacaacaattcatgacacaagcagctatttgataaactgaaatggtgaataatccatatacaactacagattggaatacacaactgagctgtttccatggtgatcactgaccgctcgatcaattaaaaaaaaattccaaacccagctggtcaggtcaattcctgaagcaatttctccagcgcatcagaaacaagaggaatgtggaggcaatcttggccatcagagtgctttctgatcttcaccagatcatggtctttaaactccgtcaggtgggagttcagcgtcacttgactgcttacaagaaaacgctcacggcatttggtatacaagctactgaaatgcatacctggcaaacaatgtagcaaggtttagtttgtaaacaacaggaagtcataagaaaataagtctgcaacaaacttgccttcctccttctcgtgtgccaactgatattcagcaagaactctgaagacactttgcgcatttggtgtcaggctttgcagaacaacgagggcggttttcatggtttgggcatgaccgccgctggcaagaatcaaggggtagaacacaccttcaactttgtaaggtgcaaacgttgggacgtgataccagctccacttgaactgtgtgtgcaccatcttcttgtcccatactacagttatttgacaggttaggaatcttaaacagtgaaggcattacaggaggttaaagctagccaggaacttacacaaaggtgcattaacatgatctactgatgcgacaacatggacttgcgggcagcacgaaacttgagctaggtactgctgtgattcagcgtcacgcaaggcaggtccgtcgatgttgtgaataagaaggcatacattgtcatccccattgtcagatgtctggttatttagaaaggagataatatcatctattgattgggatgcaaatggctgcaactgggaccttgttgctgtctggcgttttctcttaagttttgtttgttcccaaaatatttcagctattgtcactatgacctgaaatggcaacaaggcagaaaatttggcagaattaagagctttgatgtagaaatcaatagtcctccacaatataacaagaacttcctgattaatgatagtaaggaattacatgcacatgaatttacttgaggtgccgaatttgacaatattggaatggttgaacaaatagaaggtacagatgtttcaatatgttaagttacaggtgtttgggatcatgatcctaataggcaaacaaggatctccatatgactgcaagcaacaccaagataaaggaattgcgcgcagttttcatgaatcatctatttcagcttcacaactagtcaactattagagagcaatgtttgaagccactttgagcatgaatcagtggaaattaagattgcacaatcaactttggataccaaattgatgcctttggtccttatagtatttcatttgtcctaaaccttaaccccttaaggactgtaggctcaatgcttttttttcccttttcaacaacaatgcgataaagtaatccatactgcaggcaacaaaggtcaatatcggtcaggaggaggtcatacttgcttcaagttgatggaagggagatagccattaaccacaatgacggtgaaatcgctcaaggtcgtggacgcaaaatcctcaagcaacatcttcttagatccaaatccatacatcaggagcccaaatccgcacctgcagaagaacatcacatcgatcttttggcttcatccacatcaacatcaacactgggaggattttgggtagcagacgaacctgagctcgaacagccagttgcggtactgctccttgtagcttctcgtcagagcctccacctctctctcgtgcttcggggggatctcagcgagggatgctcgcagcacctgcaccaaatctcgaatcagggcattcgccatggcctcgggaacacgaatcggagggtttccaggaggggcgggttatgcagacctgctcgtcgacgaggttgaggtcggagagcttgccggcggcgcgggcgcgcttcttgccagaggagggctccttctccttggccaggaagtagctcctggagaagccggcctcctcgtcgtcatcctcggacccagagcttaccccagcagccgccgccgcgtggccgcctctcagtgccatcggggttcgcttccgccgccgccgccgccgcgaggatggaggacgagaaaggggaaggacgcactcgtgcacagcctgccggtatataactgtaaatggttcaatacaagtagaaaataacaaataagtagaaaataacaaatagtaaacgatacggtatataactgtaaatggttcaatacaagtagaaaataacaaataagattgaatcttacctaaatgacaatgtaaattgttcaaaaggtcttagataaatccacgggtgggattggtacatcacaagatgcaactcctttttgcttcatgcttttgaataagtaacgcaatgcttgacttctccatgcctcaatctccaaccatcataccatgcaaaaatgtcatatgaggttcattgttgcacacaattttgtggtaatttatacaaatcaatatctccttaattggctaatcacagatattattgaagaaattgatttattactaagtactggtctagtagaactctatagaagggggagagggacggccggactgagggagagccagagaggtagttcactagcgctcaccggagtccggagtccggagggggagggccgctggggccggcgcagagggcgggaggccggagtgccggacgcggcggggcggcgtcgggcgagaccacgggaggccgcgcgaggcggggccgcgggaaggcggcgccaaggcgggcaggcccaggccggggggcagccgcgcggggtgtcctccggcgtgcggcgtcggaccgtcggtggctcggtgcgtgcgggagtgcgccgtgtgggcggtgcggcgtgggactgggagaatagccagctagggttttttttttttttgttgcctgttgggccaagcttttttgataggccaagaaaactgaatacctgctcttctctgggtctctgggtcaaattctagggtagtcttaggccgagtacctcttggggctcttggggcgcgtagggtaggtggtttatgcggtttatcggggaaaaccggttttcccgcgcttttgctacctcttttcgtggcaaatggctcgatcatggtcgggcccatccagcagtttcagttgggcattgtcaattttgttagcctcgaggatcaatttttcgtgaagcgcctacaaatcgggcatccgatttgtttgtcaaaaatcgggtgttgtttcactaatgaggaaaaaaatgtttcaccaagtagattgaaaatgtttcgatcttttaaaatgctgaaacacaatcaaattacaccatgaaacattttttttacaacgtatgaaacaatgatttcgaatatattaaaatatgaaacaaatccgagtacatcgagaataagaataaaacaccatcgaattgaaaatgtttcagtgctgaaaatggtgaaacagaatcaagtcacacaatgaaacattttactacaacgtatgaagcaacagtttcaaatgtattgaaacatgagacaaatccgagcacatcgagaaaaaaatggaacaccatcgaaaaccacattgcaacattttgatctaactgatgaaacatcatggtacatggactaaaacatcacaatattcaagaggaaaacctaaatctgcctcttcctccactttggtggttagcaaccacaaccgcatcgacgccgcaccgagctccaccgcacccgcatagccactgtcgttgacgtcgcacggagctcggctgcgcagagctccatcgccaacagtggcgggggcgctgccgtagcggctgcttgctcagggaggtggcggcgttcgacggtgtcgccgtcatggaggagaagcgtcgccgtcgcggaggaggagcgattggcagtagccactggctcggggaggtggcagcgtttggtgtcatcgccatcacagcgaagaaacggggaggagaagcatagctgtcgcagaggaggagcgattggcggcggccgtcggctcggggaaggaggcacggcgccgccgctatgcaacgtgtgggagagagatgagcgagataaaggagaaaaaatagggaggggaaaagtcacgggtgtggaaataggtggttgagagcccccgatattttttgctcacgttgggcgcccaagactgagcatatccaaccttttcacctcttggtattactccatcggcttgttagccgatcggctttctggtgatctacgtgtttatctatcttgtcagttgcaggatcaaactgattggcacgcctgtacctcatcaatattttagacctgcactggagctaaaatgatctcctaggccgttatgttcatcgacttagtcagcgccaacatagttctggcaccatcggccaagcgcggatttttcatcaacacactgccacccagatccccgcacgccccacgtggccacgcccgatgatgtcccctctcgctatgctgggctagcctggacaagtggacaggtggtgagctccgccgaatgcatcaaaatgatcactgatcattactgtcactttgccgcatgcaatgtagcctgcagtacttagtttgttcctgttaattaccatgcttagttacacgtgctatctttgaatcataggttcgccctagaatattcttgcacaaataatcgagtcgaatatgatgctttgttattcgtcttacaagtattagaagttatatgagcaacacatatagatatagatggccaaatgggccacctggcccgacacgccacgtcaaacggtcaggccgggccgggcctgcccacggcctccacctacggcctaataagagtcaggccgtgctagccagcctaaaggcatgacgtgctcatccttggaataattctattttacctccctcattttttggccgcgccttatattccctccctcctctttggcagtgccttatatatgactcaataagtctatattgtgcccctcatgtttcgtgccaggccggcccactatgccaaggcagcggcctagacatggcccaactgtcgggctgggctggtgtcacgcccagaaatttagcccaaatttccagactattttgtgtattaaatccctgtctaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcggggcttcagctccactccacaggcaaaactcaactggggtctgagccttggtcttctaacttcgtctttagcttagaagcactacacttctgaatagggggaataatagcaaggctgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacctgaactacagcgtattgggtcgacttattaagtgtgagactaatcacggtgaatctggtcgaccgcccataaccgcgggcacggctattcgaatagctttactctgatcagaggtgtacaactgtacccacaagacacagccccacgacacatttccgtgcgccgacatgccaccacgacataccggaaagaggccgtgacaggacccttcgcataaccccctctaaccaagcacaccacacctcaggtttcaccccccgtccccagcgggcaacgggcagtcccctctcgtgcctaggtgaatccggaagcgacagaggccgtcgcagggcccgccccgctctatcacgcccacccttgcctggatgcgtcggctagaggaaagctacactacaagcccagccgttgcccacgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgataaaggacagatatcaagtaaacatggcacaagcgagcagataggtaaaaccctgaccccatgtaattagcaaaacatgcatatttatttgtaaacggtaaaacatttataaattgggatcaatatgctcaaggggaatgtgtgacttgccttgcttcttcaaacaatcttccgaactcttatccttgcgaccgtgatcttctgaaacgacggattctacacgcaggcacgcaaaacgaggaaaaactctaataaaaaccaaggaaacagaacataaaaagtaaacaaacatgtagagctcaattttagatgaattttgcaatttgaatggcccaatttggagttcgaatgaattagatatgaattttagaagttttgagccactaaatgaatttctataattattaatgatttattgcgcatttattaaatattttcacaaaggaaaaggactgccgctgacgtcagcaagagagtgggccggcgccgacaggcggggcccgcatgtcagcgagacgaggtggcggtccaccgtggaccgggaccacaaggacggtccaccgccggtccacgggttggacggcccagatcggccaaggccgatcggacggctggggacggccgggcggcgcgcagacggccagtcaaccggcggcggcggcggtgcaacgcggcgctggcacgggaggcggctggcgaagaggaaaaggaggagggaggcggcccaccgagaggcgcggcgacggagggagcggccgcggagggaggcggcggcgctccacggggcgaagacgacggtggcgattcggcggtctccaacgaaggtggaggagcggccggggtacgggggagcgcggctaacgcagtagaggcggtggtgtggcgcgaggtggcaaggaacagcggtaagaggcggccgaaggcggcaaacgcggcgatgtcctcggcttcgcggtggagatggtgttgctgcggtggaacgggaaaacgaagcagaggccggggtgctacgcgatgcggcgaagccgacggtggcggtggcgtggcttggtggtggctagggcggcggtggcgcgctaccggagtcggcaaagtggcggtggagctcgggttcacggtggaatcggtgcccgggtggtttattgcggaagcggagcggtggatgggatgcggcaaagcgcggcgaggccggcgatgcaagcggcgcggcacggggacggcggtagcggcggcagcgcccggctggagtccgccgacgagcggcggcgcttgggctcacggggaggagggggttccgggcatgggggagcttgggagagaggggaaaacggaggaggggagcacgagggtgctttatatagggctcggggatggagatcgtggccgggagaggcgggatcggccggtgacgtggggaggtgaagtggagctcgtggggaggtcaaaccggcgccgtttcttgcggggtgagtgggggaaaaggtggaggacgtggagggggtcgtgtccacgtggttagatgcgagctcgggtgcgggagggcgctggattttgcggcgacatgggcggaaatggcggctggggttggctggcgagaggtaggaggaggagctgacaggtgggaccgtcggccggatggagagagaggagggaaaccgggggacataaagtagactttcgcaaggcgcgggccggccgagagagagagaggaggcgcgcggcccgcgggagaggaggggaaggcttgggccaagcccaaaagggaaggaaggagaattaaatttgttttctttttatttaattgtttaaatgatctttgtgactttaaaattatttcttgagctccgaaaatttgcggaaaaatccggagagtattttagggcacaaagaatattacaaaatattctcagccaatgatttttaaaggaaattttaatttcctctataatttcacttgattaaattgatttaacttttaatataatttcttgaaatgcattattaattgatttttaatcccaaacgaaaatcggggcgttacagctgggccggcacgggctgacaccagtcggggcttgggccttttggccatctatacacatagaagattttggttactcgaattgatagtgaaacaagttttcagggtgtataaccgttttgacgggccagaaaatagatattatttagatatatgtttaaacattttcgtcaattttgatgactttcttattaggcatattgtgttaattttgatgattttcttattaaacatattgctagagagaaaaactttagggcaaatgatttggctcatgttaaaaaaaagagtgtcccggtgtttcaaaagtttggacgaaattgatgaagtttcagatgcagggtggtttgaccggcgcaccgaggcctgtttcactggagaagccgacggtctggtatgaggccccaaagttattagtctctctttgcataccacaattcaaagtatgcaatagaattttaatggacactataactaccaaatttactcaatatctatgcaacatagtgctgataacgcataacatgtgcacgagtatgtttgtcttgtgtatcatgatcctgataggcaaaccaattttgtataaggaagttttaattacccgatatagatacaacaataaacttgtcttgtaaatacacattgggtgcaacagagtgaggatagtaaaattcttatatcttatgcagtcaaatggagaaaataaatactaataatataaaattaataaattatggtatcaaaagataccacttaaatatatttcaaaatttaaaagttcatttacgatcatactattaaataatattaatacttctatctgtgttcttcccagcactccttttccactcgcatgctttccgaactactaaatgataaacgatgagttttttgaaaaaaaaatatatagaaaagttggtataaaaatcatactaatttattttttttaagtattttagctaatacttaattaattatacgttgatatgtcgtttcgtttgtgtgtaagagaaggggttctcaacccttcaaaataacataacctagatttgagttaataaaatcgatgtattttataaaagctcttttattagtttgcaagtgtcatgtttattgcaaagatataaaacaatattttgctagtttataaaagtttataatagagtgggtcttacatattataaaagtattctttatagtagtctttaggctctgctacctaacatatggatcatttataagaaataaacaatattattgtggatgtgtatgtagatacaggacttatttagtttattgctactattaagattaccatattttagcattgtcaaattttagcaaacacatttatcatattctaccaaaacttggtaattgttgtcgattgacaaacaaatctgctgaagggcaagttatcacttaactatgtgggatgtatattgatttattaaaaacaaaattggatgccctgatacaaaccacttgggttctatttatagttttaaagccccatgtttgcaactctatggtttttgtttactcgggaattgacctaatcgcccttatgacaaggacatttacatgggctaaaaaatgttttggcccaactagtgggtcacgggctctaaaggttcagtcctaggttgtttattggaccttcatgggtggtaggtctgtttagagcccaactggctaagtgatctcggcgtgcatttgaccggtcggtgatgtgttctgcttctgccatccatcatccatccatgatccacgatctgtctgacacgatttctacgtccctctatttcagcctgaccggtagccatgtacactttaacactataccgcaatgtaacatgagcatgactgccatgacataacaaatgtgccagtaaatcaacgaggggtgaagtttgcacttcctttgatgcatcatgtatattagtgtgtttatcatatcaccaggttagccatcagcattttcgacctttctaggtggttcctaactacatatatgcatgatgcataaacacaacatatactatgttagtttataaaagtttaagtgctatccatagcaataggagtgggtattaagtaccttatagcctacttatatattataaacgtagtctttaggctatgctacccaacatatggactactcacaatcataagaaataaacaatattattgtggatgtgtatgtagatatagggcttgtttagtttgttgctactatcaacattaccagattttgcattatcaaattttagcaacaacacatttatcatattgtaccaaaacttgtaagtgttatcgattgacaaacacatctgctaaagggcaagttgttacttaattatgtggaaatgtaaagtggaatgtatattgatttcttaaaaaaaatagatgccctgttacatactacttaggttctatttatagttgtaaaaccctatgtttgcaactctaggtttctccttactcgggaattgacttaatcgcccttatgacaaggatatttacaagggctacaataatcttttggcccaactagtgggtccatgggctcttaaggtccagtcctagattgattattgggccttcctgcgtggtaggtctgtttagagcccaattggctttgtcatgctgcttcacctcctgttagtgaagggtcttcgcttcgccgcttggtaggtggttcgccacttggtactcgccttcgccgcttgcaagtgcttcgcctcgtaactaagtggttgtttcggcacgttcggttgaaagtcctcatggtatgcctccaacaacaatgttgtcaatttgtcaaaattttggtattgactaatttggaaatattgattttggtagtaatgtgaccacccccaaagtgaacaaactcgtattcaccagtgtattgctggagaaataaaaaaaaggaaaattgtacacttacatcgtttttgttgatgtcgaaaatgctcttgcacttagaagcccagtcaacaattaagagcaattcatgcgcatcagcgatgaacacaactaggtccgcacccgatggggcatccggtttatggccatgagtaatgaggtgttcgggaaggatgaatcgacgaaggagatagcttcgtctttgcggatgatcagtggctcaatcgattggaaaacaacactgctatacacacgaagaaactattacgaagtgcgtatgaaaagatccctacgtacgacacttcggggacacagaacgctaaaagcccatgaaaagtcacagccccatagcccactctatcaataagcagtctggattcttctagtacagggaaaaacagatcccctatctcagattgacagatttagtacccctcttactccttcagtgcttggcttgagcggagatgcagagagcaaggagagaatcaactcaatcaaacatatgagctacaagaatatcgattgcactagcagccgacgcggaggacgctcacctacggccacagcccacaatacgagcagtgagctataggtagctggttggcttcatgcacaggtacggatctacaaaactaaccacttatgctgcaaattaaggataacaattcgttgtgtaggagtcaatagtgcactgctattagcatgcagtaatttcctggtatgatttgaacacgatttactcatctggagtttggacagatgttgcctgtggtagtatggtagatcttctccagtatatatagatttgcagaaaataaaaatatacctcttattcttttggtttgcatcatatatgctacttcaggctgaattcttttaactaaattagaatccatacgtagtaccaaacttcaaagcttccatgcttctatgcacataaattcttctatgcttcttcagatttcgtagaatagaacagtagaagaggacatcaaaggcttcttttctacctgtaatatttccagctataagaacgaaatctaacatacacaataaacatcttttcttgtgaaattggtttactatgaaattaatgaaaccaacacgacgagttaattgaattgccgacaatgaaagggttcttaatgtgcatttttagtcctaaaatgcaatttcagtttatgaaggttgaagcatcaaggaatgtgcaatgcatttgatctacggcataagaaatactcaatctagatggcaaaacatagacagggacatacctggtcaggatgctcatcaagggatacttggagattgagtttttttttttttttttgttgaaccttacagatcgaattctgttacccaaagattgtgaaaagataaggagaggaggttagctttggagggaatcactggaaaatggcgggaccacgtcacgacgttctgcacatgggcctttattagttatgggcttaagtactaatgagaagattacaacatgtaggctaaagaagcagcccatggtggctgttcgaacatgttccgtaacaaaattattcgtacgcatagagttttccattggaaaacacctagaggtcttccagcttgctccacaaagtgatgggctagccggtctgggttcgaagctcacttgttctatttatttgatattaggtcattcactaatattagtttttttcatggcggcgacggcggcccaaccgttggcagagacaaccgcgctgagatctgtgcaggcggtgaccgcacgcgctgcgtcgtttttttagagagaggagcggagttgggaatggggaagaggactttggtgctttcgctctgggctccgcaacgatggtcgtttcttcagcctacggcccagataagttggccggagtaacggctaggagaagtgtcgagaagttgaattttggcaagaaattcagaaccttctgaacattgaaaataaactgcattccaaagacgagcacaacatatatcaacaccgaaacacatgcaacgatgacttcccagccaaacattgtattttcacagctaagtaatctcggcgtgcatttgaccggtcggtgatgtgttctgcttctgccatccatcatccatccatgatccacgatctttctgacacgatttctacgtccctcgatttcagcctgatcagtagccatgtacactttaacactataccgcaatgtaacatgagcatgactgccatgacataacaaatgtgccagtaaatcaacgaggggtaaagtttgcactttctttgatgcatcatgtatattagtgtgtttatcatatcaccaggttagccatcagcattttcgacctttctaggtggtgtctaactgcatatatgcatgatgcatacacacagcataaaacggagccattgcatgatactggtatcgatcaatatgctaaattgccaatatgccaaattgccaatatagagttacattaaatggaccgcaaaagctgtgcagtataattgctcaattaatccttttttccaggatcattgatcaatttaattttatgtatggctatgtaacatgaaattaagaagcacgactttaggcgcgcttcgcggcgccctgccattcattaaagagttatgtagcttacagatgattataggatagcattgaatagtactcaaagaaaagcaaataatatgactatgcaagagctgctgagagcatctaaagcaaagcatacttctgaccagtttgagtaatattaagtacaaagatagtcatgcatggaagtcaatcgatagattttataatcactttatagtacatgtcggtaagaagtgtcaacattatcacttaaactatatatagaaaaaaagagtaaacaaaaaatgaactcccggctttggtttcttcctcttacccattaatttagaaatggaaaaactaatatcaaacaaaatagaaagatgagataataatttgtgcagcaagttctattgtcagtttgtttgttctatatttggaaccggcccattgggaggaagcctactcggtgcagcagcggtgggagaacatggcaaacacgcccgacattctgaagaagggacttatatccctcaccgtgttagttgtctgggagatctggaaagagaggaatcggaggatctttgaccataaagagatggcaacgagctccctgctaacgaaaatcaaagaggaggttagcctttgggctctggcaggggccaaacgtttacgtgagttcatcccgcaccctgtatagtgtatattttacgtgtaacaccttttctctctttacccttaggggttgtattttctcctgctttattcaatgaaaaggcactatcttgtgttgttttccgttcaaaaaaaagtttgtttattcttgtctttggtaactaagcggtgataccgctgtatttaaagaacatgcttaagagaaacttaagattagtggcaattctcacatttccaaatattgtgtataaaataatacatcttgaactgcaatgcagctgcttagcacattataacatgagaaagcagagccacaaggttgagaaacgctcctggaattttgacaaactttagcaccttctatggtagtagccaatccattttacatgaacagaacaaaaggagtcatcagatttgatattcccatttataatcagattgcacttatttctctctcaaaaaaaaaggattccactgtctattaacaaccatttcacactaccaattagagtagaaggcaaaccggaaaggaagataaatattagtaatttttatccttttttaacactgaaacacaactgtattatagatccaaatctggtaatatgctttttcattagtcaatgaggatgataattttaacagagctagcttgatacaaagacatgactcaggaaaagagtaagttgcatctcctaggcaaggtggtgggtgctcaacctcatggcacactaatggcacaacctcaaactgacctgaaatctaaagtggacatgaaccttcaaattttgcattgattcacttgggtgctacatagaggacaccaaaaaacttcaaagctctgtcctgaccagggtgctaccatgatagaaattagttggtgatgccagcatgttgtcggctagttctaaaatacatattgtgggcagttttctccacatatatttagtcaatctagcctcactggctcacagctccaaagtatattagtttgcccaccacagcttctgtggctcctagcagtcacttccttttatgtaattaacacataacagatgaagcttcagcgcataaaaactcagaaattttcttttcaaataagcatttagttgattcactttctgctgatatcatccgattactgtaccaaaatgtagaatgcctcatagcactggtgaatcctggtgtaatatggatgcaaaatcatatcattagagctagcaatttgagattatgtctgagatggtggcgagcaatcagaaccagggtaatatggatgaaaaatcctatcattagatgtagtaatttgagatagtgactgagatggttggcaagcaatcagaaccagggataccatggcaagtataactgacaaagacgttactcacatgagaaaatagagcgccatcgacctcaagcgcttgaggtgccgttgccaaaggcacggctgcgtatgatgtcttggggaaagtagagtgtgtgcacccagtatcagagctaggcgccgccacctcagatctatgctttgctgcctcgctgcgctgggacagcagaacgacgacctcgctaagccaaaccgccggttccctccgaatcaagtgctagcaggccagttcaagcgatacgccgatacgctgtctcttgaacgacgacctcaccatcttccatcgcgccatcgccagcaacgaagggacaagagaacggtgggggtcgatggcagcgtgaggaatgaggatgtaaggggagaaagggagctggcgcgacctaggaaggaggaaggcggtcgcgatgggctagcgtttcccaaggggatgggaacagagagagagagagaggagaagggcggcggcgggctagggtttgctcaggctccttgcgaagctgcgatcagggttcactctatcggttgaggcatttgtatcgggggtcaccgaaatcccgaaatttcggtccaaaatttctgaaaatttgagcaaaatttagttgaatttgaacaaatattacccaaattcatgaaaaaattgaaaaattgaaaattttcggccaaaataatatcgtatctggggtgaccgaaaatttcggtctgaaatttccaacactggttgcgattggagagacagagaggagggtgtgggtgcggggaaatcgtgtgctgctgagctaacgatcccgacggtcagatatcaatcggatggccaagccagacgattaaagagagcgctccaaattcaccagccttccagcgcgggcggaccgacatgtggacccacatgaaagtatggcccagcgaacagagaaagaacggtaaattttttttgtgtaaaaatcccacgcgccatggcaaagccaccgtgcggggcgatgtggatagcttggggagcgagcacgtcgtgctgaaatccctccgaacgccctggtccgagcagatcgcccttacttttagggccccatcgtttcgctttttttctaataagccaaaacggcttattagaaaataaaaataaatttgtaggtaaaacttttatatatgtgttcttggtgacttaaaagtcaatactgaaatagaaactacgttgaaaatatctcaaaatcaatctcataattaagtttgaaaatttaaaatttagcttttttttctgcttaatgggcaatccgatgggagccttaattaccccgactagacccctatcaaggatccaaagaacttttaccaataaaggagctcgagcaccagccgctggtgtcaccattctcctcttgcaatttcaccaccaccgccacggcctctgcctctcgctctctctctctaggcggcgcaaatggcagcctgcgtcgataagtggccggcggcgtacccgtgccgcctgccggataagttctactgcgccttgccggactgcaccaccacggaccgtccggtggcgccggcgccggcggctagcgggagcagcggcgactacgtgtgggacgcgctgcgcgccgaggcgcaggacgacgcggacgacgagccgctcctccgcaagttctaccacgacctcgtcctgtcgcggccgtcgctggagtccgcgctcgcctcgctgctggcggccaagctctgcatccccggcgcgctgccgcaggaccagctccgggacctcctcgccggcgcgctcgccgcgcacccggaggccgggcgcgccgcgcgcgccgacctcgccgcggcgcgcgaccgcgacccggcctgcgccaagatggtccactgcttcctctactacaggggcttcctggcactgcaggcccaccgcgcggcgcacgcgctctggtccgacaaccgcagggcgccggccctccttctccagagccgcgcctccgaggtgttcggcgtcgacatccaccccggggcgcgcattggcggcggcatcctgctcgaccacgccacgggcgtcgtcatcggcgagacggccgtcgtcggctacggcgtgtccatcctgcacgccgtgacgctgggcggcacggggaaggagtccggcgaccggcaccccaaggtcggggacggtgtgctgatcggcgccggggcgagcgtgctcggcaatgtgcacattggcgacggagcggagatcggagccggtgcaatcgtgctacgggacgtggcggacggaaccacggccaagccgatcatcggcaagaaggcggagccgcaacgagagcttcccggggtaaccatggagcagagatggtcggattgaatggtttgagtagcgtgcagtgtgaacgcgaactggttagtacaatagagtttccctccaaaagttattttctggtgatgactactcttgtaaacctatatacggagtactctctagagattagacaagtactcaattagcattgagccatttcaaatctttttttctttttttttctttttctaaggaataacgaaaaacgtttctgatcatctgttgcctccttgtaagtatagtaggagttcatcctctcatatgtgtttttttagagaaggatattttttacctggcctttatatccaaccggatatatgcagccattttaattaggaatttagcctattgaatagggaatttagtcttatcctcttgtatgttcttctgctgaagatcatagtatttttcttcttacaatgtgaagtacggatgctttcttaaatacttgagtagtacagattgatagtacataccgagtactacagtttctgattctgaccaagtataatggtttgacgaaaccctacgtgaaggtggtcaactagccagtagatgagtagtggataagtttattaacttgactagagcacaaagtatagtagcccaaacgaaaacatgaccactaaactgtgaacgagttgcataaatatagccgcagagaacacttccttcaagacttcgtccaaacaaatcggctaaatctacagcctttttcgtgtttacatcgcagacgcaaataattgacgatattggtatcctgcgaactgaaggacgtcaggatagatacaagtggatgcgaactgtggttacccgacgaaagggacttttgtgataagctaactcgatgaggctctctgtcagcaaagtcaactttgatatccagtaatctattgctggcggaaactgcccttgtgtccgtgttctccaatatgaagtcccaaggaatcgaatatcgagtgcttctaccatgattttccgtgcttaattttgatcatctgtcttaattaaaaaaattaaaaaaaagattaaaaacataagtcacaggtactattcatatttcatcatctcataataataaaaatactaattataaaatatttttaaataagatggacgactaaagttagatgaaaaactcattgttgcttaaaataagacagagggagtaagatattgcttgcggaaactgcccttgtatctgggctcaccaatataaagtcacaaggaatcaaatgcctccagataacggtacagtccactataaacttatatagctcatattagttaatactccgaccgcccctaaatataagggattttggttggatattatacatcctagtacaataaatctggacagggattttg

SEQ ID NO: 78754 - DNA, 28261 bp, Oryza sativa
taacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaacactttgaacgatatatagtctgttatgcatgataagcgtccaaccaaaatcccttatatttagggacggagggagtatgtatagtagatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgaggaggtggctcgatgatgaacctgaggagaaggacacctcctgcatgacgaccggcgatggaggcggtgagttcgggcggtcggtggtggaggcggaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtggagtgcgtgcgcccagtatcagagcttggcgccaccacctcagatctatgcttcgctgcctcgctgcactggaacaacagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctaggaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaataacatgtaagtacataatatacatcgatacttaggaagtgtaatatttctgcatgtcatagtcagacaatcatatcttaacaatccattttgaccaaaagtttaaccaccaaactgtccgcacagaagaagcatatgttagacaacaaagtaaaccatactggggttaaaaaatatagagtaaatttcataaaactacatatattttgcacattctatcacaaaactacagatttaagaacttatttcacaaaactacagatttagtgtctacgtttatcacaaaactacaggtactttgcacaatacatcacaaaactacagatttaagaacttgtttcacaaaactacagatttaatatcttcatttatcacaaaactacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatctcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaggaggcatcagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaaccttccctccaccagcgggcggcgctcagccagacattggtgagccgctcgagttagaggcgggcctcttcgtcacgggcgacagcgccggtgcgaacatctctagccctagccatctttgacgaccccctccaccatcggcctcgctgtggaacgtcttttctagatctggacaccatgtctcctcccgatctgctcttcctcgacctcgcggcttcggaccggtgccatcgtcgtcacctccaccgccgtcaacctgggggaccacgccggcactccatctccgactcctcgccggcgatcgatctcctgacagaaggggatgtgcaggccggctgcaagagcggaagagaggcggctagggtttgggagggtggggtgaggggtgggcgccggccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatttgacatagtcacaaaatttccagggttatctggctccaattgaaccagtttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcagagttgtgaatgtcactgaatctggctgcatcccacaacgcaacattgcatccacaagttcaagtgccctctctccatgcccattctttgcgaaagcacctatcatcacattccatgacacaacatccttccgttcaatctcgaagaacacatgttctgcattgtcgacacatccaacacgtgaatacatgttcatcaacgcattccacagaattgcgtttgaaccactatcaccatggtttctcaccatgtgcccatggacctgtcttccagactccaaatcacaagcccccagcacagcaaccgcggtacgggcattccctcgaacacctcttgcgcgcatctcccggaagcaatcccacgcctcgccattcatcccggcaccagcgaaccccccaatcatcgcgttccaggacaccacgtcctcgccgtccatacgatcaaagatcctcttggccgcgctcaccctcccacacatcgcatacagcgcgacgagcgccgggccggccgaggcgtagaaggccagcagtggcgcggtctttaccccgtaggcgtgcgcggcgcgagcggggagggaggcggatgcgcggcggcagcaggagacgacgcaggagaggagctcggcgtcggggcgggcgaccgcggcggcggagaagagggagagggcctcccgggggcggccgtggcgggagagcgcggaaaggatggcggtgtaggatccggtggaagggtgggggatgagggagaaggcgcggagcgcgcaggggaggaggccggaaagggagtaggcggagacgagggcgttggaggccgggagcgaggaggggaggacccccagcttgagagcggcggcgtgtagggtggagacggccggggcggcggccccgggggtggtggcggcggagacgagtaggcgagggagggagagagggtcgacgggaagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtcctatatatatatatatatatatatatatatatatatatatatatatatatatattataacacggccgggaggaggaaatgaaaaaggagccatgatgagaggaatagacagattacttacatctatctaccctaaagttcaacaaatactttcactcattctttcattcatcactcaatggttcagattatccctgtgaaatccaatgctccagattcaccctccccacaaacgagcgctcccttcccaccccaaccgcgcccaaacctcaccatcacaccgccccgccacgattgacgtcgccgctgaccccagcttctcgtagaacgctaaaccctaacctcccctctctccccaccgctcgaggtcgcgccctcatcgctgctgctcgtcgcccggagcgagcgatgcggtcaccggagatgagcacaaccgctggggcaccacgctttctcgatcggaggccagcaggatggaggaggttgcgggagagacgccgacgccgtcacacgctgttgatccgattccttgctactagatcaggatgcagtcccttttttttcgtaatctgcatgtaatcctagggttggaggaaaggcactgtggagaggagaaagtggagacggggtgccggcgtgccgatgcagacgagtggccaagaataggtaaatagctctgttctattgctagctagcttttttttttacttactatgacaaattgatcgatctccctgttggatttttattaattctgattgaggaatgacgttttgttttgaacttttgtgccgtttgatttgcaagattactttgctagatttagcaattgtataatattcaaaacagaggctttcactatcactaattagagagcagaaacagaaagaatatagagtcagagttggtgtaccctgcaagtctgacgattggattgtacatgaactgcaatttgcatttcatgctactatggcattatgctcagtgaatcttgctgacttcctttattcaggcacaagtaatttgtgtcggatgatcaattctaagcagtgtctatgtgaataccgtttgaacaaggagctgtgtgggtttttaggattcaattctaatgaagccaaagaaaatatcttgaagatatttttcaggttattgttgtcttttgtgtccttcagagatggggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcaacaaataaatttcatgatttttgttcccaccatcatagtaaatttcatgtgatatagaggaatagcaagctaacacacgttcttgagattctttaaacaatcaattatttacttgttggtaaatcatgcatctacagttagatttgtggtttccgtgattacattacatcacctgaagtaatcaacagatttgagcattttgtgtatgcaagtagttgaagaatttcaccatgttctgcatgatatgaagtatgaacattatgctagagttactgtagatcctggcatcacagtcccttaggtttggtaaattcaaatttaccatgttactaagacatgtacgataatttacaggaatatgaaattatttttagaccaaatatattacaacaatatatataccgttgtttggttttgagacatttgaacttattttgctaaaatatgtatcttttagcatatgattgtttaattcacattactaaatatcgccgtagcgttagtacgggcatattaccagttccaacaattggccatgttttttcaatggaattttcgttaaccaaatgaaggcatcaaattcctgtgtctggggtagacgtactaggacaacacgaacaggaaaatacgcacagaacatacttcctccatctcaaaatagataaatcaactcttgtacactagaattcattcatgtatatgtatatgtaaaattattttgcttgaccctagtatgaaggtgaaatatatttaattaaatccgatccagagcacaaaatgagaagtgtttttattcataaatttctatttaaaacacacgagagtcacataccctatcgagaaggctgtaccgtctggacctatgattaaccatctggagcgttgtgctgctgttcttattacaaccacgccgaacctcgacgccggtgaacaccgcgaatttctcgtcgaaatcaaagttggacctccaccctttgtacatgaatctgacaatgcagaacctgccggcgccgagagggacgaggtgcggcgtcaccggtgagccgctgggcgacacggggctcaccttccacacattgcgccgcggcggcgaggtcggacgcgcacagctcgttgccgtcggaggagagcgcgaaccagagcttgtgctcgggcgcatactcggcgcggcctctgaacggaagcaaccagtcgccgagcttggtccatgtggcggtggacgtgtcaaaggagtaagtccccgcggcggcggcgacggtgctctgcactgtcatccagatgcatgagccgccgacggccgtgtaggcggtgaggaagtcatcatcatcttggaaaaagttgcggatgctatcaagggcatcatcggcggtgaaggcgaagggcggcgaagggaggaggcgccagtgccagtgcggcgtggcgaaggggtggtttgggtggcgatcgtggacgagaacctcgaagcaagaggagggggattgggaggaggccgggtacctttccatgacgtagatgttgcctccgatggtgagcgacaccgggaaggccttgggtgtgttcatcgggggaaggatggtgacggcgcgcgaggcggcgccgtacagcaccccgctgccgctgtagtcgacggcgaccacgtcgttcttttcgccgcctctgccgctgccgctgccgctgccgagaggcatgaaatccacggaggagggccaactcggaagcccgtatgatgggcaagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgggggctgttcattctcgccgccgccgccgccaccgccgccgagagatccgatcccccggatctaatctaaaacgggacgagaaagagcctggatgaaatcgtaaaaggacgaagggaaagtagtactactccccttgccttggtgacggcccaagaggaggccggagagggagtaggcggagacgagggcgttggaggccgggagcgaggagggaggacccccagcttgagggcggcggcgtgtagggtggagacggccggggcggcggcgccgggggtggtggcggcggagacgagtaggcgagggagggagagagggtcgacggggagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaaaaaatgttattgataatcaagacttcaatcctaaccgatgaaatgggatgcaatattcttttctcgaatgcacatacacgtagtcgtaccaactctatcactataaacacattcaaaaatttaggttagaagtcaccgcagatacttcttaccacaaaacttacctcgaattaaggcacctttgaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcaaacattgtcggacatgttgcactataagtagcctagctaattaatttatacttaattcatccgtataaagtaatttatgatagacacactacgtgtaaagaacacgtaggccaaaatcttatatttctaattaacatttttgcatatatatatatatatatatatattaaaatcaaatagctatatcaaccatgcgaactaatgagcaccctcccccccccccttccccgtaatggaacttcaaacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcagagcagcatgcgactatgtcctcgctcacaacgtccattttgcaagtagaatcgtatcaatttgacagtgttgtaatttgaactcaagaggattaatttcaaaacaacgtgccaatctccacgtgctcccagcaatgacacacgggtttgtcacgtttcccaaacttagcccatcaaagaaaggaatagaccggaagaaagcccatcacgactcgccttcctccctccgcccgttcgccgcagccaccgaaccaccaccgcctctctctctctctctctctctctcctctctctccggcgaatattccctcccccctcgccttcctctccacgccaaagccggcaaccgcgccgcctccgccgcgcccaacagctcagacgctaccggagtccggcgactcgacgcgacgcggcgcgacgctcctccgccccggcgatgctgcggcgcgggctcctcgtcgtcaatcgcctccgcaatgtccacctccagcgtctcccccggcatcgcacgcactgctcgagcggtcccgcctcggcgccgtcgacctcgacgacgtcctcgtcggcgccgctccccgtggccgcgcctcccccgccccaccacctcgcgccccgcggcggcggcggcggcggggggccccgacgccgcctgaccccgctcctcgccctatccacgctctccctcgtcacggccgcggggacgatctaccacatctccgcgtgggacctggaggggacggtggagaggtccagggcgtccgcggcacgcgtggtggagcggatgcagcacacctgcgcggcggggaaggtgctgtgcaggtcgctcatgtccgtgctgtcgtccgccaaccacgaggtgaggtccgggttcgagctccgcgtcgccgcgctgctcgccgacatcgcggccgccagcgccgcgcgccgcgcggccatcgtgtcggcggggggcggcgccgtcgtcgactggctgctcgagagcgtcgtgcggcgggccacgcaggcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagctcttttggaagaccagagcttgactttggctccttctgtccctgactggtgctcaagtcttcttttgacagcttctcgggctgctgagaatggtgacatggcattggctcaaatgtcactatcaactttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaatgcgtgtgccgccaactgttcttagtagttaagttggttgataaatgagttttagataaataaacatgacgataatcagactgaaaatactagaacgtcaagaacttaagatcaccagtataatatagtatgtcacatgttcagatttatgacaagtattaaccatggaggaacaatgttctaaacattccatatataaaatttgctttgttatttggcgactctataaagtgcttcatgccagatgctgtttaggttttttttttttgggagctatcttcttgtctttcgaaacatttctatgaaatacacatgttttgatatttttattttaattgtgttatattgtttgaaacaaaatttgaatatttggttgctactagcctgctacttttcttgtgcagagtttcacattttctatcatctgccattttcagtttagtgctgctctttttggatgttacagtataacttattttgtgttataaagctttagcttaactcctgatagtactcctgatagtactaatttcacaatcttgttcttcctccttttttgtcctgaatcctgatactaaccttttttatggacagaatcaagttgatcaccataatgcttcctctgcgactcagatcttgaatcaattagctactgctgttgtgaaattggcaatagttcaatcacactatgatcctgcttctggtgacaaagtaccccttttcgattttctctctcttgaaccatttgctacagctctgaagaacttgaataaaaagaacccacctaagtttgatgctgctgactcagcatccgctacgctgaagggaataaaagcactggcagagctttgttctgaggatggtgcatgccaaaagagaattgctgatttaggagttctttccctgttgaggcgcatcctccttggtgatgattatgagaaactcgctgcgatcgaagcatatgatgcatcacgaattcgagaagtgcaagacaagaatgtgtctacctctaatgactcctctaatgacactacttctgatccctccagtgtacgggttcctccagcagctcatattcgaaggcatgctggccggctggttaccattctctctcttctacccaattcaaagaaggaaattatttctgatgatgtatggtgcaagtggcttgaggaatgcgcaagtggacgagttccttgcaatgatttaaaattaaaaagttactgcaggttaactttgttaaatgtattctgttctgaggatccaaatacaggaagcacttctgatgaataccctgattcaaaaagtgagtataaaagaaaatgtcctcagtttggagatgctttgttcttgttaaatccagagttgcctcttgaggttcatttggacaacaatggtcatgaaatttcaagaaagaaatttaaggatgactgttgcactgaagaaggtggtgactctgaaactggagatgctccaagcaacagagccaaatatacaccccctttaatggatgtcgtgttcgtccatggtcttcgtggtgggccattcaactcatggcggatagctgatgacaagtcatcaaccaccaaagcaggtctggtggaaagtatagatgaagatgctggcaaagagggaacatgttggccaagagaatggctttcagcagattttcctcaagctcgttttttgacagtcaagtacaaggttagtttggtgctctgatgttctttatgtggggagggttatactggtctcttttaaaacttttgttattctggtaatattcgatgcttccctgctgatggaattattgttgcttttatatgtttggaggtcttactggtttcaaatgatttatgcagaccaatctgacacaatggaccggagccagcttgccacttcaggttagttttttctttttctttttcttgttccattgctgatctcgcgaaaacattccataattttgtgatactcagatctgatatgttctgtagttggataggagatgctcagagtttaactttaggcttatttgtttcttcttactgaaatttattcagttgaaataatatttgtatataggaggtgagctctatgctgttaaggaagttaattgctgctggcattggcagtcgtcctgttgtttttgtaactcataggtaatgatggtcgcttggttcatgatgtagtgctggaaattgttgaaaagtctgtgacagatgaaaaggcttacttattcccatttacatatatgcagcatgggaggactggtggttaagcagatgctgtatcaagcgaagctgaacaattatgacaagttcctgaacaatacgaatgggctagtatgtatttgtttgtcaattctttcaaacatctgtgagatctaaccatgttcatatcacaggttttctatagctgtccacattttggtagtaggctcgcagacatgccatggcgtatgggtttggtgtttcgtccagctccatcggtttgtccttcacaaaaaacttgcagcttatcttttttgttcaccccattctatatttatgacacttgcagcttatctttctttagattggcgagttaagaagcggatccccaagacttgttgagttaaatgattttgtgcggcaacgccatagtaaaggattgctcaatgttcttagttttagtgaggtaaaggaagatattgttattcaattacacattatgctttcattgttataatactaatatacctatgtcaactggcttcacaccttaatagactcaagtcacaccgatcgttgaaggttacggtggttgggcacttcggatggagatagtaccgattgaatctgcatacccaggatacggggaacttgttgtaagtaaccacgttataacgttcgcaccattgcgtagttaattgtgatctgctagccttgcactataacggacttgatagatcatgcatccacatctagtactctgcacagttttaacatgcttaatgatgtcaacaatatatgattatacatgttagagacacaaaacccaagctagtgtggtaaagacacaatgttgattttgtaggtatcccattgtatttttcttcttgtatgccccccaaatttcgcccatattatggggttgttcagattgatgacatttttaatcataccaatttttttgataaagttgctaaaaaaatgtctatatttagtttgttgctaaactttagtaaatacataagaaatcccgccaaaatttttggcaagttggctttggtaaggtttattttagctataatttgaaccacccttataattttcgtaaggtagtagcagtttatgcaacttgtaactggtggtttacttattattattaaaattttgcaggtcctggcgtccactgatcatataaattcgtgtaagccggtcaataagaacgacccgtcgtacgcagacaccttggcatttttggagaaaatattgaaatcgcgtctcaaagaatcagaatcctagttttttttttccttttaacttctcaaatatgggcggcctatggtatacaacacttcgggtggaaacgctggataggatttccttcggcattatgggggagattctgtttcttctgcatcagagattctcgtctgtttagttgatctgatctgacaatttgggcgggctgtgttttatgaagccttagcccaatcatacagtacacgaacgaattacatctacaaatagaggatagctgtaaatagttgcccctcttgtaagaagaaaaaaggaaatatatgtatgctctctgaatgacatgtattatttttctctcgaaattcataagcatgtaaccacacaccccgttgattatgaaattttgtgtcaatgctctatgattattagcaagcattaccattcaagcctgatgaatattttggtttgaaacccaatattgaaatgggctgttgagttcatgggcttacagtttgtagactgagtcaacttttagcccatttacttccaactaatgaacttggagtggaagaagaagaagcgacacgccgacacccatctcttcgtcttcctcgcctaaaaccctcgccttcctcctccgccgcttcccccctccacgccgacgagcaacggagcaagcgggcagcccacaccacacccaaggtgcccctccaaattctcccctaatcctctccataatttcccctaattgatacttgcgtcaagatttcgtcgtagatccccgtggcccgtgagggatttcaggatttgggcgaaatctgataatcgcgggccctcgattttgtctgtattcccccaggatggtggacgcgtggtggccgctgctcgccgcggcgatcccggcggtggtggccggtcaggccttccgcgtgaagcggcggcgggacgaggagcagcgcctcaaggcggcgcgcgggcgcgagaagagctccgacgaggtgttcgtctgcgagcgcgtgtgcacctccaagcggatgctcaagaaggtgggggccttctccaaggaccccatcccggagacctgcgtcaccgtctgcggcgtctccgagctcgacgcctgcgccgacgcatgcgcccggaccgtctgcgtcaaccagcaccaggtccccaactggaacgacgtctgcctcaagaggtgccagagcgagtgcctcaagctctcctccaccctcatgtagcatcccccactgtaagccatcgttgtttgtaccttgtttttggtacaaaccatcaagctcttcttgttcctaatgcaatccttattactacctaagaggagagcttcagacatccatagctatcgtttataaatcatgaggaatggaataggtgaatgactgcttcctgattgttttgtgcttcacatttgatcttcaacaaacaattgtgattgctaggtaccataccatgtcttttgtgaggcgtatccgaggttgagtttttcagctgggccgacgaataacaccagccaaatttatttagtatcagaggttgaatcaccccttttggatgaaatgcttatcgtgtttaatatgtgcttacctgagtgtgctgattctgatatgaaatcccgtctactatttatccgagtaggaaatgtaggacggctctattgcccatttacctccagaattgtagttttgtgcattagtattgggagtttcacaacttgctcaggtgatttatgttgcacagatgagttatctacagttcagaccaattgtgacagctaggttgtaggtatcatgtcttttgcggggggtatctgatgttgagtttatagcttggccggttttggccaaatttatcatgtatctaaggttcagttatcccatttggatgaaaattcttatcgtgtaggaattgtggttgcctctgcctgagggtgctaattctaatattaaatctcttctgctatctgtctgagaaggaaatgtaggatggctattacctattttacctccagatgtagtttggtgtactggtatcgggagcttcagaacttgccgaggtgatttatattgcacaattgcaatgattttcagagtttagagttgagagcattgcttgctggagtttctacctagtgctagcatgcgaagtagtgaaagatttgcagtttcttgctatgctcttattattagtcagacacaatgcttcctgcttcagttactttgctgtttacgagcttcagaagcttgttttctgctccagttagcttcttgttttaatgtttagtaacaactccctccgtctcaaatgtactaggtttgtttattttgagacggagggagtacaaccttccatggctgtcatttatctctaggaatgagccatggaatgacctatcctggttgtcatgttttgtccattccattaccctttgtgcatatgatcctcgagaaaattatcctaaggttaacagagaaggccttcctttatctgcattcagattacaagacagtgatggtctgaaatacatgtatcttttgcaaggcaacaatgccacatctttccggtcctccatttcccctaccgtctgctcagtgtgtgcacatgttgctatcagctccctgggtgtgaagctttaatcaccattgtgatgatccagtctgtagcctgaaactctgaatcaggcgtcagacaagcatcaggtagacgtcaaattctcctcttggattaggttaaccaagataataggatcaaaatcgtcactgttgatcggtgatcgcacacccaggccaccatggaaacgggcacctaacgcactgatcgtaaaactaagaggacatggagatgatcttgaacagaaaagacgcgcgacaactcccgctctagcttacgcatgcatatcgttctgtttcgtatagcatatggagtagctggttcagataataaaactatttagaaatccccctgaaaatgctccaaatgttcaaacacttcaaaacgcctctatactttaattctttgggtaatgcgtttgtcataagcaatgctgaacagtcataatcatccagcacaaaatacaagatattcgttttatatctcttacatactccactgtacataaacttgctgttctccccatcaagccatcaatcttatatatatttacagaacaaatttgcacattagactgtggctaatcacgcttaacatcaacacaagctcgagaaaacagcatcgtggaaagacaagtggctaatcacatcagtttgccacccgcacgccatagttttatactacttccatcccagaagactgcagttttgcattggttgtgttcaacatttaccatctgtcttatttgtaaaaacttttatgattagtatttttattgttattatatgataaaacatgaatattactttatgtgaaactatttttttaataagatgggcgatcaaacttgaacacgaaaaaccacgactacacttaaattggggcagaggtagtagagtttagagtgatctaatgcattatgcatcgttgtctagaggtgacacgggccgacatgatgcccatgtccttcctccaaggagtagatgatgcgctcgaacgcctcgacgtggtgctccgccacggccatgaacacgtcgacgccgcccttcgccgcgcgcgacgggacgaacaccatcagcccctccacgggcaggtccggcggcaggaacgccgccggcgagccggtgccgaggtccatctggtggaacctgaacccgagccagctatccacctccaggtccgggcacaacatcgtgcccgccgccgccgccgtcgccacgagatccccgccgccgccgccgcccgccgccgccgcgccgccgaagtcgacgaacgactggatgtactcgccgtcgaccctcgccacggcgtcgcggatggcgcccacgacggcgccgtaggtggcgcggaggagctcgcgcgcccgcatcctcgggaacgcccagagcaccatgttgccgaagaagtccatgggcacgggcgggttggctctgccccggcagttcaccgccaccctcacctgcgtgaactcctccgggctcaggtccctcgccgccgtgatcttcttccacacgtgcgcgagcaggcactggaacgtgctgcaccggccgccggcgcgggccttgagctcgccgacgaactccgccgtgaagtgcacggtcaggtccttgatcttgtccagggacacggcggcgtaggacgacctgccgccaccggcggcggcggcttctcctccgtcgaactcgatggaacggtggtcgaacgccggcaccggcggggtgcgg

SEQ ID NO: 78755 - DNA, 798 bp, Oryza sativa
cttggaaaaggcatcgtgcctttaacaagccaagctctcccgtagtcggccgtcttgcaagcgaatccctccggatttttggtcttgcgacatgtcgaggggagagggatcgcgctgtcctacggggggccgaacggggccgagaggggtttggccgaacccctggtttggccgaaccagggagctcgctgatgggctccaaatttgctggggagcctggcactgttgcaaggggctacgcccacagtgcatttaccccttccatggtgtagtgctccaccgggatcaattgattcgccggtgtcggctctccgtcgaggttgtatgtggaatttgaggaggagccgatgaatgggatcaaagatttgtgtcacgaccggaattaacccaacgggcgttccttacgtgcgtgtattattccttgtcccaggaggcaaggtacaccaaaagtttatacatttcagagtttatcaagcggaagcgtaaatagttaatttattacatgggcggcgaaggcccagcacacacaaagacaaacgggaaacagcggaagactagggcgatgaccgcaggcgcttgacggcaggcacgagctagacaccaaaggctttcatcttccaggaactcctcttctgagtttggaaaaaattgagcaagactgagtacaaccaccatactcaacaagacacacccataagtgcagaataaatgcaagggagtacaagggggttataatataaagggttagggtttgcagtaaacagcattaaagacacttagttgctcaaagctattttg

SEQ ID NO: 78756 - DNA, 13489 bp, Oryza sativa
catgcacttgaaacgggtaattatgtgccggtacgatgtacggatatgtccatgaaaaacttggtggagctgaaccatcattgtagcgagcttacaggttttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttccgcccagacagagggcggcaagggggccacgtgtcgtagccccccaaaacgaccgtcctgcaccgtgtgccacgtcagctttttgctgatataacatttctgttaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtggtcctatttattattattattattattattattattattattattattattattattattattattattattattattattattattattattattattattattattattagtagtagtagtgattgttctttcgtgtaaacaccatatagtatgaagactaggttaatgtaccacatgagtaaataccaaccttagtactgttccgtgagtctttttaccgggtttaaccgttgagagagtcgttatacccaattttttttacgattgaggcgaacgatgatcgtacagagtcaaactagactttatttaaagcttttatcgatcgtagtaggccagggcaaaatcacttctctatcattgcccagctcttgatccgcaagtacgttcggcccaattcctagcaactttgattgtttaggcccatatttcttgcaggatactggatttcgctctcggtctatcccgtcttcgtcttcacgcgcggggactcggggaggctcaaaatttgccgttgcgaagtgtccctccttgtcgccggcgccggcataggcgaacaccatatttgtcttgagacccagactgtgcctgtgacgtcgttgcgttgaggacaagaaaacaacatgggccatgtcctgatcgatcgatccagaaataagttcactttaggttccttactttgatggtgtttgaatcttctgaagatgaagattaagcgttaaacgaggtagaaataacgtttgaataattaagttttaattattataaacttgaaaaatggattaatctgatattttagaacaactttcctatagaaagtttttacacgaaacgcaccatttagcagtttgaaaagcgtgccactttgatccaaaatttaatccactatttttagtggattcgaacagggcctttatcaacgagtatgaaatttatccctaaaccaaaataccaaatataacgagtcttccaattcacaaaaccgaatcactcgaggttctagacagtattatgggcatgttcactttgatgcaaaaaaaaaaaccttaccaaattttggcattgtcaaaattttggcaagatttcttatacagttaccaaaatttggtagcaaactaaatgtagtcacttttttgataattttaccaaaatttggtaaggttgaaaatggcatcaaagtgaacaggccctatgtctggttttaattgacatggcaagctgagtctgcgtgggatccacacgggccccacatgttaattgaaacactttcttccacctctcacttctctcccctcccttcctcatcctcaccgcggatcttctcaccggcttcttcccagccacacccctcccctcctaggtggtcgtgcggccgtgtgccgctgttgccctcaaaaccattgtcccacctacgtcggtgataaaatagtagagagaaacggagagagggaggagaggatgggtcactaatgtgtagggttcgccaaatgctattttttttatttagactgaattgccctgacacgtggatctcacactgactcagcttgttacgtcagctaaaaccggatataatactacctaagacctcgggtgatccaattttacaaattgaggaacccgttatatctaatattgcggttcatggacgaatttcggatttgccgataaattaagggacctaaagtgaacttattccatcgatcgagcatgagcagcaaggaaggccctggccggctgctcctcgttgggccttgttcttcttcgaaggtctctccaatccaacccgtgtcagctccttccctcccattcgaatgcgcctgcaagtgccagctatataacacaccaccttcttcttccttccgctccatctccgccttgctcccaatccctcctcttcctcgtcctcttcctcctcctcttgcagtgcgagctctcccaccgccccatcccctatccatggcgaccaaagcggcgctccgatcgttgtggtcggccttcgacaagcaagcgtcatccatcattgacaagctcgtgtggccttggctgatgccagcggacgataccgaggagggcgcgaagaggcgcgcggaggagattactgaggagctcgcgcagctggagaagaccaggatgacgacgtgggcgcgatcggtggtggagagcttcgacacggcgcctcctccttcccctccgccgctgagcgctactacgcctcatcctcctcctccgtcgcctgcgaccagcagcagcaggacggcgacggcgacggcgacggcgacgccgacctcaccgacaccgacacctcccccgacctcggccactttgctgtggccccggcctcgcccgacgaaggaggaggagggggagggcctgcagcgacgcacggacgcggtgctcgtgaagaggctgaggagggcccgcttcgcggcgtggacgagtgcggcgctgcacaagttcgacttcgacgacgccgcccccacggtgcctcctccgccgccggccaccatgatacctcccccgacggtgacggctacgatcacgccgctgtggcctccgcctcccccgacgaagaaggaggagcatgagggcctccagcgacgcacggacgcggtggtcgtgctcgtgcggatgcagaggagggcccgcttcgcggcatggacgaatgcggcgctgcacaagttcgactttggggccgctccccccacggcgcctcctcctccgcagccgctgcctgttgggaatagtcccacattgaaagtttagggggagtggcaccaacttaaaaggggaggggtcccttacctcatgagctagcttttggggtgtagaaaggctttctcccggttgggccaacgtctaccggttttgggccaacaagtggtatcagagctcaggtgccatgtctggagatggtgtgtacacgccgccaccgccgccaccgatccgtcgcagcagcggtggcggtggcagcagcagcggcaatggagatggtgtgtacacgccgccaccgatccgtcgcggcagcggtggcggtggcagcagcagcggcaacggcggggatggcagcctaggcggccatgagctcgtcgtgcagcaagtgaaggaggcgggggtgacgttacactaccccatgctcggggagaacaactacggcgtttgggcggtgaaaatgaaaatttttatgcgtgcacaaggtgtgtgggctgccgtggagggcaacgcaaccgatgagaagatggatcaaatggctctcgccgccattgtccaaactgtgcctgaggccatggtgatggccatatccgaaaaggaaacggcgagggaggcgtgggacgcccctcaagcatatgaacatgggtgaagagcgtgtcaagaaggccctactacaaactctcaagagagtgcttcatggtatgtacatgggtaatagtgagaaaattaatgattttgctttgaaggttaccacgatcgtgaacgagattcattctctcggcacgaaagtggaggagaccaccgtcgtggagaagctcttgcattccgttcccgacaagttccaatccctcataagcaccatcgagcagtggggggatgtgtcggagatgacggtgacggagacaattagacgtttgcgggcgttcgaggagtcctccaaggggcgacgtcgtgaaaacgcaggggaggagcagctgcttattgcaggggctgagcaacggctcacacgcactgagtgggaggccattgttgctaaagagaagaagagtgatgaggcctctggcaatggtgagaagaagttccgcggcaagttcaacaaatcgaagattgagtgccgcaggtgtggcaagttcggacacttcgctgacgagtgtgatgagccgcggaagatggccaaggcagtgacgcagcttgtcatcgcggacgcggatgatgagccaacgttgctgtgaaaccggttgtggaggtggagaataaaatccaacaagattagagggtgattgttagagttaatcttgttgtttatgttttcattatattcagtcatgtatacgtagtggtctgagtccaaattagctagtgtgttgcgtggcatggtgagctgatcagccgttagtgaaagcacaaagtggtgcagcactacactggccaaggtcacctgtgacgggcccaaaccctcatctttgacgacttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttggggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcgatcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggcctcaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactcctcgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttacacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggtgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatctttttgggcccatattgcctccttgccgatgtaccctgcggtgcccagccgatgcgggtgctcattccgctgttgcagtacgcgatgtgcctcgctggattccctaaactcttgggtggttttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctagatcctggtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggcggtggagaggacggcggagatggcggcagagagggcagtggagatggcggcggagagggcggaggagaggttgaggcggcgacggtggagatggcggtggagaggacggcggcggtcgagagagtgagtgaggaggcggcggtggagaagaaggcggcgagggcggcgaagagggcggagatggcggcagaaagggcggcggcgagaagggcagcggagatggcgccggtgaagatggcggtggagatggatggcggcggtcgagagagtgagtgcggcggcggtggtgcaggccggcgtcgggaaggtcggcggagagggtgagcggcagagaggtcggcagtggagaggtcgaggcggtggtggggaggtcgaggcagcggtggagaggagggcgcagagggtggcggagaggtcgagagggcggcggatttggcggcggcgaggacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacctgtgacggccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcactggaagatgttccattatgtcaaagaaagttggaggaaagtacatctcaagatgacatagggttctcacaagttctgcctgtagttcatctagtccctcgggatcaatgatcttctggccgattgcatggaaaaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcggggggccggctgtatctctgtgtccattgaaatt

SEQ ID NO: 78757 - DNA, 718 bp, Oryza sativa
  unsure (1)..(718): unsure at all n locations
cgcgcccttatttaattgtnnnnnnnnnnnnnnnnnnnnnnnnnnnnnnnnnnnnnnnnnnnnnnnnnnnaaaaaagtttctttatgttttgtgtagacacgattttgcttatggtattaattagtactgcttaatttttttattatacaaatacaatgtaatctttagaaatgagtgaggttgatcactaaaaatatatatagctaaacaaacatgtgatcatgacaatcttcagagtatcatttatatgtttgataaagatctatattttagcatctagtgtgtattcgtcacctattgttcataattgcacgagacacctttactaattttaaaaatgactttcagtggtaggcaacgtacccgtcgacagcgagctatacgtggtaacttcgtcaatgtcaaaatatgtcagcctagtctctcagaagtactcataggggtatgtgcaagtgtgcgttcattaggttgagtgtgcgcgtgttgtgagcgcctgcgtttgtaccttgtttctcaaaaaaatatcaaacactatttattgtttctcttttagtttaatggataaaacaattgagagaggacaacagtgttttgaacttgtaaggttaaggagtgtggtgaaatttatttttctaatttttctatgatttaagtgaaagtcgatgatggggtgtttcatttttttctaagaatttttaaggtttttcctgttttata

SEQ ID NO: 78758 - DNA, 1020 bp, Oryza sativa
acttcggccaggcccgagaggaagaggggagaaaccttgggccagacttggcccaaagggaaggagagggttaattttaggtttttctttttaataaactctgataattgtttttgttgcttaataattatttccggtgctctgaaaattcgagtaaaatttgagggctccttttagaacaaggagaatttagcaaaaattctccgggccacatttgaatttttcttgtacgcattttagtgtttgccaatttcttttcgaattttaattaattctattattccttttagaaaatgatttttatttcgggatgaatttatcaggacgtgacagagacggcgaccgacggcaacgaccgaagcgacggcggtgcccgactggacacccgccggcggcagcgacgcaaagaaccacgcggaggcggtgctagagaaggtgacaggctagggcgaaggtggcggcgagaagaggaggtcccgggggtccttttataggggtctaggggcgtcgatggaggcccatggccagcggcaagaagatggaaggtctagggttagaggagagagattgatccgaatcgaactcaaatccgtcgatttccaaacaaaattagccggagtttccaatagagaaaaggaagaggagatcccgaggatcatttcccctctatcaatttgatcggagaaggaaaggggcggccggattttggaaggaggaggcggcttgcggcgcggctaggcgcggccagaggttgaagacgactgacaggtgggtccacgtgtcaacggcacagagagagagaggagggaggggcggcggactgggccagatgggccgagcacgcgcaggccggggagagagagagagacttgggctgactttcggcctaaagccaaaagaaggattaaaaacatttttctttttaaattattcatgaaatgatattccctttattaaaaatatttcctttgctcaataaatcccagaaaaatctaggaactataaaaacaagagaagtat

SEQ ID NO: 78759 - DNA, 4268 bp, Oryza sativa
cacatcatcttcagtagtgtagcactgaagagtgaagacatctgaacaaatgtcataagacgcaggatgcaaataacaacaaagtgcatacttaactatccatcatagacagcaagatcttaagtccttgtctgccttagttaaagacgacagacaaatcaccaggcagcacacacaccaggcaatgcagtcatacactgacaggcttcaattcaagttcatcaaatcaaaagtatataattcattacatgaatgagcatagacaaaatggcaccaatgcttcaattcaagttcaccaaaaagtataattcattacttcaactgctcataaaacattacaactgaagaatgaagatgcctgaacagtgaaccctcaccatacaagtgttccaacacatcaatcaaattgcaaataacagccttcaggcactttcatagcgtacaagtgttccatacataattcagatatccaaataacagccttacttacatgagtccaacaatttgtcacccggtttgcttaaaacgaaacaaggaaacaagatcataataacctatataacaatatgaaccataggacaaataacccccaatgtaataactcacatatctgaccacaacttaatagctataactctctagtattcacatttcgcctgtgtgctaattgtataattcagttctcatttgctttgtgcaactaaatagtataccttatttacggcctcttctttttttccccctcttttcatgtcattatcaaagagagaggagattaggagggagtgagagagtggcgatcggtgatggactgacacgtatgatcaatggccgaaggaaaaccggtcggcgggggtgatggagtggcggaagtggcaccggtggccgtaggggcagacgccgccggcgagcaccatgcggcagacctgggtcttgtaccgagggtggcggatgacggggccgaactccgcgacgccgtgggcgaactggcactggtcgccgtaggggcaagccccggtctcctcccacttgttgcacagctccgtcttgaacatgccctggttgtacacctcgaactccagcccacccatgggcggctcctccttcttcacaccaactttgtgctcgcctccctccgcgccgtcaatgcccacgaacacgcgctgctgcttgcattgtcgcatcaagaacatcgtactagttaggattgggattttggattcagcacaggagtcagtgcgctgcaagagtgggagccagacacaacacaatggaggaattgggggatttggtctcaccgagccgacgttcaccggcttcgacacgcgatgcttgccgccctggttcagcttctggtatccggtcgaacggatggagatgctcttcggaagaacagcctgcttctcggggacggcgacgggattcatcagtgcggccggcggagactgcggcggaggaggaagagctggcacggtctgctccttggggaggcggaggcggcggaggtcaccggcgagggcgatggcggagctctgccttccgccgaacttggcgatgcggcatgcgaggtcgttgttggcgacgcggagctcggcgttctcctgacggagcgcggccgcctcgtccgcggcatcggcgaggtgggagaggcagagctcgaagcggttggccatctcctggtactggagcgcgaggtgggcgaggtggaggcggtgctcggtcgctgccgctgcccccgcaccatctccgtcgtcgacgacggagtcggaggaggacgagcagtgggagaacgaggcggcgcgccgcggcggcggcggcgagagcacgcgggtagggctgaagggggagtagcagccgtagaagagatctccaccgttggtcagcaggttgggcgaggagagccgttgatctccgctgccgaacggcttcgggccaaagtccgagtagaagcggcctggatgagccggaggtagaagagcttcctgcatagcggcgatctccgcgaacaactaatccctgcaagtaaacggatcaaaatgtcaatgaaaattccaacaaaaatcacactaaattctccacacgaagcgaaccaaaataaaaaaaaagtagagatgctttccacagaatctagctctgagaacaggaaaatcgtatcatggaagcaatcaaaaatcgcattcgaagacgcgatctcatccactgtaacagtgagaacaagtaatcaactagtttctaaatcgagaaccagactgattccacaccaaaaaacgggacaaaaacgctaagaaaaaacggaaccggacgcctgatcgcgaagaaaacgctgaatccacgaacaaaaactagtttctcaccaatgcagcacgagaaacagcaagcttaaaaaataaaaaagcaaaatcgatcaaactcgcatcccaagtggagcagaacagcacgcccaacccccaactatccactgattaactaactagtggcgcaagcgcaactaaatcaccaagcggttaaccccaagtgtagattggatcaagcagcacacctctcgattagcgctcaccacccggagcctttgattttgagaaggatgatttgggggagaaggggatagggagaggaggaggagggtgtcgtggggctcgcggctctgcctctgaatctctctggcaatctgaagaatgcaagtgctctgcacctgcgcatatataggccgccattccgtgcggtggattcggtggggccggtacgcagtacacacgctccgcgaaatggaagtacgtactgtgttgtacgagaaatggatcgcgcgcggcgaactgtttcttgccgcgcgtgggcgtggcggacgacggtgtttgggatttgggaattgggcgctgtgaccgcgggtgtttttgcacccctctcatcccgctacgcgtacgcgcacaccagcgaatacacctcttaacacacgctcaaatagagatgaaggccaacagtacttgttaatatcctattgaaaacacacccatcggcttgtgtattatatttatgagtaaattttactttcagtcacttttattatcggtatgtctatctgaatcactctttaaccaatatttttgttttagatcggataatcttatctttgttgtattttggaccaccctaactttcttatatatgaacaatctcagctatacttactcttacccgtcaatgaattcccaacctattttcttgacatatgagatgtagatcaatagatggataatataaaggatgtaagagtggtccaaagtgtcacaaagttacgattattggttaaaaggtgatctaatatgaaacaccagtaataaaagatgactcaaagtaagattcactctatattttggatatatcctagtgggtgaagttctgtacccaagatttcacctcagcatcgttggtgctttccattattcctaactattttcagtacgttaatgcaatatatcattattacaaggtccatggtcaattctcaacttgaaaaaaaataaacaagcagcatgcctaacatattcttaactcgatgcttcataacaaacaaatcgtcgagggtccactctgcaaacaaataatccaggtagctgagctactagcaaaatatatcccttgcacgttagacacacgacacacaacaacggtatgctaatatgctactcctatctagtgcggttcttgatgcaagggatcattacaaagcttcgcttgcttgctttgcttttacgggtccgtccctctctcggactccgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcaagccatgccatgccatgcacacgtacgaacgaactacacacatcaccaaccccgacctccagctgctaaaaaaatactggggatttttttttttttggctcctgctgcctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgggtgaagacatgcacgcacgcgatggcgagcgcactgatgtgcaggttggacctgaaattaa

SEQ ID NO: 78760 - DNA, 1815 bp, Oryza sativa
  unsure (1)..(1815): unsure at all n locations
acggcattgtagactgactaaccgcatagcacnnnnnnnnnnnnnnnnnnnnnnnnnnnnnnnnnnnnnnnnnnnnnnnnnnnnttaaggattttgaaacaagcaaaaaatttaacataattataattagatcattaattgattaatttattgattaactaattgctgaaatattctttgtagtattaacattaggaattgagctctgaaaaatctgagaaaatttaagagagcataattaatcatggagaatttaataaaaattaaatccagccatgcgttatatttaggaaattttatttcccatatttatcttcacttgtaaattaatgaacatttaatataatttctattattaatttattaaataatttataaatcttgaaacgaaaattcaggctgtgacaggtgccctctgaattgctccaaatttttgacaatcctgacaccccttgctcatctcccatcggctgctcggccagctgtatgcaccatattgataggaaaatgattgccatcaactttcatcggcctcttagaatcatcaaacttgatttttcctccctcaatagccgcttggatctgctgcctgaagaccttgcaatcattggtagtatgagacccggaattatgccacttgcaatactttttcttgcccaattcttcagccgatggaattgtatgaccagtagaaggttgaatctgcttctctcggagtagcaagtcaaaaatcttgtcggccttggtaatatcaaagtcatacctctcctcttttccagaattctttacccattggcatggtataaccattttgcttctcacccattcagctgctgctatttcagaatcatcatcatcatcattatccgatccatatatgtaaggacagatatggttaacctttctagagttcttcctggcctctgtaaacctctgttcatgcaaggttaccttctgtgtaagatgcgacaagctatcaaagtcttcagacgagaatttctccctgattggagtaatcataccttgaaaagccaaatcggctaactgggcatcagtcaaactcaagctgtagcacttattcctcatctctcaatctctgaatatactcatgcacaggctcatcatgtctttgcttgattgctgttaaatcagacaatttcatctcatgtaccccactgtagaaatagctgtgaaaatgcttctcctaatcagcccaactgttagatccacaagctcgctactcaagtgaagaaactccacaaggagaacatagagcttagggatcgtaatgcggagctaggggtagaacttgctgagcttaggaataattttgatacacttagtcgcggtttgtgcactaagatcaagcgtgcattcatagagatgggaaaggaaaatatgtattatgctaattagatgtttcctttcccatgaataatatagtagtaggtgcttgcttttattttttccaatcatgtaagcacttgctataaataatgtggctcattggtattaaccccaatgtttgccaaagtttgttttttttgttctatgtttaataaagttcaggttttgaataagtgtgggggagatatcccagcttctgacgtgcatatgctctgaaaattgttgaaatatctgatcacctggaagcactaaactctgcagaaaattgcagaggtattgggcaccagagtggttcggccgaaccaagtctggcccaacacctcccagttttcacaggtaagcaggtgagcacgtcttgtannnnnnnnnnnnnnnnnnnnnnnnnnnnnnnnnnnnnnncgcgcacca

SEQ ID NO: 78761 - DNA, 8423 bp, Oryza sativa
aaccttattggcaggcagccaaacatagcaagaacacaggttgtgcactgaaaatgtttgctgcaaacttgtgatcccctacacacttgccaatattagggaagagagacaagaaccaacagcaaaaataggcaagaagctaagctgccaatctgccatggattccaactccattacttcctttatgtcttcctccttgccaacttttccccctccctgcggctctcccccttacaccattacaatcttttcttccattggaggaagtaaaggttaggtttgtagcatagggagagtctagggcggagagagacagaggaagaagaggaagaagctatcggccacacggtcaataaagagagcggcgagaatggcgagcaggacgcagtacgccttcttgctcctctcggccttcatggcctccctcttcgccggctcggccgccggagtttaccacatcatcggcgccggcaaggggtggcggatggctcccaacaagacctactacgcggactgggctcgcaccaggaacatcagcgtcggcgacaagctcagtgagcatatgcattgagaattcgcaattttatctgatcttttggcgaaaaatttgaagtgtttgggtgaatcttggaacaatctttgcagtgttcctgtaccggagcggggtgtacaacatcgtggaggtgccgaccaaggagctgttcgacgcgtgcagcatgaggaacatcacaaaccggtggcagaacgggccgaccatcatcgagctcacccagcccgggccgcgctactacttctgcggcgtcggcaagcactgcgaggaaggcgagaaggtggccatcaacgtctccgtctccgcgcccacgttgcccgactccgacgccgacgccgacgacgacgacgcggacgacagcgacagctcggccgccacgccggccaccgccgccgaccttctcatctacctcgccggcctcgccgcgtgcttgctgccggcattgttgctaatatgatcggcatgcggagtcgcagctgtgtgcagtgtgtgtatgtgtgcgtattgtggcaggcaggttgggtgtgtcagtgtgtgcattgtgactgtttcttgcaactgtgtgcgtgatgagattagtacggagtaggaattaacctttggcttttggtaggaacaaagattttctacacctagatgccatggcacctatcatttccatgcgactcaaatagttatagaaaaatttgaaaatatttagtagcatcgtttgtgatgatacaagtctatacacaaacacgcaggactaaatttgatctacaactagagaaacaaaaataataaaatcagacagtcaatagtatccgtacagtgcatataaaatttgttatttttgtttcttcatatatcgatcaaatttagacttgcatgtttacatagtgtctataatgtcttatattatcattggactatcttatcaaattttatgaaatattttatataattgtttaaattacatgtatacatctaggtgtagaaaatactttttgcttttagtagcaagtgtacctgcaattttgcattcgatcgctcacccgctgctctcgtctagccccgttctttgattgctgcctcgtctcgtgccattctccaaatcgccaccaccatcgatctccgccgacatggacggagctctgtggcgacattatcgttagccgccagcccgccacgtcgtcggccatgggcggagctctcagccgacatcgtctgccaccacgtcctgtgcgaggtggaccgccgcgtggtggaactcgtctgccgctcctggcgcgcggcgctcgtagggctcgatccccctccgccgctcacgtggctcgtcgtccccgactccgaagccggcggccctgggttccactgcgtccccagcggctgccgcacccaccccttcttcaccccgcacgccgcacgcctctcgcgctgcttcggttcgtatgacggcgcctggctcttcctcgccgtcgacgacgacgacgaccaagctcaaggcaaagacgaccacgtcctcgtcaacctcaacagcttttacttcctcgacctccccccaacatgttcccagaaatgaagttcaacaacagcgagcttgtcatcgtcgccgccaccctctcgagcgagccgaccgaacaagctaggatgcatcatcgtcgccggcatcatcaacttctgcccctgctcccagggccggtgggacacatcgcgttctggcgcatgggcgatcaggcgatcttatgcgatccttcgaggcagacgagacgtgccttgaagtggaggacctcctatatacttcaatggagatttcctattcctcgctcgaggggaacacattcgtgtgtgtttagatggccaaatgggccgcccggcccggcatggcacggcaccgtgcctgggccgaggttagtcggaccggcacgacccgacctacacatcgggccgtgccgtgtcgtgccagcctatgacattctagtccagggcttaatagaattaatagaatgctcatatcaacaagttacaacttctattccggaagctaatctccaaagaactccgaggttaagcgtgcttgcgcacgagtgaggacaaagtgtgcagaaaagacatgtgttggtctgtgagggcagtctatgacctatgaaagctataaggtgtaagcgggctcggcctgggggaaggacgttacaaagtggtatcagagccgaccctcgcggggcctgggggaaggcgggacgttacaaagtagtatcagagccgaccctcggcgtcgatctagcctagggcttaataggattaatagaatactcatatcaacaagttgcaacttcttttccggaagccaatctccaaagaactccgaggttaagcgtactagagtggtcatgacacatgcgttggcactggacacatggatgtggccaagaggggacgttcctggcctggggttgatcgacaggggcgtcgatctagcctagggcttaataggattaatagaatactcatatcaacaagttgcaacttctttttcggaagccaatctccaaagaactccgaggttaagtgtgcttggcctggagcgattgcctggagcgatttggggatgggtgactgaccgggaaattcttcccgggtgagcacgagtgaggacaaagtgtgcagaaaaatatcaggtgtaagcgggcccggcctgggggaaggcgggacgttacacagcccacgggcagcacacacgctccaggcacgacccaataaaactcgggccgtgctggaccggccctaaggcacgacagtctatcgtgcttctccacaaaataagtctatttttgctccttcaactctttgggctgtgcctatatggctagaaaataagtctattttatattcctcttctctttgagccttaccttatactatgatttattaagtctattgggtccctctactttttttcttcgattgtgtcgggtcgtgctggcccaccgtgccgagggagcaacccaggcacggcacggctatcgggctgagttggcacgggcatgaccctagtcaggctgtgccgtgcttgggttgggccaaattgttgtgccttgggccgggctgtcaggtctcgggccatctggccatctttacgtgtgtgcagtgtgccaagaagaagaactggtctttgcataccaattgctaatcctatgcacaattgccatatatctcacacacgcgtacactttgccgtacgtttcacatgccacctcagcctatatagctcaaattactaggaggcgcctacatatcaagcactgtttcaccaagtagatcggaattgtttcactaagtagatcgaaaatgtctcagtattttaaaaagctgaaacacaaccaaatcaccttgtgaaacatttgctacaacgtatgaaaaacggtttccaaaaaactcgggcgctgtttctccttatataaaaacaatatttcagcaaatagcgaaaggatgttttaactcaatgcaacatttgatccatacataatgaaacatcatgagtacacttactgaaacattgttggtgaaactaaaaatgaagcggattcccttaatagagcgtttctgtaatatgcgggtgatttgttgcaacggcgtggaggcgcgggaggcgcccgatttttctgccgctgatcgggcgcatgatcgccgacgttttccaaataactagccacgtttcacacgttcaactacattttgatctacggcgcttctacgaattgctcgggttaaagtctatgcacaaactaactactgcgaactttgaatttttctttcgacgaaaacacactaactagtaatacttctgtcggtgacatgggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccatgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccagtcacagaccggtcagatcgcgggttaggtggcaacaggcggcctttcgcacgcctcgccccgtcccgtcggaatgatgagagcctccaggcactcgtccctagccggagccgacgtgctaactcctggagttagcacgtcagtcccggctagattcataccaggcttcattgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtaacagggagatccccggtgtcaggcgagtgatgacgctgggcctcactcaaagacaagctgtgatttagctttcaggcgaaggcgcaagctagtttttttgaagatagggtgagtccccacccaaaagaagagtaggtagaagtggtgcatgtggtatccccttgagatataaaaggaggaccttgctcacttaagaggggaagaagggggagaagacctgagctcgtagagaagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgctgtcacgcccggaatttctatccaaaattccaaacgcttacatgtgtgtgaaccctcgtctaggaatcagccgaggcacacaataacaaattgataatagagtacaattattactctaattaataagcgaataaaatgtcattacagaggtagatagttcctctcaatcaataaagatctaagcagcggaaagaaagataaacggcgcagacgactccattccacaggcagcttgaccagggctacacctaatcctccacaccatcggcatcactgtagaactcttcctctgatgaatgattgcaaggtgagtatatgacatactcagcaagtcacgcagcaaatatgcaagtgcacaggataacaaaggatggcataatagggttccatttgcataaacagcctttaataaacatttcagaatttaataaaacagttaagtaataattaaacaaaattaatccaacgctatacaacataccctgttgtataggcccaaccattctgaacaaccatcccggctgcacagtcctatctccaaaccaggaatataccattccaaaccaggagctaatcaaattattaccaattatagcatcttttattatgatgagaggtgtgagactaatcacgaaagacattgttagacccgcccataaccgcgggcacggctattcgaatagttttactccgatcagaggtgtaccactgtacccacaagacacaaccccacatcatgtcaccatgtgcctcaataccaccacggtatctcggaaaggagttgtgacaataccccttgcacaacacaatccattacagcgcacctttcctggatcataatcacccccttataaacaaggcatggactccctagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatatgctcacaacccaccattatcaggttttagttggcacattaattaattaaccaatcacgattgaccaacgtgaactatcattaagccatcattaaataatagtaaatcttaagttatcccaatagtgtgctaatgtttctaagcagggctaagcaattatatctaatatctagctgaaccaatatataaagctcaactagtcaagttataataacccaaggtatcaaggaataaagtaatcaagaacaaaagggctttagcaaacaataggttaattccacccaatgacattcgaaaataaatgcaatagttgaatagaaacgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttaaagacttgaaccaactaaatccgagctaagatgaattagttatgaatttttaaagatttaatcggattaaaacacttatatagattttaatggaattatgacgcaataatgaattatttttgaaaaggaaaaagggatttattgcgtcagcggctagggtttcgcggtggaccgggcgcacggcgacggttcacgggaacggacggccgagatcgatccatccaaaacggacgaccgagatcgatcggtccacgaccggctcacgggagagggcgacgatgacgtcagcggcgacgtcaccactggcggcggctcggcggctcggacggctcggacggcgcacgctcgccggtgaacggcggctcttcggcacgaacggagggcaccaacgggtagagggcgactcggcgaacttaccggtgaccaaaagagcggcggaagaccaacggacggcgacggcgacgaggaagaagcggcggcggccttcgggtcaacggtgacggcggtgctccggcggtcttcggcggcagtgaagcggtggacggggacggcgacgacttggcgatcccgacggtggccttcccgagtgacgacgacgaccgaaacgacggcggcacacggctggacgaacagcggcgacggcggcacaaggctacacggggctagggctttatcggcaacgagaggcgaaggcgagggtggcgacgggtagcggcgacaccggggtccttttaaaggggctaggaggcgacggcgaaggcccacggcgaccggcgacgcgatggaaggttcgggctcggagagagaaaagccgatccgattcgacttcgaatcaaacactttccaagccgatttagccgatatttccaaaggggaaaaggtagaggagatctcgggaaacatttcccctcaatcaatttcaccggatcgggaaaggagcggccggatttggaaggagacggcggcatggctcggctagggtttcgggcggcggcggcgcgacgaagacgacgactccgacaggcgggacccacctgtcagcgatagcgagggcgcgcgcgcggctgcggactgggccggcttgggccgaggagagagagagagaggatttgggccgactttcggcccaaagccaaaagaagactttttaaaacctttttcaatttaaattatttatgaaatacaattccatttattaaaaatacttccttagctcaaataaatcatagaaaaatctaggaattatagaattaagcaaagtatttaataaaattttatctggccccattttatattggaatttattaattaaaattagatcttctcttca

SEQ ID NO: 78762 - DNA, 6658 bp, Oryza sativa
  unsure (1)..(6658): unsure at all n locations
ctttcctttttctctgttaaatatctgtgacagggattgaagtgagagaggaaacaagccaggaaagaatagcccagaactagagacaggaccttaaaggaactaactcttcttgttgatgtgctgtttgttttacttattctgcaagttgattaagcaaacaacctagcatggttacatcacaacccaccgatgcaaaccacacactacacacacaagcaaggaaacacacgactaacaacactatcctagaggacggcttaggttctgcgactggttcccaagatcttcactccttcacagctggcttcactgcttcctccacttcgctagcggatcctgcagtcttccggagcttcggcaaacaactgacgatgtcttcttcttcactgacctgaccatctagtactagttgaaatccgaagaaggaagggagtaaaccttttgcaaacagcattaagggaaggagaaaaaaggaactttcgcaaatagttttatttataaaatatgtccttaggttttatccacttggcttatcctacagtcgagatggctctgataccatcttgtcacgaccgagaaaaatacattttcccgaacgctagtgtattaatccccgtcccaggaaaagccggggtacaccacacaaacatgatataaaagacacatctttattatatcgataatatttacattattacaaaggtacttaaggcctgacaatcaaaaataaacagcagcggactagcgggcctacggctccatcttcacaggcgctcaactggggtataagccaggactccacctaggacttcatctccaaagcttctcttactgaagggggggggaaagattgagcaagaatgagtacaaccacagtactcagcaagccacaccggcagatgcatgattaatgcaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacccaaggcctacgatgtaaccacgtgcacatctttacccacaagacacatcttcctcatgtgtaaccacgtgccacataccaccacggtatacggacggaagacgtgacatagttcccaacccatcctagccataaacaagagtaccgacccaatcccacctactgccggaacccccgggacaggtaggcaggactgagcctccagcagcaggacaccggccctgtgccatgacatctcgactaccgggccgcagctcgtgtagccttcatttgtcctagagatgtccatcgacccccgatttcgtccatctccatccgtgtacttttgtttataaccagactgagccacaaagtaagccttacccactacacatgtggaagtacggtagtgctttgcaacagaggcccgagcttaatccttatagtacccgaggtacgactaacaaaacccaaccacgcacctcgagcccagcctaaagccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggtttgatttatcctagggtgaacaaggtaataataacaataacaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcagagataacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaagagacttgaacgggtcgattcggagctcgtatgaccaagatatgatcatctgaagtttaatgctgttatatggagatttgcggattattataatttaagctttgcaattataaaacatgtgtaagcgctagcctggaaaagacaggaaggctgcgccgttgacatgcggaccccacatgtcaacctaaaggactgcggtagaccgagtacacagatacggtccacgggtcgacggaagcagatcccgtgtgtcaaccgaggcgagtggccgacaaacggactccactagacaccacacgggctgcacacgtggaaaccatgcggctaccgagcgggcacactaacacggtcaccacacgcacaagcgaacgactaccgacaccagtacacgggtaccggggtcgacaaccgcacaacgggcacgggcgacaccgaaaggacgaggacggggcagcgagaggagagagatccttaccaccacgcgacgaggcgtgggaacgacaacgacgaacgggcgcggcggaggcggccgggaacgacggagacgaacggcgaggggacgacttcagcggcgatccttggacgaaggcgagacgcggctggcacaaggcttgacgacgtggagccgaggacgaggacgacgacggggctgctgcacacttgacgaaacgcgggcggcgaacgcgatcggcttgacggagggacgaacgccacaacgaggaggaaggaggaagacgacgcccgacagggaggcgacgagggcagccggcagcagctgcacggaggtgaggacggcgtgggacacgccgcagcgatgcccacgacggtggcagcgcagccagacgacgagccgggcgatcaacgggacgtcgacgacaagaacgaacggagacgacgacgatggatcgcggaggggtttggtcaaaggggaggcgaggccgagggcgaccttgccgctgcaatgccgggggtggagatggcgacgtcggccggcgcactggcatggcggaaggggctgccggagagggtgccggcgggaccgagggagaggtggcgcgggcgacggcgttccggcgaaaccgaggagcagccggaggagaggacgacgccgcgacgtcgacggaggagacggcgacgtcggtcggcgtaccggcgacgaacagcagccggccggagacggtgtagtggtggcgacgccactggacgccggcggggcacgtctccggcgatttccccacgaatcggaggcagcgccggcgaagaggaggcggctgcgacgccggggaaggcgacggcacggccgggcggcgctcgggcgaggagggaaaggcggctggaggcggccggcgcgggggaaagagaagggcgacggcgggaacgcgcctccggcggtcaccgcgcaaaacggagggcaggccgtgggagaggaggcggctgcggggccgagagaggtggtggcgcgaccagccgacgcacaggcaaggagacagaggcggctagaggcggccggcggcacgggagagagaggaggacggtggggagaggtggtgaggtcacgggagagcgcgagagggggctaaaacgatagaacgaaggatggggattccattttataggcgtggggagggagccggccacgggaggagcggggaacggcggcggaaaagccggccggcggccatggaaggtggccggagttggcgcgtccgttcccggcgtttgggggcgccattcaagggggaattaagggggaaagagagaggagggaaaggggattaattccccctaatcaagtttggaattcgctgtttgaatcgcgtggattttggggaggtttggcgctaggtttccggggagagagggagcaggccgtgcgggaggaggaagacgaccgcacgtgctgcgcgcgtgcggggagcggctcggcgtgggccaggtggctgggtggcgcggcttgggccgggcgggaaggagggaggggaggggcggcccagaaggaggaggagaggagggagtgggccgggaggggaaaaggaggcccaagagaaggagagggagagaaagagagggaggagagagggacttcggccacgggccgagagggagaggggagaaaccttgggccagacttggcccaaagggaaggagagggttaattttaggtttttctttttaataaactctgataattgtttttgttgcttaataattatttccggtgctctgaaaattcaagtaaaatttgagggctccttttagaacaaggagaatttagcaaaaattctccgggccacatttgaatttttcttgtacgcattttagtgtttgccaatttcttttcgaattttaattaattctattattccttttagaaaatgatttttatttcgggatgaattattaggacgtgacaaatccaccccccttacaggaatctcgtccccgagattcgaggaggctagcaagaagataggttgggcggtcttctcttcttgtctgacttcttccgctccgtcttctataacaaacttgcctagctaaacttctccactctggactgcttggctcgatctcctcttgcagatggaatcttctcttcacctgacttgtccttggttgcacctctagctgtcttcgactgggttgtggcacttgacaatgggacttcagttccagaacttctcataattcatatctttggcgtcaacctcatacaagttacccacttcacgttatgcgtcgatatcagcttgtcattactaggataccatgcttgtcatcatgagaataccatgcttgtcatttacttctaacttgcctccaactgcctcatattagctttcctgctctccgggtgctagctacttctgctattccatgcgagggtcgataactttgcctttgagttatgtttctcaacagaaccaacttatcctacatgacatgcttcgacgtcttccaaaatgactttactgctagacttgttatggtctgatcgtgatcctgccaaatctgaagcttcgttgttagatgtggttttaatctgacctctatagactatctttgaacatattacttggttcataactgggaatagctcccacgaacaagcagctcggattcactttctttacattcagtttacttcccactattatcttcaggttgtcctcagttagcattcaacgtattcctttacacctttaaccttgatgtgttctttccagatttctcttatcaatcacctttcgacctacttctttgcctgatcataaacacctttgttggtatcttctatcaataaccttttgaactttgtcaaccaagtactcttcactccgagagttgtggatgcttctggtgacgatgtggtcctttggtctgctgactttcagtgaaaccttgaagtgtttcgccaaaagctgtactgactgtctttgcctttgatccgaaaaagacacatctgaaactcttagtccaaacaaatgtctctttggttaatcgcttgattttcttttccattatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacaaggcactgccttaaacaaaaagggaaggtgcttaacatcggtacattgtatcctcaacaggaatcatccataaacatagcaagctcactgtttatagtcatgaatatattgatttattacatgattgctgcaaactttctattacacaatgataagtagcgaactgaaaaccacaaacgtggctgctcattttgattctggagagatatagctggcattgttctaatgactgcatcatccttgattggttctgtgatgatgtgataggactgcatattgctatcattcacaggagaagcttccttctgattgctggttgaagcggataacggtcttctgctttgtatcgccctcctgaggttgattgcccttcgctcggcctggagtaggtcggggagagacacaacttcttccatcgacgacaattctttgctgaggctgtcggcccagagaatggttggtgctgaaggtattattgctatgattgattgcagagtcaggtgcagcaggaggagcattggtgctatggatgatatcgtcgatgttgctgttggagctgactagctgatgagacaatcgtagggtggttcattggatttctgcggtcttggtcaacaacacactaagttggcaatccttgggcacatggtttgtaccttcgcacagaaaacatgtgaccttgcgggtgggacactcccctggtggatggtcttcttcacaatgagggcagagtgtgagacacatgctagcaacgtgtccaatttctccacaataggtgcatgcctttgattccatctcttcctcgccgagannnnnnnnnnnnnnnnnnnnnnnnnnnnaagctccagtcat
